United States Patent 7,868,149 (PLANT GENOME SEQUENCE AND USES THEREOF) - sequence listing, part 43

SEQ ID NO: 22706 - DNA, 9864 bp, Oryza sativa
  unsure (1)..(9864): unsure at all n locations
acaaaatgcactcatcaaggttaagaaaagataagagccaaacaacctaagattagagaaaaaaaaacagctccctcaatatgaacatatttattatttgagtaaaagcataacaacactagctatctaaaccgatagcaattaggattaatttgttcggactccagatagcaatgatcaattagcatgatcccagggtacaaggtttgtgttgttctgccagctgaagtgatcatcagcagccatgcccgaattccagctgtacaaagcagaatctggaacagttgatgcaggttctagagtgctgatgttattggtcaccatttcagcagttgaggttgttgcagttcccaagctgtcaacatacatggcattctgagatgcagagctgatcatgctttcctggctcatctcacttggctcccatcctgaattctccatcaatccctctgcttgattgatatagcctgcaaataataaggtccaaggaatcaatgcatgcttttttgaaattaaaaataaagctgacaaagtcagggagctacagcaatttcattacttggcatgcctgaagaaatcatgggcttttcatcatgaaatggaattaagcttttatcaacaagtgccatctcattctgcacttcctccatctgatcccactgttggtatgcttggctgaccaattgcttgatttggacctgcaattgagatcaaagcaaatttaaggtaatcttaagaaattagtaagacaatcaaatttcattgaccatacagggattaattaatttggtggaatgaaggaagttaccatttggtgtggaagcagttcatgcaaagagcacatccgaccgccgaatctcactgctaagatctctcctacggggttgaatttaatctcacaaccttcagatttgaaaacatagcatttccctcccatgtcacatgattttgcttgcttcaatgtcgcgctccactgccgatctgacatgccaacaagctgaacagtgtgtgcacaacagaacaaattaaagcagaaataatttgtattatacaaattatgaactataatcccccaaagtgtttgaacaaaattgaaacaggagaacctacacttttaagcttgttgggattcatggtgttaagcttcaaaaagtcctggacgttcttgatcccctcggcctccaatctcttgtcgattggcccatctttgcctatgttcctcagcctccagacgttgtccgtcagcaaaggagggaaatgcttcttgtacactgcaggtaaaaggaactctgtgattaataatttgttccttctattgttgtacttaatatgatctgttcatcgaacttacattcgcctcgatgatctttgactgtgaagctctcactcactgcctcttggatcctcaatccgcaactgtctgtcagcatgacaacgcgcacaccgattctgaacttcctgctcctgatccagcttgaattgtcagtgaatgatacatcatcaatcactgcaactccatggttgctcatggtcacactgactgtacccactagcaatggcctcctcccttcccgagccttgacgatcgcggtgctgaattgatcatcagtccacctagcgccgtcttcatcgtatcggaaatcgccatctaggacaagtacttccagttttattgctgaatatcctaggtgagtgtttgatggtgttacaatgaggttggtccttgtgtcaacaagctggatttctattggattgttgtcgatgtcgacgagcttgttgttggtgaagattggtagcttgagctgcttggtgaagacaagcttcaatggaggtgagacccctacatcttggatttgtaatggaagagatctgatagagatggttttattgtcagattatgtgttgaatatgtttaacaagtactatttccatgcgtattgctcaaaacttgtttttgtacatccaaatttgcagaataaaaacgtttgccatttgtttcagtaatcttacaaggtttcattatactaacctctggccttgtgctatatatatgcatcttgttttaattcaaaacctcgcaattaattttcagagatagagagagattgagaaattttatttcaccatacctatgtggtaagtcatgaccatactggggaaatatgttccgaatttcctcacgcacctaagaaggtaaaaaagaaaaatcatccaaaagaaaaagggttaaatgaatgttcatatatgtgcactaaaaactgaaaagcataatgaaattcacacatacaagagaaggaaatggtatacaactacaagaagaacaaatagtcattcatatgtgtggatgcataacaggtaatgtaagttttattgattctagacaaatttattaaaattcgctttctctacaatccacagaaagtgaataacttaatttgaatccaacgtctcacacatgaaaaataatcattaattatttctccattgaaaatgactaataaatcgaggcctaatacatgggaaagggaattgctaaaaaattatcgcgaattcaaatgtgactatagtatacttgtactgtatagcatagttgtagtgtatagatgaattaatattaacttaccaccctacgaatgaccggttccaggttaagaacaatttgttgaattgtttccgctgccactgcccttctcaccaccctgcagaaagagcacacaactatcacacacccagttcgcttcaagtaattattgaatttgttcgaagttccagttgaactaaattaaaataagcatgcataatatgcaaatataatagatacaatactgttcatatctctacatatccagagtgatcaagagatcgagattatgatttatatatctcaatggacaggagaagaagcatggaactgaatcttgccaataaaccgtaatcaaatttgacgaggcttgcaaagtgatcgatcgatcaacatgaaaatttgacgaggaaaaaattgaagagaaatgagttgaactaacgatctgaaggagagcacagggcggagacgcctggcgccatggcgtcgctgctgatgttcctcggccgaaccgctgctcccatcctgatcatcgtcgtcgacctcctcctctacccgtggccttcgcaccgacatcgatcgatcttcagaaccaagaagtaaaatcgatcatctgcttgcagggcgtacgtgcaagaacaatattttcagaaatagttacacgagcagtaatatgtaactaatgactgaaaataagctcgattgctaattaactagacgaatatttatacacacaataattaagatgagataaaaatgaacgcaactgaaagtacctgtctgccgaactgaacaattaatcaaactatatggctagctagctaattaagcttagccataattgcacactaactatataatatggggatcctctagagaaacgggttgttggtagcagtatatataggccatggagatagagggccctggtcatttcctaggaattgttacagaggaagtgaagaagttgctgcaagttttctcctgcagtcgacagaaagactgtggatggatgagagacaggagaatgttccggggaggccgcaggaaggtagctggaagctatgcctcgccgtcgcatatgcatcccaatttctcgcgtactactagtagtagtagcctgcatgtgcggctcgcgagaggaagtagctgcagcttttgcagcagttatatttaccatttacgttatatatactccttggttctactccatttttataacaccaaattagtttcattaaaaactataattgaatatattttcataatatatttattttaagttgaaaaggttgctatttttttctacaagattagtcaaacttggaacaggttaattttgaaaaaaaatcaaaacgacttttaacttgaactggagagagcagaatataagcttttttacttatgaatctgaatatgtctatattctttgtaaaaattactactccctccatctctaaatgtttcacgccgttgactttttttaaacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggtatgtattttgtagacaacgaaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacggagcaaatacgtatacgtgtagcatggatgcgaccgagcgtgaagactcggtcggtcggtccgccgtgttcatgttacatgcggcgacggtttcatgactagaccacgaccaccacagacgacggcatggtcgtaggttaacttccagggcccttctgtcaaactaaccactctgggacgagatatacgtagtgcaaaacctaggcaacatactagtatagtagtagtggtgtagtaggagtactactgtacgcacttccacgaacattctggcctttctcggtcacatttggattttggagatagggcctttttaatccctggcaagttttttcctcctatcatatcgactgtttggacacatgtataaaatattaaatatagacaaacaaaaaaactaattacacagattgcgtgtaaattgcgagactaatcttttaggtctaattgctccatgatttaataatgttgtgctacagttaatatttgctaatgacggattaattaggcttaataaatttatctcacagtttacaggcggaatctgtaatttgttttgttaatagactatgtttaatacttcaaatgtgtgtccgtatatccgctgtggcatggtaaaaatgttcacccctgaatctaaacacagccataatgccaatatcattaacgtgatgtatcaatcttagctaggttgaataatatcatagataaacaaaaataatatatagcttaagttttccttcgagaaaagcaatagcagaagttcgccgagagctgacaaaattctagatcggtatgcgtgttatcctatggaaatgtaaatatactcaaattaagttgaatagaaaagttacattaaagttcgaattttgatttaaaaaaactacttcttcacatactcccggcccttatctccactaatcacaatagtctcttatttaatttctcaatttacttttccacctcaaccaatcacaatcatctctcattaatttcacttttttttatatccataaaaatctccgtgcaagttgaaactattcgtgtacaaatttaattaggtagctaataaataagaaaaagactttctccatttcaaattactcaccatttgttgtaggtttatcataaataaaatatgtgaacattaatttttgaaaattcgtgtagtttaacagcatatcaattatatactaagaaaatatttctagtggtgaatctataaataaaaatataaatcttatgatattaaatctatatagaaattggtatttacatattaaaatatttaacttacgacaaacctagaatggacgataagtaattggaaatgaaaggtaggaaatagtgtttttttttaatttctgcttaaccttctttcaatcgtggtcgcttcgaacggttaattttatcagatatgcaatttcgttgttattaaccagctagttgacaggcgactggacggaccgacgaagaacgccgcatggtcagtatctaccgaccaaagctaagcttccaccacttttctgcattcctcaatctctaacgaaagcaactactggtactagcgtttttttctacatctcaaaagttacactttggcatgacatctccttaatttggagagacttgagtagaccacgccaccatttaaattaaagtgcgttgatcgccggtcaactaaacagtgtatgagtatgacatcagacagcgactgttaattgattagcaaacaaaatacatcaaatcgagcaagcattcaggtatacttactactctaaatctattataagttacatccacctaaaatcccttacaatttaaaataaagggagtacctgacgttcatgttcctagttttcatcagcgaatgatggcatgatcaaatcctagccacggccccacccaccctgatagaaagatttgttcttttaagagcaggtacaatagcaagctataagccagctgcaaacatattttaagaagataaataaggagagagaagagcagcgggatacagatttgtagccaggtgtagcacgggctccaagacgtaatgtgtgtatgacaggtgggaccagatattaatagtgtaatatgtaactattgtatgaatgagctattagattggctatatatgaattggagctattagttggctatactattaaactttctcttagacctgaaacaactagaattacatatgttaatttatttcgagacaggtcaacacatgttaatttgaacttgtggaaccatacagtaataaatctcctacaagattttgcaactgattttgatcgataccgttccgtcccaagctagccagtagcaatatcagttcagctgtttttcatgtgcccgatcctctactttagccctaacttaatgcagcttgactttgtaccggcagtcaaggtcaaggtcaagtatatatgtagatagagctaatttaagtctacaagtagaaaagaagaaccaaattaacaaatctccctctctttctcggttagcagaccaaaagaaactgaacgtacaaaagttccattcttctatctttttttttaaaaaaaaagtaaagtaaaacccatgacaaaagctccatttttattttaaaaaatttatcaaatcccatgctttatggtaaaaaattaaaaaaatcgcatgtattatagcttgtaatacatataattgcatgttttagttttgtggttcaagtgttacatcagtcttgttgaaatctcaattaattttagtgtgtcggaaacaatactaggttttgaagtagtgaagagttaaaataaataacctaataaagaaatcaaaaatatattttacactcaatactctaaaattttaagtaaatataacttcaaaactcctgtcaccagaagttcagaatacctgaactttgctaaataaaaatatgttctataatccaggccaggatgggccgggatggatagaagcatgcccgtatgggctggaaattgcaataggaataagttcactttaggtcccttaatttgtcagctagtctaaatttcgtccctgtttcgcaataccagatatggcacgtcccgcaactctcaaaacagtataaataaggatctaaggcagtttggatggcggtttcggctgacgtgacacttatgtggtgttgatatggcacttcaagcaaaaagaaaccgttggacccacgtatcatccggttaaaaataaaaacaatacagtgggacccacgctatcaacccatatctttcccttttatcactcttcctcctctctcatcctacccaaccgtgcgcccaaacccgcgtgcgctctttggagcgtcggagccgacagtggcacgcccctggggtgcgcctgaccggccatcgccgtcgcgcttttcggcgttgggttcctcctccttgacccgctcctcgacagcatccactcccgtgacgcgctcatatcctggtgacagtgactcgtccatccttcatccacactccttgtccacgcagtacatggaggaaccgagcgagtttgtacactaaccgtcaccggtggtgaacgagtagaggttgcttgtggcaaacgcacccttggcagcccatccaagcgtcatctctgcggacaacatcgcaaagaagggcacggacaccacatatgtgtccctccagtagatgtcggggtcgtagttgagcgcgcgggcacggatgcgaccagtagaggtcaaggaggccttagttgggtgcgcgagcgagtttctcaacgtagaccctgaggccacgatcggcaatttgctgctgtgggaagaggagcagcagggaggtggggcgcaggaggaagaagaagagggagcggaggagcatggtggggacggggaggcacgccatggccgtcttccaaatctcgctctgcttgcttcagatggaaggagccaccatggtctcgctcattctgtttgcttcacctactctctcccgctgctcccctttttcacttccacgaccattctcctggggctttccatcatgaagttggatgtggacaagagcggcgacaacgcgggggcagctggtcttctgttgcttctagtggcgcccgctgtgtccgtcataggtatactgctttggctcgcgcgtgcgcggtcaaacctcgagcccgcctgtcctcaccctcagcttcctctccccacgcccgaccatcttcgtctcgaggcatgtcgtcccccaccgtgcgctcgtccggtgcaacaccgcgtttgccagccggccgcctgccattgtgcctttctgcgtgctcactactagccagtgcaccgtcagctccacaccgtgtcccaacatgtgggttactcactaacacgtgggtcccactttttatctaacttgaagtgccctgtcagcgccacgtaagtgctatgtcagccaaaaccgtcgttcaaactatgttgagaccttatttgtattggttttggannnnnnnnnnnnnnnnnnnnnnnnnnnnnnnnnnnnnnnnnnnnnnnnnnnnnnnnnnnnn

SEQ ID NO: 22707 - DNA, 3810 bp, Oryza sativa
ttcattttgggcatcatgacccacatttctgttagaaagttgcaaatgtgaccagcattttctgccagataaatgattgaattgatgcaggtgttgctacaccggttggtggactgctggtgcttgatccaagattttaagtggctgaaattgtaaggttggcttagctgatgaattatgtttggcttagttaacctatggttaaaaagagaacttattttaacgacaccctctttaccttgaattatttaagtccaaatcattattatcaattcaaaacctttgatatttatttttttaattctcttttcattagattaaaacaggaggcttagttgtttggacaagagggggcatacattttgtgtacagaggaagcagttacctagaaaacgcaaagcggcatcgtgactttgttaattataatgaggaactttccccagtaacatctaacaatcctacatcccaagggaaatattggagtaaagatgaaactttaaccaatgataatgatgaagctgatgataaggacgacaaacctatcaagggaacactatatgaaagagaagtcaacagactactggacagtttgggccctcgatttatcgattggtggtggaacacaccattgcctgttgatgctgatctccttcctgaggttgtccctgacttcaagactccatttagacaatgccctcctggtgtgagaccagcactagcagatgaggagctgacctacctgcggaagcatgcacggcctttgccaacacatgttgacctacgagagtcgacctgcaggcctgccatattctgcactcgatagtcactttattgatagtttcaaatgaatatgctttataggatgatttaagtgttgattgtcactactatctattgtaacatcttatgcacacataacctatttccttaaagttccacaagcattattgtatattcataagtaacccatcataagatgtttatatatgtagcccaactataatcttgactaatttctggcaggtagaaatacaaaactgcagggtttggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatctatgatgcttgaggttgagacaggaggcacattaatagcaatagagaggttcactaccagccatgccataatactttaccgaggaaagaattatcgtcggccaacaaaatcagcacccagtaatctcctgacaaaaagagaagcattacaaagatcaattgaggttcagcgacgaggggtatgaattgacatataattctcccttctccccttaatttccaattttctggctgtctgggtatctcatttcctcattcgttttgcagtcaatgaaatacttcgctcaggagaggaaaaagtccattgatgaattgaagagagaactggttagtttacatgctgtttatatcaatacgacgaaatgaaacttcatatgcttaagcaactggaattttatgtacttgatttatcactcttgtgttacagaggaatgtgacatgggaaatcaggaagctaaaccatgatactgaacagtcttggacagcatgatcgctatcaacattgaagattggaataacgattcatcctctcttttttttttcgtttttaacatgataactacaaagaacaaagtacacagaggccactagatctggtaggtatggtagatatggccacaatgaattatcttgcaagtgtgaagatgtttttttttttgtttatgtacatgtgatacactaaagcacatgagagcagaatcattcaatttggctctgatactacgacgaaatacgaactgattactgggtgttgattaaagctcggggagtttgctgaatatgcttagcgctttcatgttctaaaagaaaacaagtcgtatgacctattgaagagaaactaagaagattcagaaggatgctgtactatctagttctacatcactgttacaaagttactataccttttaagggcgaggttacgagggtacaaaaacatgtgctgaaattctttccccaagcaaactacagaaaagatcctgcctagcaaaagcggtactagtcacctggcccctgaggaaattttacaggatttttggaagatttgaactaagtcctgttatccggtgaaaattctgcaaaattattgtgttcgaagatcccaataaactatgcattggtcgcccaaacgagagcactcaagcagaaggacacagagaagcacaagtgctgaagaatctcactggacggcagatggcaagctttgcattcatcagcttcattgttcttgccgtcccgtccttcatggtttgcgaggctctcccctgaactgctgctgctgctgctgctgccgatgatgatctctcttgggcctctgcggcgcgttcttgggattggtgaaccaggtggtgtagaggaactgcttgtgcggcccgtcgtggtcgcagatgaggcggagcttctgcttctcccgcatccaccgcatcatgatcttcatctgcctcttgctcgtcaggcccctcagcccaacgtcctggacacgaaaatgccaaagattttctcgctcgtcagggatgcatgcgatcagggtggcaatcagaggaacacaagatcgttcagggatgacagtttccatctgtcaagcactgctggttcattttgacactgtgagacattacgtcgaacaggtggcgcgcgccaccgggggggccagggcgaacggtttaaaaggtaacgggtgggcccggcggacagggagaaggagcagcagcaaggatgcggcggcggcgatcgagac

SEQ ID NO: 22708 - DNA, 621 bp, Oryza sativa
ccctcaggcccagaagatgctttacgctattctgatggcctcgaggaaactgcgccattatttccaggcgcatcgggtcactgtggttacgtcttaccccctcggtcaaatcttgcataatcgggagggtacaggacgggtggttaaatgggcaatcgagctttctgagttcgatttacactttgaaccacgccacgctatcaagagccatgccctcgccgattttgtggcatagtggaccccggctccagagaccgtttcagtctctgaatccagctcatacccctctgaactgcctcacgccgtccactgggtgatgcaattcgacagctccctgtctcttcatggcgccggcgcgggggtcacgttaacctctccgaatggagacgtcttcaaatacttggtctggctcgacttagagcgaccaataatatggcagagtacgagggactccttgccggactaagagtggcagccggactggggatcccgcgtctcttggtgttaggcgactcccagctagtcgttaaccaagtctgtaagagagtaccggtgctctgacccgcagatggacgcttacgtacgccaagttcggcgtatggagcgccattttgacgggat

SEQ ID NO: 22709 - DNA, 3806 bp, Oryza sativa
  unsure (1)..(3806): unsure at all n locations
gcnnnnnnnnnnnnnnnnnnnnnnnnnnnnnnnnnnnnnnnnnnnnnnnnnnnnnnnttcttttataagaaggcctgaacctgtataaatcctttgtctccaaacccatacacttttctagcttgatagccacccccttttattattgccgaaatctagtttcgacagttggcgcgccaggtaggggttgcgtcaagcttttcgccgatcagtgcaatgggttccgtctccggcatcgacgacctcgtcttcccacccgggcagacgtttcggttcggcagcctcgacttcatcaccaacaacttcggcaagatttctctcctcgactcggaatcaaaccagtcgggagagaaccggatttcggtcccgtttggattcccgaacgcggctgaaagctacttcaagaccatcttaaccgagtcggcttcaaaccactcggccgagattgcatctcctccgacggagccagatcaagatgatggggcttacccaccagtcctgatgaagctccccgacgatttagcggccgtcttcaccacgacaacgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcgcgccccaccgacatcgtggagtacgatgagtttagctctcgctaccacgacccggatctcgacgacttcgacggaagcctagatgacaactacacccctctctactttggcgttttcatggccaataacgagacggaggagcaacgccaagcccgggagaccgaagagcgtcgccgactggaggaggagcaccaagcacaagaacaagaacggctacggcgcgagcagcaggaccgtgaacggatcgcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcgatccgaccacgtcgtcaacatcctgaaccagacaaagaccatgattgcggcgacggtcccagttaactccgaaagcgtccacacgccgactggcagccgggtcccccacttccgatctcatgactaccgtcatccaagcctcagcatcaccggagcaggatccaatcgcaggagcaggggccacgacgagcggtctgttcactcgcctcccgaacttcatagggagcgccgagtggaacggcctcgctcaccacctcgtcgccggcccatcgatcttcgcgacacaatcacacagcgccgagcagctcgaggctaccatcactcgccggatcgccgcgacgacgaccttgacgagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatttaccggtggctttagcagattccgcccgatcttggctccatggattgccccgtggtacaattggatcttgggccgaactacgcgaccacttcatcgccaacttccaaggcaccttcgagcgtcccggcacacaatatgatctttacaacgtcattcagaagtccggagaatctcttcgagattacatccggcgattttctgaacaacgtaacaagatctccgacatcaccgacgacgtcatcatcgccgcattcaccaaagggattcgccacgaagaattggtcggcaaattcgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaaacagttcgcggagcagtacaccaagtctactcggaagaactccgacgaagaacaaagcacgtcaaggaagaaggatgacggcgacaccccggctggatttcaagaccaccccaaggagcttaaccatatcttcggcggccccctggcttacgaatctaaacggaagcagaagttgactgaacgggagatcaatgctgttcaacctgacacgccccagtatcttcgatggtcagaaatcgcaatcaagtttgaccgctcggatcatcctgaccgagtggtccacccggggcggtaccccctggtactagacccagtggtccgtaatgtcaagcttcgcagaaccctcattgatggcggcagtgcactcaatatcctcttcgccaagactttggatgatatgcagatccctcgctccgagttaaaaccaagcaatgcgccttttcatggagtaattccaggattatccgcaactccactcggccagattactcttccggtcacttttggcactcgggaaaacttccgcacagagaatatcagctttgaagttgccgatttcgagacagcataccacgccatactcggacgcccggcgttagccaagttcatggctgtcccgcactacacttacatgatgatgaagatgcctggtccccgaggagtcctatccctacggagcgacatcaagcaagccgtcacatgcgacaaggagagttgcgacatggcccaaactcgcgagatggcgctagcccgagaggaaatccgactggctgcaaccacggtgagcgaaggaggagtgcccgctgccaagatttcaaaaagtggggaaaccgaagcccagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagttcttcatcccgactggctggcaaacccggttctggttcggaagaaaacagggcaatggcgcatgtgcgttgattacactgacctcaacaagtcttgccctaaagatcccttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgctacgtcaccatgccgttcggactaaaaaacgcaggggcaacttatcaacgcatgattcagagatgcttctcaacacagtatcggcccgcaacgttgaagcctacgtggatgatgtagtcgtcaagaccaagcaaaaagatgatctgatctcggatctacaagaaacctttgcgagca

SEQ ID NO: 22710 - DNA, 2983 bp, Oryza sativa
cggtttgggggctcacatggttggcccgtttaaaaaggcagtcgcgggtacacgcacctcttcgtggccatcgacaaattttcaaagtggatcgaagctaagcctgttgtcacgattacagcagataatgctcgagacttcttcatcaacattgtgcatagatttggagtgcccaatcggataatcactgataatggcacacaattcaccggcggagttttcaaagacttttgtgaagatttcggaataaagatttgttatgcctcagtagcgcacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgtgaagaacgctatgaagaagaccgagtggacgacttgcaccgactggaagaagtccgcgaagcagctttgattcagtcagctcggtacttgcaagggttgcgacgttatcataatcgcaatgttcgatctcgtgcctgtctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaacatcaagttttcttcttgccgttgtcagtcgggggctattatcataataatggagtgtgattttttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaagattttgtcatcgccaaggccatgccagctcccatacttccagctttcttgatatttttgaaatatacttccggagcaacactcagcttgtcaaatatttcggttgcgtcgagtgcactcggaccaccgttattgaggaacatggcttggataattggtgcagcggcattggcgacatcatcccttgctccttcaagcctcttgatcttaccaaccaggacgtcaaactgagcttgagatttgatcttgcgatctacaaaacacatttatgatgagcatctgttgcattataaggagagaagctcagattgttggctggcgttaccttcgacttccttcaaggctgagtccctttgcgcagccagttctgtcttatctctctccagggcttcaatttgctttgccatctgttccatcctggcggcttgcgctgttttgaaattcagatggttgaggatatagttatgccagtttaaactgatgaaactgatctagagattaccttttgatgaaccactcagctcataatttgactcttggagctgagcaattcggtcccttaattctttctccgtcttcttggcaagctccttggtctcatgcagctggtccctaactgcttctagagttcccaaatgaggaaccagcttttccaaagttgtggtcttggcctcattgcgaagatggattctctgcatgatggatcatggttcagttctgctaaaaagaaaacaaagttactgaaggctgtcgctcggaagacttacatttacaatacgagtggcctctccagcgctttcttcagctggcacacttcttcatcttctttctgacggtttatgactataccggcggcttgtgagttctcgtcccaccatttgatcaaaataggaggacgagagtcgtcggttgcctttatgcgagggatttcttctccgtcatcacctgacggtcctgatgtgtttccaagacattagacggatacactgaggttatttaaatcgccattatttgagaagacaactaacctgaagatgtacctagctgagcgtgaggtgatctttgttctttacctgaagacccagctatcgagtcgttaccagcctctggtccttgtgaagccgtcgtctgcgctcctacttcggggatctcctgatcagggcctgcgtccgactggtttccagtcgggggctcttgagttgttgccgtttcagttgttgccgactggtttccagtcggcggcaggtcactcggattggccctatctcccgaagcatgggcgccagtcggctggctttcagcagtcggctggttttcagtagtcagctcggggtccttggatatattctgctctgtcatggcaggatcggggtcttttccagatggatctatatcagatggtttcctgcaaagtattctttcagaatttagcatcattttcatgagagagcttaccaaagtgaaatcataccgagaggtcttatacctggaagatgttctaatttttggcattgcgcggccggccaattttttctgggcatggtgcgctttgggggtttgttaggcgagcccttatccccagatttatcatcgtcgccttcatcatcatcaagcaccagtt

SEQ ID NO: 22711 - DNA, 2526 bp, Oryza sativa
  unsure (1)..(2526): unsure at all n locations
nnnnnnnnnnnnnnnnnnnnnnnnnnnnnnnnnnnnnnnttgactttttgacaaacgtttgacctttcgtcttattaaaaaaattatgtaattataatttattttattgtgacttgatttatcatcaaaggttctttaaggatgacataagtatttttatatttgcataaaatttttgaataagtcgagtggtcaatcattggttaaaaagtcaacggcgtcatacattaaaatatggagggagtatatatatactacttaaaaagtataagatgcttccttcgtccatataataaaaaaatccgcttctgattaaaaaaacaccgttcataagaaaacagcgtgaaaaaaaaggccttctagaaaacggcatcggtaaaaaaaccccgcaaaaaaagtaacccccacacgcggcaaaacgccgttaggaagaaagacggaaaaaagaaaagaaattttgattccgatttaaaaaaaaccgtccccaagaaaacggcgaaaaaaacatctagaaacggcgtcagtaaaatatccggcaaaaaaggaaaaaaaaaaaaggccagaacactatcagcaagaaaaacggcggaataaaagaagagagaaaagcaaaaaaaaaatagacaaagagaatcttaactaattaaaaatttggtagctttcgatcatcacatcgatttttagtccgtactaccattttccgtccgttcgcaacatcgcgcgcaccttttctccaaatcccacataatcaaaatccaagtccaaccaaaaacataatctcaatccaaatccaaatccaaatctaaatcggaatcatcacaaaatcatccaaaatattaagagatgttgagaggagatggaggggcgagcgggaggccaccgttcctcctccgccgtcccgtcattgcatcggggatcagccgagccgccactgtgtcgctagggagccggggagtagccgcggttgcgttgggaagtcgctggctcgcctctgcgccaggaagatgctgggagggagagggaggagccaatcctgagccaccatgccgccggggagccaccgacttgctggatctggcgaggagtgggatggcagcagcaccccgacgaggaggaattaaaggagccaatggttagggggggagggagggggagcggcaccgcgggagaaaggagggcatggagaggcaccaccggtgggggaggggcgtggagaggcgccaccggtggggaaggggcagctcgcggtgggaggagtagcgtcgttggtggggagagaggaggggcgccgctggtaggggacagagacggcctgcggtgaggggagggaggggaaaatgaattagggttagggattttttaaccgcgacgattttgatggattcaaaatcgatctgagccgtccatcaaaacgaacggctcagatcgatcccgtgttgggccagcctccatctttaggccgcatcactgctacgcagcacgctggccggctggtccaacaaagcacttaggttggactttcggttgggggccacacggcaatgagaggaggagtagggggagccaaattacacttcctgttgggccgaatgctttcctacaggttgagacggaggggaggagaagggataaaagcgggctgaaaatggcctagagaccaaggttgatttttttatttaaataaatgctgaaataatgcttgtactatcaaaattagctattaaactctagaaatttcaataaaattccaaatattgtaattaatcatggagacttcaataaaattaaatccaactatataattttatttcgcacactaaactaatttaattatatatctacctacttaaaaaataccaaatattttcggaaatttatatttcaattaattacataatacatatctttctcaaatttttctcaattttctagtctttacaattcctgttgcaacgcacggacacttttactagtaaatatatatatatatacatgcgtgtgtgcttgtatagttctgcaaaagaataaactcgatcaccagcgtgcggtgtgcgcttatatacacacacatatatatatatatatatatatatatatatatatatatatatatatatatatataactacaatagggcacctaaaggtgccacggattaaatggcacctgatacaacctcacaaccactctgccccacataccgccaccgaccacgcagcccgcatcacaccagattaatagtacatagttaaaagttaactcagtgttgtacaacatccatcacatattttacagtgtcgctattctcaattaagcaaaattttaactctattttttttcttcaggcatcattcaaaccacacactagcgggcgtcgtagcacagatcattatatggggttatttttaaactcaacaatctgtttttgatttatttatttttaattttccgacatttattctaaatgtttaattaaatgttgtccatttttttattatttggattctaacacttttattatcatgc

SEQ ID NO: 22712 - DNA, 651 bp, Oryza sativa
  unsure (1)..(651): unsure at all n locations
gctaaaaagtcaacggtgtcaaacattttaaaacggagtgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttgggaaaaatcagcatatgcccctagaggcgcccggaccccccttatatatgggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccaagtgcttcaagcttttcatgccaaggcctgccgagtggactgtaaagggcgaaaagataaaannnnnnnnnnnnnnnnnnnnnnnnnnnnnnnnnnnnnnnnnnnnnnnnnnnnn

SEQ ID NO: 22713 - DNA, 242 bp, Oryza sativa
  unsure (1)..(242): unsure at all n locations
nnnnnnnnnnnnnnnnnnnnnnnnnnnnnnnnnnnnnnnnnnnnnnnnnnnnnnnnnnnnnnnnnnnagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcag

SEQ ID NO: 22714 - DNA, 669 bp, Oryza sativa
ttacttgcaaagcattaggacattatgtccggaaaagttagagagaggtgaaattttttcaggaagaggaaagaatcaaagaacaaatttggttcgtcctggagatacaagatggggttctcattttacaacattagctcaattagagacaatgtgggattctgtggtcaaggtgttagcaatggttcatgcagatgagcgtaatcctagtcgagccggtggtttggtgcacaaaatggagagcttttcctttgtgttaaatatgaagttgatgttgaaagtatttcgtattacaaatgagttgtctcttttgctacaaagaaaggatcaaaatatagttcaggccatgcagttgcttgttgatgtgaaagcgcgcttggtcgccttgagaaaccaaggttgggagccgttatttgaagaagtcaaatcattttgtggcaagatggggtcgatcaaggcttgatggcaacttaatcacacttgagcatctctaccgtgttgacacttactttgcagctcttgattctattatcacggaaatggatcatcgtttcaatgaggtatcatctgagttgcttgtttgcttctcttgtcttgatccaagagagtccttctctaagtttgatgtttgataagatcgcacggttgacggatatgtatgaccaagac

SEQ ID NO: 22715 - DNA, 918 bp, Oryza sativa
ccactgaaatgtctgaatacacaccattattcgcaacactgtcagcatcctccctctgcagtatatccctcctttctgcacagaccttattgaccgcattgacaatctcagaagtggagttgtatggcatgcaaacagagaagaccagtcccgtgttttcagcagtggtagccatcagtttctcagctgctaccctcactgatttgctcaacatgtccaagttcccccagaagttgatcttacagttaaccttgttgatgacatttctgttttctagcagttcattgatcttttcctccattaactccatcaaggatttcacctcagtcggatctcgcttaaaattatcgatgctaaatgcatacaccgtgatatacttcacgcccatttcatagcagtagagcaggctggcaatgagagcagagaagcccaccctgtgaccagagccttcctggatactcctgaatttagcatatctacggttaccatccataataaatgcaatatgcttaggcattgggccatacgagaggacagctacaatgcatttgcggatgaaattctgcagactagcaagaacaccagtcgcaattaactcatcagtgttctccgtctttgaatcctaaaccaaaaaagtaaaactcaagtataagaatatcagcgaatgacacagctaagcacaaaggaaaagtcgcagctctttgattatctttacatgactaataatacctccacctggatacttgttctacataagagatttaactatatatcactgcatatgaatctaaaacataccactgaaggtgagtaagacataagtgagccaagcattttgatggggaggaaccaacaagcagtatcagacctgcaaactggaaaagaaataaaattttcagatttgcttgctcgggtcaa

SEQ ID NO: 22716 - DNA, 709 bp, Oryza sativa
tttttatgtcgacttgtgtgcctcctggtggctgctggtggtggtggtgctcgccccgcgggcgcgccaccgacactccctcgcctcgcgcccgcgcccgcgcgcgcgccagtgaaaagtactagtaaaaaatactagtggcgaaacgggcggtgtcgcggagagccccccgcgggtgtggagcaggttgggtgggtgcgtctccgcgacggcggcgccaagcttggttcgttcgaccacctcgagctggatttcctttcaggaggcggcgggttgtccgccggctcgtcgtcggggcttggccgatgggagattgcgggggaagaaaggggaattgggccacctaaaactcagcttttccaaggggtgtgtttagatgcgggtaaaactttctatttgctgtcacgtcggatgtttggacgctaatttagagtattaaatatagactaataaaaaaactaattttataaatgagagctaatccgcgagacgaattttttaaacctaattaatctataattataaaaagtttattgtagcatcacattgtcaaatcatgacgtaattaggctcaaaagattcgtctcacgaattagttcaaggttatggtattggttttgtaattagtctatatttaatacttcaaattagtgtcaaaaatccgatgtgacagggacttggaataagtccccgttttccaaacagggca

SEQ ID NO: 22717 - DNA, 1739 bp, Oryza sativa
tatgctttgaagaggcaggaagcacagtcacataacagacgggtaacacttgaggatcttgaagattcatgggatagaggtattcctggtatcaacactcttttccaaaaagaccgtcatactttggcatatgataaaggatggagagtgagaacagactttaagccgtaccaagtgctcaaacaaaatccattctggtggacacatcagagacatgatggaaaactatggaacctaaacaactataggactgatgtcatccaagctcttggtggtgttgagggtattttggaacacaccttgtttaaaggaacgtatttccctacttgggagggtctgttttgggagaaagcgtcaggttttgaggagtccatgaaatacaagaagctgacgaatgcacaacgttctggtctcaatcagatacccaaccgaagatttaccctgtggtggtcaccaaccatcaatcgtgcaaatgtgtatgttggtttccaggttcagctagatcttacgggcattttcatgcatgggaaaattccgaccctgaagatttctttaatccagatcttccgtgcgcatctgtggcagaagatccatgaaagtgttgttatggatctttgccaagttttggatcaagagctggatgcactggagattgagacagtgcagaaagagacaatacatccgaggaagagttacaagatgaacagctcctgtgcagatatcctcctttttgctgcacataggtggcagatgtctaaaccgagcttagtctctgagtcaaaggatgtctttgatcagaaagctagcaacaagtattggattgatgtgcaacttcgatggggagactatgattcacatgacattgagcgttatacaagggccaagttcatggactacactactgacaatatgtcgatatatccatctccaacaggtatgctttcaatatctatgaattgttttatcaactatctatttgtctgatttggttgtagctaattgatattttgttctacaggggtgatgattggaattgatctagcatataatttgcactctggttttggcaattggttccctgggtcaaagccccttcttcagcaagcaatgaacaagataatgaaggtaatataatcatgttaattgtaactactctatctttagcttgcataatgatctgtctgtatgttccagtatttccaatataactaacctgctggactgttttcatctataacagtcaaatcctgctctgtacgtgctgagggagagaataaggaagggtctacagctgtattcttcagaacccaatctgccgtatttgtcttcacagaactatggagagatattcagcaatcagatcatatggtttgtggatgacacaaatgtctatcgagttaccattcacaaaacatttgagggtaacttgaccactaaaccaatcaatggtgctatttttattttcaatccaagaactggtcaactatttctgaaggtatgttcattctcttctagctacagtcataattgtgacattactgtggagtgttgcaactttgaaggcttaaaatgaaaatggattgcaatatgcaggtcatccacacaagtgtatgggctggacaaaagcgtcttggacaactggccaagtggaaaacagctgaagaggttgctgcattagttcggtcgcttcctgtagaagagcagccaaagcaaatcattgtgacaaggaaaggtatgtt

SEQ ID NO: 22718 - DNA, 477 bp, Oryza sativa
  unsure (1)..(477): unsure at all n locations
nnnnnnnnnnnnnnnnnnnnnnnnnnnnnnnnnnnnnnnnnnnnnnnnnnnnnnnnnnnnnnnnnaaattcttttgattcagagatgagaagcacaaaagtttcccggataaaatgtgaacagtatttgtgccaatttgtttgattgagtaaagcatacactcaaaggtgtgaagaagcactaggtaatttacggatgctttaagctttataatgttctcagtttgtttgcatgcatactgtaacaagaaggatatggtagcacatctgcacagcgaacaaaattgcttcagggaaagtaaggcactttgcttagaccaaatgttattacatttcacacatttggaccaactcaagcatacacatgttcaagcatacaatggcatagctatcctttatatatttcatattccaggagataccacaggagaatacagattattgtgtaactacagagggtaccgagctcgaattcgcc

SEQ ID NO: 22719 - DNA, 701 bp, Oryza sativa
cgttgaaaattgtgaagcacctgcactgcaagcacagttgcacatctcaagttcttcagatagttacattagggttctgtttgtcgtggatatttttttttctctaacaataagcataagctgtcaagcacatttcccaaaatactgtgttgattatatcttgacaaaattcttacttctgccccataggatacgtctgtgctgcgaagctgtctgcagaagtatgacaacttggtaaactttaccaagcacctcaaggtccaattactggaagctgattctgattcatcagcaacaggattgggatcaactgatccatcatcatcctctacacccaggaaaagagcgtcttctggtcggagtaagttattatattgacttattttcattcagattgtgatgcagactgctattagtgtacatatttatggttgcttaatactccctccgtaccagtttagagggcgcctagtttttttttcccagtgtcccacaacataaggtgcatcttcaaattggtttgatttgtcctgagattagcccttgttagctgtttcagtgcagcctgtgcgtggagcatgcagcttcgcgcagcatgcagatgggctgggccctcaaatattctccgcttccgactgaagcgatgagattaaatccttttgcatgcacttaattaggggtataacaagtaaaaaactttt

SEQ ID NO: 22720 - DNA, 1266 bp, Oryza sativa
acagcgccggcataataggccagccgtgtagtcggaggcaccaatcggcgccaacgaaggcaggccggtggtgaagtcgtaaacgcccacaagcgccggcataataggccagccgtgtaggcggaaacaccagtcggcagcggcgaaggcaagccagtcggtgaagacgtagacgcccaacaacggcggcataaaggccagccgtgcaggcggaaacaccagtcggcagcggcgaaggcaagccgatggtgaagtcgtagacgcccaacagcggcggcataataggccagccgtgtaggcggaggcaccaatcggcggcgacggagccaggccggcggtgaagtcgtagacgcccaacagcggcggcataatggccagccgtgcaggcggaggcaccagtcggcggcgacggaggcaagccggtcggtgaagacgtagacgcccaacaacggcggcataaaggccagccgtgcagacggaagcaccagtcggcggcggacgaggcggccggtcggtgaagacgtagacgcccaataacggcggcataaaggccagccgtgcaggcggaaacaccagtcggcagcggcgaaggcaagccggtcggtgaagacgtagacgcccaacaacggcggcataaaggccagccgtgcaggcggaaacaccaatcggcagcggtaaaggcaagccggtcggtgaagacgtggacgcccaacagcggcggcataataggccagccgtgtaggcggaaacaccaatcggcggcgacggaggcaggccggtggtgaagtcgtagacgcccaacagcggcggcataataggccagccgtgtaggcggaggcaccactcggcggcgacggaggcaggccggcggtgaagtcgttgttgttatcagcaatggcggtggcgaagacaagccggcagagtggacttgcggccgatcgaccggaaagctgagacgcctcgagtccatgaccagcatcaatcgcctcaatagtgccgcgtaattatatgcgaacaacaacaaaaaatagcaagagattaatctaggattaaaaatcagtacgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgcttgttgataggaaactcgacgcaacccctacctggcgcgccaactgtcga

SEQ ID NO: 22721 - DNA, 738 bp, Oryza sativa
  unsure (1)..(738): unsure at all n locations
nnnnnnnnnnnnnnnnnnnnnnnnnnnnnnnnnnnnnnnnntttaaccctttttctttaccacaaggaatactccatccatctcataataagtttattttgtaacggagtttataaaaatagagaataattgtatttggtgtagataaagtgctgaaacagttacattgggattttacaaagtagagatattctatttattttaattttgtattggtagatataaaacgagtgaaaaataaatttattttggaacgggtggtatcttgcaagcatcgggctgccggaaccaggccggcccgagctcagcgaggccgagaaagcaatcgaacacggccaatccttccctttcccctcgcacaccacacccgggcaccgcgcgcgtcaccggcctcgctcgcggcgcgtcacgctgctcgtgcgtgcggccaccactaccaccgccgcgatcgctttcgcgcgcacacacacgcaacgcaccaagagtccgagactgcgcgacagggcgagcgaggggggaaaatggcgtgatctgcagcaaaacgagaggggaaaacgcaggaaaacgagcgggcgacgcaggattctgtggatattgtgggtaccccatacccatacggcatggttatccgactagtcataggggataacttatatctatggaatatgtaatagatcatgactcgggtattacgtttccttgtatattacggaaccgcctaaagtcctggtttgataa

SEQ ID NO: 22722 - DNA, 845 bp, Oryza sativa
tagatgttttttttttttctattcaccatgtaccttgcctatgggaatgtcagtaattatgtatggaatatggtttaagactgtaggttaaaatctttatctgtggccaccataggtctctttgctcatgggcaattcaacttaacaataacaacagtcattagccaacaacaaaagatggtggtattacaaaggggggctgtattagacagtaataagacagacttacccccaacagcaagagacgaacctttgggccaactatgaacttgaggggatactatggatggtttgttactttatcttgtacctgtgcctgaattttcttgatttcacattggtttagttggttttatgctctttctaataatttgggaacaaaatgtgatactctagtaagctgcatccttgactatgataaatctgtgttagacttattcaaacaatgaatctgatctggtgttcagtactttaattttttcccagtatgatatgggttctacgctaacaaagaattaaagatctatctgttccgggatatctatgttttaagccccctttagctttagtgctattattaacgtaggaagatcggcgttttaagggctcattcggaatgcaggattgaaaaaacataggaataggaaaaatataggaataggataggaatgcaagtgtaaaacagaggatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttggg

SEQ ID NO: 22723 - DNA, 705 bp, Oryza sativa
  unsure (1)..(705): unsure at all n locations
nnnnnnnnnnnnnnnnnnnnnnnnnnnnnntttcggtggtaagtgagtcttagcgtgtcatggaggatgaggacgcagcggtggatccggtggtcaccgaggcggaacgcggcgtggaagaggaggaggcggcgccggtggtcggagaggcgaggcggggcgcggcatggagaaagtggggatagcgagcgcggacgccttcccttctctctctgctgcttgatatccccctctttctctcccacttctgtgttcgaaagcagaacacccgcggttgtgttgcgtggaagagggggattaataagggagggaagcgaggctgtgaggggcacagcacagctttcctttgggctttaggcaactgggctatgcaggcttggtgggctggaatgctactaccaaatcggctcttaatccgtgctttgaggtttttgccttgtacacgaggacatgttcctttagacggagccggcggcgacgttaagcccgagtgactaataaaatatttttttcaagatcgattaattaattcttataggcgttgatggcgaacaacggagcggtagacctcgagtggttgcccaacccgcccgtgaggagactctggcactgggtttttataggtcgattcttaacgcatggttttataagtgttcaataagacctttttaaataggtcctaaaatttcaactattaaaaccaat

SEQ ID NO: 22724 - DNA, 698 bp, Oryza sativa
gcccaagaaaatcctgaaggaacacagtacaatacccacatcaaatttaacagattgacaaatgataaaaataacttgaaagcatatggatgtcatgcaacaagcaatcttggaattccggtgagaatcattcattgaaaacaaattacagaagatgagggatatctcatgaacaaaaaaaggtgttcctaatactccctccgtcccactttataaggcgtgtaattatttttactaagacctgcatagaaaagtttttttactgttatacccctaattaagtgcatgcaaaaggatttaatctcatcgcttcagtcggaagcggagaatatttgagggcccagcccatctgcatgctgcgcgaagctgcatgctccacgcacaggctgcactgaaacagctaacaagggctaatctcaggacaaatcaaaccaatttgaagatgcaccttatgttgtgggacactgggaaaaaaaaactaggcgccctctaaactggtacggagggagtattaagcaaccataaatatgtacactaatagcagtctgcatcacaatctgaatgaaaataagtcatataataacttactccgaccagaagacgctcttttcctgggtgtagaggatgatgatggatcagttgatcccaatcctgatgctgatgaatcagaatcagcttccagtaattggaccttgagg

SEQ ID NO: 22725 - DNA, 7519 bp, Oryza sativa
cgactctagaggatcccctcacagatcttgtcaatttcatattgatgaatttttcaccacacttgctaccaatctctaatctccagtttgcatagttgaatactgtatcactagcaggttaacactgtatctattgtactatgcaaatacaagaacagtgtgaagtttaacattttttatgattatttcaccacacttagttactaccaatctccaatctccaattccttagcattgtgtttatctgcacaatgcaaatacaagagactctgaacaatgtgaggtctgaacactctgaaccactgaaagcaatatactactatgctctcttatgcctctcttaatctatctttttagtcttaaagaaaactcgcttttactaccaatctctaatatccaattccataattgatcccccaaattaacactgtatttataatatgcaaatgctctctcgaagaatacgcatcaccgaacagtctgaagcctgaaccactagcatataacctcctgttatctgaaaaagacaccatttttaccatattctcttacaagaaaagcaaaaaagaaaacatctttttttttaaaaaaaaagacatttttcttttaccacatttatagcgacgtggatctgatcaccgtaaaaaaagatattttcttttaccacatttacagcgacgtggatccgatcgtcgtgtaggctcccacttctatccggccaataggttttacaaaatcgtacggttatcacacgcttatcgtggttatcacatacggtaaccttatccgtttttgaaatcacaatatatctcataataatcacacggttttcacggtaaccctgtgattcgcggagaagcgaataataatccggcgatccaccgggagaaaaagcagctcagcctcagcaccgcacatattctcttctcccatcccgcagccgcagctgcagccgcaacggttgcccgttggttggttggttggctcgcctccactccaatccgcgcaggcagcgacaactcgctgggggtgacggcgaccactcctccacacctgcgcgcgcgcagaaaagctactactactactaccgcctttccaccaccaccgacgccgtcatcatgacggcggcgacgacgacgatccacaccggcagccgcactggtggtggccgcggtggtggtgacgccccactgccactcactgatccacccggccgcgcgcgagctaagctaagctagtagctagctgcctagctcggctccactcgctttctgatcttgcttcgcctacttgtctactcccacgcacgcacgcacgcaccagcgctgtccctcctaattctcttctcctccctttcgctttcgcttttttgggcgcacttatctattggggtttggacggcgacggggcaaagaagaagaagcccaagaaccggtcatctcgagctctcgatggattcagcgccggtaggactcgaggctagttagctagcagcagcaagaagcggttctttgtttgtttttagctccgattttgggcctgcaagaagagatgccttcccggcggagggaggagcgcgggtgcgggtgctgggcggcggtggcgcgggggctacgtggggcatgcttccggccggcgggggtggcggcggcggcgtcgggggccgacgagaagggcgcggcggggggctccgccaaggggagccacgtccacgacgcaggttggcttcttctttgctctccctttttttttccttcttcttgatttttgtttgtagctggttggtgagtttgggatcttcttttgtttttgtttggttctgtggggggtgattttgcttgtttgttctctagtggttggatatttttgcttggctattgttgcggcgatgtgattgatgttcatcgaaaggggaaacttttctgtttctgggaaattctggtcgtgttcactggggactgatctgttgtgtatttgatcggatgattagtgcttagtactgtcagtgatgtaatatacgtgggaattttggatgttataatgagaaattggaacttgggatacagattcagagtaaacggaaattggatactgttttgctgttttatctgagatggaacggatcatgcctatagtagtgctgtaagggctattcatggtggtacaggcatacagcaatgatttcttacaggcttgagtgtcataatcttaaaaagcttgtgctagggaacattgcatctatatgagcttgatcagaattatcttagcaccgtgtgttcttcagatttcaatgagagtgttcgcatgttgttagctgttgccatgttcgtaacaaaaagacatgttttatgttgttatgtgttcttcggattagcatgtttcaataacaataagaggatgaatgggttttgctcatctttctatcataccgtgctaagcaactctttatggtatacatttaaactgtctgtcaaatgggatttttcttatccttgtgatagctgaagaagggttgttgtaaatatgacagaagcatgaaacaaatcgtttatccttttattcaggagcaaaatacatcctgctgtgtttctttctaatgtcatgctgatcatttttgctgaccttgagagacgggaaatgattaagctgaatagtagtactttcaaaataataacctggataacataagaaacacacactgatggtatttcaagtcaacttggtaggttttcttcctgtattaaaaattggttaggagtatgcccatcatataataaatcttggatcaatgtctatcaacttacttaaccaagagctaataactattgcccttacaatattctatcttggcttattctttcaagcttaatttggctctcaaaggacagtttgggtatatagccatgatatctactaagtactttctgttgttgaatttttcagtttttgggtgaggtgctcaagcattttgtttttctctataacagcagagaccagatatctaaatgctagcaatcgagagcttggtgatcattttcagacaaaccttgatgatgaaaatggtgtaaatgcatcaactgaaaagaaacttcttcggtttactttccaagagttgaaatctgccactgttaactttaggccagatagtattcttggagaaggtgggtttgggtatgtattcaaaggatggattgatccaaacagcacatctcctgcaaaacccggtactggtcttacagttgctgtcaaaagtttgaagcaggatgcacttcaaggtcacagagaatgggtggtaagtatgtgcttgtcctgtacatgtgtttgtgtaggtagagttataacttacaaacataccgtatttgcaggcggaagttgactttctgggacagctgcatcacaaacaccttgttaagctgattggatactgtatcgaggatgaccaaaggttgcttgtatatgaattcatggcccggggaagtcttgaaaaccatcttttcagaagtaagcaatctttacaaccatcttttcagaagtaaacaatcaaatacatgcattagtatttctttttaattcaaataagattggcatcacatttttaattcatgcaaaatatatactatatgaatactttcatatgccaatgtgttagtacatccttttgtcctaaaataaaatgaatcatgtaattgaaacatttagatattgtcatgtcttgagaaatatttcttgatgtagtgaagtaattaaactgctttatagaaactagtaacttctcccaaaaggagcaacaatggttgaaagtgaccctttgtttatttactcttttttcttccaaggtgataatgcatgcagggctgttttagaataagtagtacaatactcttttagaaaagctgttgttgacttgccttattgaacaccaagacttgacctcaacaatatcatttctaggtgttgtccattgaattgttaacagttcattgaaaactaggacctgtttatccttacacgccctctttgtttaggcttatacgccagcttatgagcctaaaagtctaaacctaaacagataagcagcttgtctgtttggttttttaaggacataagccactcttacactattaagccacaagctaggttgcagtagcttttttggcttatgtgaagtggaggtatgacttcaccattaaacttaaggcttcaaagccaccagcttataaaacatataagccaaaaaattggctaggcctaagcctaaacaaagagggcctaacgatgatctatatggtgttccctgatctattaggtcatccttgtctaacaattgtactttgttctgtaagtttcttgattggtaatgccttcaaattgtttcccaatctaaagttcctgttatcttactttgtttaatcttgaaggggctcttcccctaccttggccctgtagaatgaagatcgctctcggtgctgctaaagggctagcctttctccatggaggtcccaaaccagtaatttacagggattttaagacatcaaatattcttcttgatgcggtactatttcttatcaattcattcacatcatgctcataaatatgttgcacattttcacaagattatttcttgcatgctattctaacagcagtggaaattctgcttatacaggagtacaatgcaaaactttcagattttgggttagcgaaagctggtcctcaaggcgataaaactcatgtctctacacgggttgtcggtacctatggttatgctgcacccgagtatgtaatgacaggtattttacggaaacttttggttttttgtcgtctacttgaatcaaattttctttaatacgaatctaccagttagtattttattatgtttctgtgagtttctatggtgtgatatctacatctttgcttctaatttcatcacactgatattcctactagattgaatattaagatgcctcgggattccatctgatgacgtataaactgcagtatctagacatgatcaccaagtaacagctgatgatttttacttaagtaacaaatggcttgtttgtttagacaatgatacagacaacattcatcttggagcactcttccgtagcatgatttgattatccgaattcattggaataacctgaaaacgtggatagcaggaaccagtttggtattacatgttctactctgcctttctggttcaatattactgctgtatgcatcccacaagtttacttcctacgagatcttttctggcttcataaaaacttaaaataataaaaacaaagtaatgtcaaacatcagattatacttctccctctgagaaacaagcatacatgttcaagatctcattaaagtacacttttcaggacacttgacatccaagagcgatgtatatagcttcggagtagtgttactcgagatgttaaccggtagacgatcaatggacaagaagcggcctactggggagcagaacctagtggcatgggcgaggccgtatctaagtgatcggcgaaggctctaccagctcgtagatcctcgcttggggctgaactattcagtaagaggggtgcagaaggttgctcagatctgctaccactgcctcagccgtgacaccaagtctcgtccgacaatggatgaagttgtcaagcacctgacgccgttgcaggacctaaatgacatggcgtctgcatcatatagacctcgatcatctcagcgtggtgagttatcatctgaacaaagaaagaattaattcatcatcactgaagtgacctcaatttgtttgaactgcaagaatgaactgttttctctgctctctttgctttgcagttgtttttgcttttgtaaacttcttctgtagatcttttgcatattcgcgaaaaaagaatgaactgtctttactcacagctagaacgtgatgaatgattaaaaatgtgaaacttttggattagcaaatgaagctaactgtaattttttttcctcatcgcaggaaaggcacgtcggtgatggccggatccactgctaaaaagcagcgaaatttgatgatttttaaggtcatttccgggtgctttgttttggttttaattgtatagtgaaactaggcttgataatcctcaaatccctggagatgtgacgccccctgatgtctaatctcgcttattagatgatcagccgaacactgtgtttggtggctggttgcacaagcgaaaaacggcatgtacgtgtggttggctgcaacgtgtaataacaacttatttttctgacaagggctgatcatccggttgatgctttccaactgtgaataccgaatactactttcgagatgcatggtaatatagtggaaaggggtgtgtggtttaaccctcggtccctcacgtctcatatttaatccccaacacacttataatttcttctttaaaaataaatgtttgggatggctctccctccaatctcgtttttttttcccgaatactactttccctctcttcctcactttgtagctctgtatatttttattttattctgtattttagatctttatttactcgctcagcaggttactaaatgatgtgttgatacaaaagaaatttatataagattttgtgaaatgtttttagtagctaatttatttattttatactcttaaatagctgtcataagaaccagattactcatccgtctataatttcagctatttgaaatggggcatatatccacgtaattccattacttaaaaagtgtagcattgtaattgttgagttgtgatctaaattcatttgcacatatataaaggccaacttctgctggagcaaagcagaggtccgtcgccagaggcttgggccagaggcctgaggacgcctggggtgtaggggccccgcgttacggatcgttatccttttaagtttcaccttcatatatacttcttgtaagccgccgtttgacgttgtaacctcgccccgatatagtgaatatatttttctgtctggtgcccatggttctttctctcctgttttgagagggttttccacgttaaatctcgtgccttatatgattgatctattgtttttttatcatttgtatgtctatcattttctaacaggcctctcactctctgtttctcatagaaataagatcgcggtttgtcaaattacacaggtttttggttccaagcctgagaatcaccgtagcttatgcaaatttcgaatagaggaatgtcaactgaactaaattacataaagaaatcatttaaatttcttgcgcaccaaaggaacaccgacaatatagcaaactgtaaggtgttgtttgattggtatactcacgttaccaaagcttgccatattttatttaaggaaaaagtacgaattacccccccccccgaactatcgcagtcgtccgaattacccccctgaaccataaaaccgaacattatttacccccaactatgcaaaccggacgaattacccccctcgatccaatccgcggtggttttggtctacgtggcgtacacgtggaatcccag

SEQ ID NO: 22726 - DNA, 1964 bp, Oryza sativa
ggcgccaacgtcgcctcgcgtcgcaccatgcccgtggtgcccgtggtgcgcgtggagctgaagctgctccagtggtgcgtgggggcgacggcgcccgccgcccgcagtggatttccggccgccagccgccggacgcggcccaactctccaccacgcccgccgtgcctagcactggccaccaactcgcgggccacatctgagacagagagagattgagaggaagagggaaagagagagagattgagaggaaagtggggaagagagagaggtgggacagtatgacaggcaggtcccaccattttttttaattaaaaaacgctgactgggatgccacgcgtacgccacatagaccaaaaccatcgtggattgggtcgagggggtaattcgtccggtttacatagttggggggtgaataatgttcggttttatggttcaggggggtaattcggacgactgcgatagttcgggggggggtaattcgtactttttcctttatttaactaacatgcctaacatgtggctcataaaattaaagccacacttcagctgtatgaaagcaagtttgctacacttttactccatctatcccataatataagggattttgatattttgcttatactatttgaccactcatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttagataagtgtgacataaaaatacggtgaatggtggcaaacttagtataacatccaaacagtcaaatctggctaacttgagttgtagcaatagtcaggcaataagtggtagtgaaacaaacaatccctagggtgtgttctgaccaaagggttctcaacccctctcaatcgtattccgcgcgcacgctttttaaactgctaaacgatatgttttttataaaaagtttctatacaaaagttgcttaaaaaattatattgatctatttttttaaaaaaaaattagctaatacttaattaatcgtgctatggactgttctgttttcgtgctagggtgatatgttcccatccatcagcagcgaacacaccctatgtccctatctgtggattgccagtgcgaatctcgacgtacgtggtggcaaatgcagccgcagtgctaggtggagccccaagcgggcgtccaggtcgccggaaaactccatggcgcgctctggcggtgtcaggtcacgggcgccatggcgcgtcccatggcgacaaccacctcagtctccccccctccccgcagcggcgtctcgacctcatcgtctgtgcctgtgcgcgccgtgctgccgagtgctagcgcgctagaagcgtcggcgcgcgtacgtccgcgcgcgcgcgcggtgctcgcccgtgagcgcccccgcgccgtggccgctagcgcgcgcgccccgggccaggtggccgcctcgccggctcgccgcgaacacctggcgcccatccacgcatgcatccatgccatgccatgcacgagatgacgagacgagactgagttgattaattgattaacatacaagctgcttggttagtgcagtgctttgtgaacttgtgattggatcaggtgttgaccatgggagatt

SEQ ID NO: 22727 - DNA, 1484 bp, Oryza sativa
acacgccgctgacgccacggccgccgccaactccgccgtacgttccatctccacccccatacgtgccaccctacatcccgccgccgacgccgccatacgttccaccctacatcccgccgccgacgccgccgtacgtcccgccgccgacgccgccgtctcctccgccatacgtgccgccgccgacgccgccgtcgccgccgccgtacgtgccgccgccgagcccgccggcgacgaagacgtgcccgatcgacgcgctgaagctgaacgcgtgcgtggacgtgctgggggggctgatccacctggtgatcgggcagaaggcgagggcgaagtgctgcccgctggtgcagggcgtggcggacctggacgccgcgctctgcctctgcaccaccatccgcgcgcgcctcctcaacatcaacatctacctccccgtcgcgctcgagctgctcatcacctgcggcaagcacccgcctcccggcttcaagtgccccccgctctacggcgcctgaactgaacaaacgaagcagcagctagcaaagcttcgtcgtcgtcgtcaatggcggaggctactatactacaccctcgctagctagctatactgtgctacctttactctctcgatcgtactcgtgtctgcgatttgtgttgtattaatgtactacctccggttttaatccaagtgtagtttaattaattaatccacgagaaaagatccgacttatgatcaagtctctgtgcgaattgaggaatctctcggtgaattatactggaagcatatcaatctgaactagttttcgatttttttgtgtgaataatcgtccaaattacatcggttttccgtaggtaaccaaatggtaatgacaaagctgctcatcagtacttcagctttgcagttaagaatgagaaggcccaacaggcaacagcccattagatgctagctagtgcagtacttagatggtgtttagatccagggaattaactttagtccctgtctttagacactaatttagagtattaaatatagactacttacaaaactaattacataaataaaagctaattcacgatacaaattttttaagcctaattaatctataattagagaatgtttactgtagcatcacataggctaatcatggattaattaggctcattagattcgtctcgcaaattagtccaagattatggatgagttttattaatagtctacgtttaatatttatagttaattttcaaacatccgatgtgatagggacttaaaagtttaaaagttttagtcccatctaaacagggccttagcacggcccatcacatattgcatcggtgacgtagtgagtgacgcacgctgttgcagtgctctgcgcctctgcatctccttctcctgcacacttccctctcgaattcgaaaaactcgtataattcccctccacagctcaacggtcgggatcccatctcataagtgcccgcatggcgccatcttctccgag

SEQ ID NO: 22728 - DNA, 6661 bp, Oryza sativa
ctaatcatggattaattaggctcattagattcgtctcgcaaattagtccaagattatggatgagttttattaatagtctacgtttaatatttatagttaattttcaaacatccgatgtgatagggacttaaaagtttaaaagttttagtcccatctaaacagggccttagcacggcccatcacatattgcatcggtgacgtagtgagtgacgcacgctgttgcagtgctctgcgcctctgcatctccttctcctgcacacttccctctcgaattcgaaaaactcgtataattcccctccacagctcaacggtcgggatcccatctcatcgtgcccgcatggcgccatcttctccgagaagaaaccggcatcggacggctacgcccacaatcatacggtccccgaaagtccacgccgccgtctcaatttcagcggccgccccgcaaaaaattcacaaaaaaaaaaaacccgcaacagcttgcactgcacgctgccccctcgccatgttccccgcgtttcctaccccaaactcactgacgcgtgggggacaaccggtagggcccacatgtctgtcggggtgggcggtggtggtgcccactagcctggttacctggagatattgccccccaccccacgacgccaaaatccgcgcgggaaacagctccgcgcccgcgcgccaaacttgctccaaatcgaagtattattttctctcgcgatttctccgatttttttttctagcgataaattaattaatgctcctctcgccgcgccgggaaagcatttaaatctccccctcctccgcgcggttctcccaacccaaaccctaccacgattcctccccactcccaatccaatcgccgcggcggaggcggcgggcgcgcgtgcacaccaggtgttcgacggaaggcctcgccgggtggggggcgaagatgtacgtggtgaagcgggacgggcggcaggagacggtgcacttcgacaagatcacggcgcggctgaagaagctcagctacggcctcagccaggagcactgcgacccggtgctcgtcgcgcagaaggtatgcgcgggtgtgtacaagggcgtcaccaccagccagctcgacgagctcgctgccgagactgccgccgccatgaccgcgtcccaccccgactacgcctcggtaacagccactgaacttcaccgttgttggtttttttgttccccattcggtagtaccttgtctcctcctgacatgtggattgctgttgtgaagctcgcggcgaggattgcggtttccaacctgcacaagaacaccaagaagtccttctcggagacgtaagcgattgattgcttttgtttcagttgaatcatgcgaagggtgttgggatttatggattaggatgtgaattgggatttggtcgttatggatgcaggattaaggacatgtatggacatttcaacgagagatctgggctgaatgctcctttggttgcccacgatgtatatgaagtcatcatgaaggtgagatatcaaattaaactttagggacttgcactgatagctgttcttgttctgatttgtaaaatttactgttccattcaatttattggtcattaggattattgatgtatgttatgcttcttacggtttctgatgttctgatccttattttcagaatgcttctcgcttggacagcgagataatttatgatagggacttcgattatgattattttggtttcaagactctggagaggtcttacctcctgaaacttggcgggaaggttgttgaaaggccgcaacacatgttaatgagagtttcagtaggtatacacaaggatgacattgagtctgctatcaagacctaccatctgatgtctcagcgctggtttactcatgcttcaccgacccttttcaatgctggcactccaaggccccaagtactgcacatttgaccagaaaaatcctagtcttggactctgaaattgcttgcttactcttttattctctgcaatgcagttaagcagctgtttccttatctgcatgaaagatgacagcattgagggaatctatgatactttgaaggaatgtgctgtcataagcaaatctgctggaggaattggtgtatcagttcacaatattcgagctactgggagctatatccgtggaacaaatggaacctccaatgggattgttcctatgctacgtgttttcaatgatactgcccgttatgttgatcaaggtggaggcaagagaaagggtaggttctatggtcaattttatttgtgaaaattactctaataccataatctccaggaattctcataccctcctaaaaatcaggtgcatttgctgtgtacttggagccttggcatgcggatatttttgagttccttgatctgagaaagaatcatgggaaggtaaattctcaaccagatcctcttattaattcctttgcatagaaaactgtaaccatttaaatcttctggatttgttgcgacaatgagctgatttcaatgtatccttgcatctacattttctgaacttgaaatggattgcttacatgtaatagatgttatgatgcagagctgaatgttcaagtctttggtgcaaattagttataccattagaaaaaactggtggatagaagaatagcaggctctagtgtatttcttcctataatgttcagaagcttttcactatccagcatactgtgatcactggacaatttgatatgctttgaacaatttgatatgctttgcttgtgctgtttatgtttctaatatatgccatttctcctaacttaaaggctttagcctgaagaaagatctgaaatgcatgtttttatgaatgacaatttaataggaggagcatcgtgcaagggatcttttctatgcactctgggttcctgatctattcatgcaaagagtccaaaataaccaagaatggtcattgttttgtcccaatgaagctccagggttagctgattgctggggtgatgagtttgagaaactgtacacaaaatatgagagagaggtaagttggaaacgaaatttaattgtactacagtttattgaagttggaaaagattacaataacatagctttgtactttcagggcaaggcaaagaaaattgtcccagctcagaccctctggtttgacattttaaaggcacagatagaaactggtacaccatatatgctttacaaggtaaatttggtagcaaaattagtagcaaggagtacttgattttggacccaagattcctccaaatatgctgctggctatagtcaggttccaagtattcattccgaatgctcttgttgtcccacaggatacatgcaataggaaaagtaaccagcagaatttgggcacaattaaatcttcaaacttatgcactgagataattgagtacacaagccctactgaaactgctgtctgcaatctggcatctattgctttaccacgttttgtaagggaaaaggtatatcttgttagtgctttggctgatttcaaccctaaatgttgtatgtttacatgtctgatcataagattctgttgcagggtgtccccatagagtcccatccatctaaacttgtcgggagcagtgattctaaaaatagatattttgactttgacaagcttgctgaggtctgctgtctgatcgaatctgtttattctaaaaatagatactcttgcctatgtcagtgaatgttctgacacgctgttgattttaccaggttacttcaactgtcacatacaatctcaacaaaataattgatattaattattaccctgttgaaaccgcaaaaagatcaaatatgcggcacaggccaattggcattggtgttcaagggttggcagatactttcatattacttggcatgccatttgattcaccagaggtaacttttcctagttcagtaatatagtagtactagttagtagtccttcctacacttaactgatgtaaaaaatgtgatcccctcttttcaggctcagcaattgaataaggatatcttcgaaactatttactttcattctctgaaagcttccgctgagcttgctggtaaagaaggtccctatgaaacatatgaagggagccctgtcagcaaggttttttgcttttactaatgtcactttttttagtagctgaatttaccaatttatttattggtgtagtttgactaaattgttggttggatatcaacaagtaatattctttctaaggctgttttctatccacttttcagggcattctccaacctgatatgtggaatgtagttccatctgacagatggaactggccatctctacggagtactatttctaaagttggattaagaaactctcttcttgttgctccaatgcctactgcttccactagtcagattcttggcaacaatgaatgctttgaaccttatacatctaacatatacagccggcgggttctaaggtttgtaactacactgttcttagtgctcgtgctcactacaggtgcttatgattgattttgtttaattcttttccagtggggagtttgttgtggttaacaagcatcttctccatgatttgactgaaatgggtgtttggactccagctctgaaaaataagataatttatgaagatggttctgttcaaaagatgacagtgatcccagatgatctaaaagcaatttacaagtatgttgttcattgtcctaaactcctaatgctatgttctaccagatgcagatattcatttatctaaacgtttaacctcaattgttccagaacggtttgggagataaagcagaaaacgcttgttgacatggctgttgatcgtggatgctacattgatcagagccagagtcttaatgttcacatggaacaaccaaactttgggaagctgacttctctgcatttccatgcttggtccaaggtattattaaggctatgtgaaagcatattcctgaactctatgcagcccatatttattctgtatttgtcatgccatgaaaaagaactgctgtctttagattgtgtttttgcaaggtctacaagtaaacatggtttcatcttggttgatttagggcctgaaaactgggatgtattatctacgaacacgagcagctgctgacgcaatcaagttcacagttgatactgcccttttgaaggccaatggagtatgtcttctggccctccccataattgttttacattcctgaatagccaactcaccattaaaaatattgttcaggaaaacggcaccaaggctgcagaggaagaggacgtggaagctaaaatggctcaaatggtttgttccttgaacaaccgggaggagtgcttggcgtgtggaagttagatgcttcactacacagttaaaatctatttttaaccaagacgacaccattatacaactggctgatcatttggtctcaataactgaaaagggagcccttcgtgtagtttgtatgagctgatttccatactggggggtagtggggctcccctgtctgctgaatttcatctttggcttgtactgtaacatcaaaattcttgggttactgcaaatgtacatatgtgttactgttaacgttattgacgtgtggtgttgccatgttggcaatggtactttgggtttgggagtctcatggttttgtatttgcttttgcgttatcattttttgatgtggtacgagtggcacatctttggctgtgtgatattttcaatttgttactgtaatggaatttatcaggagctgtacatcagtgtgtgcaacatgattactttttccgaaacagaccgtaagttcaatatgatggtattaatattagcaagagactaactagcattttccccatggaagtccagaaaaatggctaggtcgactgcttgattgataggcacatggatattgactggtgtactataacaatttaatgtagaattaatcatttgaaataattttttatttcatgataggaaatcactaattcttaattccctcaatctccagtaaaattaagcatttcaactgtaacggatgcagacagtagcttaagaaaaagaaaagcaagggctggaagcttcaaggattagtatgaatgaagaccaataacagattcaaagctttgacagattatttcatggactaattcttgcctaacctagtcaataacttgacccttgtacacacgcacagtactaaggtactactagtacaaagtacttcgtgcgatttagatcgtatctaagaaagagaaaaatattactactcccattgatctggcattcaatttttttaatgaaaatagtgctccattcatttcatattataaatcgttttgaatttttctctagtgaaatttctttaagtttaatcaaatattaaaaaattagtaatatctgcaacataaaattagttttatcgaatgtaacattaaatatatttttataaaatatttattttgtgtttgaaatattgctatattttctttataaatttggtcaacagggaaaaagtcaaaacgacttataataaaaaaatgagggagtacttattagtctcatattctaaaccaattttaaagatgacattccctttctatcgttcattaatacacatttacaactcttatgggctcatctcaacaaatcacagttaatacggctgctttggaaaaacaataggatgttttaacaatg

SEQ ID NO: 22729 - DNA, 18697 bp, Oryza sativa
  unsure (1)..(18697): unsure at all n locations
aaattttgagttcccggttctgatggtggttttttttttttattattttgccggtttctgattattgaggatcgttttgtttgctgaagccttttgaatattttaattttggtgaacttcatgttatatggactcctggtttatgtttggatcgatcttgatcgacttcgtgacaggatcggatttggtgttcttactgatatctgtggaaattattgagttgttaagaaatatctttttaagacttttgtcaagacatgattatcataaatatcttgatgaccttttgtttttttttaaaaaaaaatcttgacaggattacgcggtgaattttgttcctgattttgtattagatatttgtttgaaacgaaaaggcaggaggattgccttttatatgttaattaatagagcagagcagaatttgtattagatatgctattatattttgcaagactatatatttggaatgaccacagtaccttcttgacccaagttttgattgcaagcctgatataatacttttttttatctctttcaaattttgagaaaaatgtgaaactaacagcatattttgtggttcttcaattttacaggattcgtttgagctcagcaaagtggaccaagcccctgcaaatgttgatatcgagctagggttgcagggtggcatgtccagttctgcgcagcctggctttgaaggcttctttgaacaggtgcgttcaagtttcggaatatcaacatagctactcagaactttcttaagtgattgaaatggttccattcacaatattcaggtcagggagatcgagaagctacatgaaacattgacaaagttactgaaggaccttcaggtgagctgcaatatcaaattggacctgttgctgaatttaaattgcagatattgaacatgcatcaaatctcagtagcacctacagaatatagtaatatacaagtgtgacgatgtgatacgtgtattccagatgctgttaaattaatagtgattaatttccctgaatttgtttgaatgatttttttattcaacaatgttactcttcatctctctaaaagtctgcgaatttcatgtagaactcaaatgaggagtcaaaaattgttaccaaggcatcagccatgaaaggtacaatacgggattttggttctttcctgcaaattggatagcttatggatacttgcgttgcttcaattttgcatcactaatttgattcctcttttcaaactgtagagattaaaaagcgcatggagaaggatgtcaatgaggtgacaaaaactgcacgtctggcaaaatcaaaagtagagaagttgaataaagacgtgagtaaattttctctcaatatttttttcccaatggtacatcattaagtacctactactttatctttattacttcctacagatttgatatatgccactttgattttcttttctgttacagaatgctgcaaacagagaaaaaccaggcttcggtaagggttcgggagtggacagatcccggactacaaccactgtgtatgcatcctacattcattctcttgcttctttcttgtcctttttgttatgtttttcacatcactgacttccagttgataatcttattgcagctcattgacaaagaggttgagagaacggatatctgagtttcaggtaccgccttttcactaagaatttcatcaattattgcacacaatctacctgatagaaattatttagcacacatggttgttaattcaccaactcatgtactctgaaataagcactaagcatcaggattgtacctatattgttcagtttgtaaaatgggcgtggttgttatccttactgtgaactatttttgcagacattaagagaggcaatccagaaggaataccgggatgtagtggagcggcgcgttttcactggtcagttatgttaaattctcaacatggtatcaggatttctatttgaattgcactgatagccttactcttgtaatcatccattgtgtaaaattatccaaaacagtcactggcgagcgtgctgacgaagaggtaagaagtatattaacttcaaatcatctgttaacaaatctgcatatggtgtgttgcttacacctggccaaattttcagacaattgacaagctgatagaaactggggacagtgagcaaatttttcagagagctattcaggaacaaggccgtggaagggtaccgattcttttggcccctcttatgataattctaacatagaaagcttaatgccgaaaaaaaaaacatggtttaacctgaatttatggcttttgcaggtgcttgacactctccaagaaattcaggaacggcatgatgcagtgaaagagatagagcagaagcttcttgagctgcaacaggtaatgaataagcaatcttccagaaaatcgaagctccaaatactgtgcttaccttgcaattgtgaatgcagattttcctcgacatgtccgtgttggttgaggctcaaggcgagatcctggacaatatagagtcacaggtaaaattttacatgccatttcagaggatctttgctactcctttgtgagccacatttttgttctgacttctgaatccctgaacctatgacctatctatctctcttcaggtttcaggtgcagctgaacatattcagactggaacaaacctcctccagaaagcaagatttctgcagaagaacacacggaaatggacctgcatagggattgtcatcctcctcataatcatcctcatcgtcgtcctctccttaaagccgtggtctaagtagaaaaacctgcatctcagaagcatcatgttcatgtcgattttggctggcaatgtttatcttttgtgcagttctacttctagttgtgtatatgccacggtgtggtagtgcgtcatgtacattctctgaaattttgggtgcgaacttattcagttctctgtacttcaaataatgaacatgcagcttgatcatacataattttgctcataaactttctatataagtatagtttttgtatatataaaaatttgttttgaacatcattaaatgtttgttggtcatcataaaataaacaaacaaattgccagaattcaaaagaaagaacaagttgtgcctagccttactagcctcaaggacgataatgggatgacatgtggaaaagagagagaagggaatggaacgccgcgggaaactgacaaaagaaatcagacgtgcatacgtggttgacgaaaacaaaattttcgaccggttcaatagtcttttttaaggtgtgtttgctgctaagctgctagattgtttgaaccttgaagcacctgttgataaattgttaaaagggaagtctgaaggctttaagttctttacagcttttcttttttcggattcttcaaacagatttgctccatgagaatatattttcttgatccgatcgatgtgttgttaaaaaccacttgttttaaattatttgttaagtttatttattacaatatttaatttatccctacaattaagtaaataatcggtagccacaatccactcaataatttatttaaaactgagccttaaaagagaatgcttagtaaaacaaaagagaatgtttttttctcttctctatctctactaactaaaagaggagtgatcctctttcacctccatgtaaaaacctattttcccccataaaccatccaccctcaaaattgattttctctataacttaaaagagttgttcttcatcatcttcatgtaataacctattccctccaataaaaaccgtttcaccctgaaaaactgatttctcaaaaaaaaaagatagccaccttaaaaaaccgaacagcccacccaaatcctctcaccaaagaacaaaaagaaaagatatgcataggcctataactaatctactaccttaaaagcaaagtctttctccttccatcccatcttttcaccgagcgcagcgtgtgcgcatgcaaaaagtaaccattggatgtaatattttatcctcaattatctttatagcccatccctaattatatgggcctgacccgttacaaagtacatacatattactatacagactatactattaatagatggagtcatcctcccttccttccaatataccctaattatatgggcctgacccgttacaaagtacacacatattactatacagtctatactactaatagatggagtcatcctcccttccttccaatatgccctacttccatataaaaaccgcctatttctatctctgtcccacttccacctaaaaaaccttctctcccataaaaaccgttcaacctaaaataccgatcagtgtaaaaaacaagggtgtccctaatgcgcgatcagtcgtgcggtcgcgcaggcgcgcgaccaccagatccactactactactcagtacctctccgcgcgcgacacgtgtccagtcgcgcggggaagagagcgcgcgactagccgcccattagctttttcgtaaaaaccaaacagcccaatcgatccaaatccttccaccaaacttaataaaaaaaaacctgttacaattcatgggcctataattaattacacgaaaagagaaaatgttagcgtgcatcttttgatgaaatcggactgggcagcatcttttgttgaaatcggactgggcggttgtttcggcttcctttccgtaaatcccacaacctatataagctatagctgatcctagatcctgcgccactacaccacccaaacacttcgatggacgccctcaaattgtgattgcagattttccttgacatgtcagtgttggttgaggctcaagaagagatgaacatgcagcttgcttatgcataattttgcttatactgtaccacattcataatattcatagttcatagtgctaaggagcttactgaaccacaacacctcaggcctcagtaacaccagaacatagaatttgtcacttgactcgtgtgtttctgggataagatcaacatccattagaacaggtaaatgttacacatcaaatccttgatttgttttacatcatcatggcagtcgatggtacaacagaaaattagggtgacatctgataatacactgtaaaacagtcaggaagcagcttcctaatcaggctatttcaactggagcagcgtatctctgcagtggctattcacaggaagcagacgcagctcccagctatcaactataatttctactcaaacaatctgctccataaaatcggtatcatctttcctcaaaactcctctttcgggacttggacttgtgttttcttccagaactcttcacactgtgatcttgttcgtgctgctcagttttaattttgttatcccttgaccttttcccgctggaaaatttgagcatcacatgtaaaaaacaaaagctagaaagcatgagtcgattgaaataccagcacaaaaagtagcagagatactatgttgcatatccagacctgttgatttccaatgcatattcatcatcgtgtactgacaaccaaagcatggatccagtgtgaggtgggattaaagaaccagttacgtgacaattcatttctgcatccaccctgtgattgaacatcaaaagaagagaacatgatcaatctgtcactcggaatatggagcctgacattagctggttccaatcatcccatagtccctaatttaaccattcagttgtaccggggaataaattgctggtcatttcttgtacataacacaggaagctaaaagaagcttttgctatatagattagctgtgctatgtaaatgcatgtgtgtatttcagaaaaccattcacattgttttattattagacttaagagccattgtatcaaaatgacttttttcagggctcctgtcataataagcacaccaggggaaaaacaattctaacatgctagaacaatgcatgttcgtgaacaacgtacagcaagtactgcatacaactaacaaattacaaatatagtaacatacaagtgccataacttttgaataaaggtgtttcacagtggaaagcaaacaatgaatgaaaattttgaaactgtcaaggggactaaagatcagcccataccttttcacagaaaatcgtatcatgcttccctttttaatcacgtgctgtttgtccgaccggcttacaaattttcctccatactttttctgtgtaaaaaatatagaattatcaatatcattttaagataaattgtttttacgaaattaatattatttacagaatagataagtttgtgagccacatattgtgttcactattcagtgaccacacaaaatggaagtatttggcatttctttcacagtataatatgagattccataagattctttccagtggatcagaagttaaccaaattgtcacaaaacgtacaatttgtgaagcattgaatggactgccccacaatcaattctttccacaataaatttagtcatttagtaagcactgatcctaatatttccaaaaaaaaaaacacttgaaagcggtgcaacagcagtgatatgcttccaactactaacaatgatcaaacagtatttgaacttagttattacagttcctgccaagctatgttccccctttcacatggcagttgttttgttgaatacaatttgtgaagcattgaagcacacataaaaaatggatgctaccaataaaaccgattagtacactagagacacaaagagtttcatctataaatttgaaagtcacaatgaaaagaacagagagtactttcaaaccatcattaatcattatgaagagaaaagctgatcacttgatcttactcttttgaacttgaacttctcatgaatatcatccaacatgatggcggctgaaaatacccctaatacaatggcatgtattgattcctttccaagcatttcaaccttcccttctaataggaaacaataaggaaaaaaaaattcagaatcacatgttccataatttaccagattggttgttccattgaaaaaagatataacaaatggagccatctacttgcaaaacaacaccacacttgatacaacacaatatgaaaaatgttctgctcaagtgccgcaaatttgtgtagccaccataacatgcaggcatcagctgatacaaaaaatgcacttaagcaggacagtgtaaatactctacaagttaagggcttctgtaataacacaacctacccagcatcatgtctggtttcggagagtaaagcagcagatttgcgtgcacgggcacgccaaagtatggtaccaaaccattcaggattttgccttgttcactctctacagttgcttcatgagccaatagtacgccatcgaagcgatcttcatacctgcatatatgaaaatcaatcaccccgcggggaaaaagcgaatctcgtggaagcttggaagcatcaagaaccatcatgccatgagaaatcgcagtccctatgactcccatttcaccttcctttcttctttttgtaccgtaatttaatttataaatgtctttagaaaactagcatggcatggagccaagaacgaggatgaggaggggggcagtagagaggacgcacgagaagaggagcgagctcagctggcgggcgacggcgcggcggacgtcggcggcgttggaggggtgcacgtacacggtcagcttggcctctgcctcccggagcgcatccatcgcggcggcggcgaggcaggaagctagtagaaccctaagcagccagcttctagtggttgttcgatgcagccgcggcagcagcagtaaccataagcccctaggcaggcggcggccgccgcggcgaggcaaggaagctaaaaccctaagtccggcgagctcgagtgtttggtggcgcggcggcggcggcggcggcggcgaggggaggggaggacggcgactctgcgagaaggagctgagcaacggtttggatcgcttcctcggcgctgatcgaacggccacggtcacagtgggtagtgtatatgatcagaaaatgttttggattttgttgatcatggcagaaagtgtcggtgattatcaatgagaaactaatgggcaaaaattttaatatcaaatctatataatggcgtcccatatgacgggttggttgattggagtatcatcttggcaccaaatggtttcatgtgttgtgagttggttgattatttacttgttactagtttaattggcttggagaaattagtgatgtaattacttaacagattctatcttgattatttggtatgattatacgcagatcccattaagtttttcttctagtaccatataagcaagttaacatgtcacgtaggatgaaactgtcatccaaactattaagagactttgatatattccctttgtgccgtaatataagaggctagtgttagcctaatactggataagacatatcctggtgtcatgtccagattagtagtcctaggacgtgtcatattcaatactactaagttcttatattttgatacaaatatagtgcattggttttaatagttgaaaattttagacctaattaaaaaggtcttattggacacttataaaaccatgcgttaagaatcgacctataaaaacccagtggcagagtcacctcacgggcgggttgggcaaccactcgagctctaccgctaccgtgttcgccatcaacacctataaaaattaattaatcgatcctgaaaaaaatattttattagtcactcgggcttaacgtcgccgccggctccgtctaaaggaacatgtcctcgtgtacaaggcaaaaacctcaaagcacggattaaaaaccgatttggtagtagcattccagcccaccaagcctgcatagcccagttgcctaaagcccaaaggaaagctgtgctgtgcccctcacagcctcgcttccctcccttattaatccccctcttccacgcaacacaaccgcgggtgttctgctttcgaacacagaagggggagagaaagagggggaaatcaagaagcagagagagaagggaaggcgtccgcgctcgcaatccccaccttctccatgccgcgccccgcctcgcctcgccgaccaccggcgccacctcctcctcctccacgccgcgctccgcctcgctgaccaccggatccaccgccgcctcctcctcctccatgccacgctcagactcacttaccaccggcgccacctcctcctccaagctgtgggcgcccccgacaatcacccacgagaacgcctccccctcctgctccgccacgcgggcaccactccggccaccggcagctgcctcctcctcctcctccaagctgcgcagttgcacctgccggattgataaggtgacagagagctcacgcatctcctccccattcacgttctgttgttcattttctttattttctttcttggcacgatcgcaaatagaggggctttctcctcaagatcgacgatgcccaagcggcttgatccagagctcgtgcactctttatatctcaactgcaagaaggatcagttagttatctacattgatggttttctatgattcagaagacagggcgtgccatgcgatccgccgctcggcgatgctgcacctgccgagctgcgtgctcttctggtagatccgttgaaactgtgattctgagttctaattcttgtacattcgaatctctttaagtccattgaatcgattggttttgaggcgagaggagaccaccaacgccgggcggaaattgtttggcaactcgtgcaagattccaggtctgcaatgatgcagcgattctttcttctttcttatatctcaactgcgagaaggatcagttggtgatctacgttgatggttttcttgatgattcagaagacaggtcgtgccatgcgatccgccgctcggcaatgctgcacctgccgaggtgccttctgatagatccattgaaactgttgattctgagttctaattcttgcacattcgaatctcttcaggtccattgaatcggtaggttttgaggcgagaggatcccaccaacgccgggcagaaattgttcggcaactcacgcgagattccaggtctgcagcgattctttcttcttcttcctcgcaagaatcacaagatatccatcatgtgtttgttgcaattcagtacttgcttatctgtttgatgtagattgtgtattgctttgttaattccttgaatatggtttgcagaatttttggtgaaatggatttttttcactgaaattccttgtatatgctggcgaaattttagtgtattatggttcatggacgtcagaaattggatttcatatctgatttagtgaaagttctcgccagtttcctcttgttctgaataaggaccttctatctaattaaatgtatcttctttattcagatttgttgcgcctcaggcagctgctgatctgaccagcggtgcttcaagtaaaggtttagcgtttgagcacatcaaataatttggctataaaaattacagacttttgatattggcttaattgatgagggtgattattatattaagtttcatctttgtaataagattgataagtttaaatgggctctagtttttggtgtcgggcccaccccaaaatgaatttaaggaacactttctttcttttctgagttagtttatatgtgcagacataaattcttaccaattatcattggtagtgattttaatattttatgtagtcctatgaaaaagaataatgacaattttgataatagatagccctttccatttaatgctattatagatgatcttaatcttagagaacttttaatatctggaagaaattttacttgagccaataatctagcactgccaacttatgagaagttagatagaatgttaatgtcgatggagtgggaaaaaattcttcagagaagttagatagagtgttaatgtcgacggagtgggaacaaattcttcatctacttccaatcgccatcaaaaattttaagtttgagttgggctgtctataaagagatgtttttgtggatatggttaaggaaatttggttaagtgttgttgatggtaatactcttttagagagttggcaggctaagattcgtagattaagacaatttttaagaggttgggccaaacatactaaattttattataaaaaggcataatcaactttgttaactcaagaagagcttgattctagactttatttgaggaatagattatcttgtcttctaagggaagagaaaattaaatggtatcagcgagctaacactaaagatattttgaaagggactcaaatactaaatattttcatttcgtagcaaatggtaagcataggaaaacaaggatttatcagctacaggatggtgatcaggtagttaatggtgatgcgaatttaaaggcgcatatcaccacttattataaaggtctttttggccatcccgaagcttcttccttaacgttagatgaaagccaaataagtgatattccccaggtttctcaattagaaaataatgctttagtacaagattttttatgaggaaattaaacatgcgatttttcaaatggaacataataaagctccgggtccggatggattcctagctgagttttatcaggttttctggaatgttattaagcctgatttggttaatttatttaatgattttcatggtggtaatttacctctttactctcttaactttggtactactattttttttccaagtgcaaagaggctttgaaaattcaacaatataggcctatttgtttacttaatatcagtttcaaaatttttactaaagttgctacaaatagaatttctggagtggctcagaaggttattagtcccacacagacggcttttatacctgagaggaatattatggagggtgttgttattcttcatgaaacgatactacatgaattgcaccgaaaaaaagagtggtgtactttttaagattgattttgataaagcctatgataaagtaaaatggtcttttgttcaacaaacttttagaatgaaaggtttctcacaaaaatggtgggattagattgcgtcttttatccaaggtggacatgttggcattaaagtgaatgaccaagtgggatcaaattttcaaacatataagggtttaaggcaaggggacccgttatctccaattgtttttaatatagttgttgatacgttaactatattaataaagagagcaaaagatgatggtcaaatttctggagtggtccctcatctggttgatgatggtttatctatcttacaatatgctaatgatactatcatttttctagagtatgatttacagaaagctaaaaatatgaaattaattttaactacttttgaaaaatatctggccagtataaatcacttatgtttaaaagtactttaagatgaagattatatatacgttcgtagcatagccgatcaaatagatctaacatgtatcagctagtactccgataccactctatgtcaagatattaaaacagacaaaatatatcaaacagcaagtctaatatactttaatgcaataaaatcttaatataaagggcagatttagcatatcaagtgaacatgtagggatgaaaggtagctaaatgaggtaagatcggctgaaaccccgataccatctcctttgacgatcataagacaaactagatatcgcagttatgaatatcacttaatagatcgaactcaatcgatgcaacattaagcataagaataaatacaatatctagacatgttgatgaaaacctctaggagatggtagatatgctatataatctagattaacaatgatatctaactctatcggcttcgggaggccgacgacgatgtcgtcgatctcgccgccggtgaccctgaacccaccgccggcggctctgccggtgcggcgccgactgttgggccctgactcgtgcagacgcatttgaggcgatgatatatcccccttttttttgtttagtgagaacaatattttatcatgggacgtaactacacagctagtggcaaaccagctaccactccatccataagaggcaccatccacctatacttcaaatacaattttctcttaaactactcatccgatctacgatccgattacaccgttgtgttcgtaacaattaaatctttacaacaagatctcacatgattatattttgacgaaaaatcacaaattacttttatgatatgtctaaattacttttagatttcactaagttacttcttagatatataaaagtaaattcagtaaaacctaaaagtaatttacatatattatagaagtaacttagaataaaatgaaggtaactttagcatgtcatttgaagtaaatccgttgtagagataaaaacatgactctatctaaaaattaaattaatcagcacaaattatggaattaactaaaataataataaaagtaatcacctcagagcattatgaatgtataggaagtattttaatcaaatctaaaaataacatatatatatatatatatatatatatatatatatatatatatatatatatatatatatatatatatatatatatgataatttgttcaatgaaaaaaggcattaattaaagttactttctttttgttataagttatttctataatatatgtaaattacttttaagctttactgaatttacttttatatgtctaagaagtaacttagtgaaatctaaaagtaagttagacatatcataaaagtaatttgtgatttttcatcaaaatataatcatgtgagatcttattgtaaagatttaattattacgaacacaacggtgtaatcggattagtaatttaagagaaaattttatttgaagtatagatgataggaatatttctcctacttgcccaatgaattaatagcaaccaaaactcctaaagtactagcacgtgggtgtctctggttaagactaattggagtggcctctccaattagatttaccgtttatcatgacaagatgagaacgaggcttctgtttgttttaggggtagtttgaattagtttatgtttttcaatcacgatcgattaggtaccctttgaaacacaggattgttaaagtacaggaataggaaaaacgtaggaataaaatatcacgttcattggattcatattggatttgattttggaaacacgggaaagcttcgaaactactgtttgatagtcatacatgaaaaattgtaggaattcaacacaggaagaataaaacatgaggtaagagcaagagctgggcttgtgtacgtcatggactcatggtcccgtactcagctcactgatgtagtcgccggcatcagcgagaaacaacgtccggttgaagagctcaccaacgatctcctggcggccatagacgccggcgagccggtctccggccagctggcccggctcgaagagatgaacgccgaagaggattctgtgcattttaatttagtgtgaatttgtattagtacgaagttgctggcatcctttctgataattgggcttgaggattgagactgagtttatttgtatgtaaactccagggcaaagggctgatatgaactttcaaaacaaaaactggcatagactttcaaaaggtacttcgtttatttagcaaatctccagggcaaagggcattcggcacaactactttgcatatgcttacagttgcgtccaacgaaaccaatacaaaattccacagattatgttttacttttgaagtaccaaaactatggaactgccggctgctgaccaactcagtgtattgctaactacaatatgatgaagtatgcgatctctctgactaaccatgggaagaacattttcaagcaccacaaccggtgctttggcaaattaacacttcagaaagaatcgtgcagtacaacaaagggaggatttaatcttcataatctacaccgtcctcatcgtctagctctgagctatcggctccacccatgagcgataggaatagaagaaccgcaacgagctgtgtcgcaaggaaatactttgcttttcgcctgaacttcttttcctcctctgttcgttccttcttagctctgggttttggcttataacctagaaagtatcaggttgattagatcgcaaattgcaaataaatgtttgaaataatccagaacatagtaaaaactctactgtgcaaagatctaggcaatattgaacttataatatcgattggcaactttgctgcacaaattgcagtccaaacattactggtaaggcctctcacagtgcgtctagctggaccgcgccttagtcgtgccacgtcggaattttgccgccgtgtcgcttggacccgcgcctaaactaggttcctcgtctcctaggtgagcaacgcaaaacctcgcgaaatcgagggcacgcagcgtggagaagacccgggtcgcgcgcgctgtgggcggcgtagcctcgccctggcatgccctagcgccgaaaccgtagcgcgaaatccccgattcgccctcccaaaacccattcccgctgcaccaatttctctctcccgccaccgattcctccgctcccgcgccgagaatcctcaaaatcagcaagcaaaaccaagaacacagattgcagcggcgacgttacaagaagaatcacacaaaatcacaaaagaaaaatcaagacacaaaatcatacaagaaaaatcaagaacgccgtcgccaagaacgccgaggaggagcgcgccctcctcccggctgccgtccgttcccgccgcccccgccgtcggcctccgcggatccgtccccggaggcagaagcggtcgaagcaagggagtgggggagggagaggggaggggcggcaaacagatccaccgccgccgttgtcgccacaacgacctccatggcggcgacgacctcctgcgccgcggaggtgtagaagccgtccgcccgtcggcgccgcattgtccactcccgccgctcccaccgtcgggcgtcgcgccgtccactacaaccgcccccatcgctcccgagtccgagcggaaggagaagcgagcggcgcatgcggcgcggtcgacggcgaggcgacgcgcacggcggcggcttccccggcgtccgccgcgagggaggagagggaggagaggaaggagaacttgagggaggagaaggcgaggcgaagggggaggagaaggcgatgcgccgctgaggataaggggtaggtgaggaaaattaatccgtcggtgcgctacccgtgtcctcgtgtagggtcccgcccactgtggacttcgctttctttacctgtgtctctattcaactaagccacacatatatggatgcttgcactgtgaggtgggtgtctttggaccaattttttgggctaggggtacgggccccatagcttgcactgtgagaggcctaagtgccaatctagtttactacagttgacttaagtagtagtactacatgtcatttatttcataattcatatggagaagtgcgttactcccattatcaagcccaagaaaatcctgaaggaacacagtacaatacccacatcaaatttaacagattgacaaatgataaaaataacttgaaagcatatggatgtcatgcaacaagcaatcttggaattccggtgagaatcattcattgaaaacaaattacagaagatgagggatatctcatgaacaaaaaaaggtgttcctaatactccctccgtcccactttataaggcgtgtaattatttttactaagacctgcatagaaaagtttttttactgttatacccctaattaagtgcatgcaaaaggatttaatctcatcgcttcagtcggaagcggagaatatttgagggcccagcccatctgcatgctgcgcgaagctgcatgctccacgcacaggctgcactgaaacagctaacaagggctaatctcaggacaaatcaaaccaatttgaagatgcaccttatgttgtgggacactgggaaaaaaaaactaggcgccctctaaactggtacggagggagtattaagcaaccataaatatgtacactaatagcagtctgcatcacaatctgaatgaaaataagtcaatataataacttactccgaccagaagacgctcttttcctgggtgtagaggatgatgatggatcagttgatcccaatcctgttgctgatgaatcagaatcagcttccagtaattggaccttgaggtgcttggtaaagtttaccaagttgtcatacttctgcagacagcttcgcagcacagacgtatcctatggggcagaagtaagaattttgtcaagatataatcaacacagtattttgggaaatgtgcttgacagcttatgcttattgttagagaaaaaaaaatatccacgacaaacagaaccctaatgtaactatctgaagaacttgagatgtgcaactgtgcttgcagtgcaggtgcttcacaattttcaacgtggcatgcatgcaattatatactcatatatcaatataaatatataatcactttggcaagttaaagctgagtattgagtgttgtcagaactcaccggtaatacattaagaacaaaaagcgcatgtccaagaaaaagagcatcaacgtctgtagggctgcacagattgaaacaaaggaagttagtgttctgtaaatatcataccatatgaagagcaattatcagtcagtatgaacagaaagctgataaaataatacgaagatacattttcatgcaagtcaaaacaagataaagtgataatacctgttgtcaaagagaaagatctgatctcctaatctcgtagataaggcatcataagcagcatttgctttctggtatatctgttcaaaaaagacttaaattgtatcacgagattttcccatgtgatgaacaaattagccttaagaaatatgagtggggaagtagaaacctcctcttctttttctgcagcattaagcttagttatgcccagttgttgcttcacttctctcgttttcttccaatagagtatctttccaatgggccaggagagatcagaaaagtagatatcatgtggaatgcttccatcagaagccagccagagctcatattgcaaagcatctgaaagccaggtcataaccatggcctttgtggataatacatccgaataagaaacactaggatgctttgagttcaagtcaacaattttctcctccttgagatattcaattacaccacccttttcattgttgaatgcaacacattcaccaaactcgacatatggtatgtgatctgtggaatgaaaactaaggtataagaacagcgagcagtgaatatactttacaaatagtaggaaaaaaccaagatttcaagtatctaccattgtaaagatcaaatatgctctttcttttgtttatccccctctacactacaaaaaagtttacggacaggtgggacatacttcatcccccctttaactttcatagaactccacccttcagcacccaaaccccagatgtttcgtccctcagttccaccacccttccaaatccctttaacatcaaaccgaagaaagaaaacaaccaggcttgcaagttactctgacgctcgaacgatacagccagttactcactatgagctgcttactgtcatttaaacaagatctcttgaaatttcagctagccagttttagaagctgtccttgcaacacagaactggttgtggcattcaattatctgatgccgcattagtgttgcaaannnnnnnnnnnnnnnnnnnnnnnnnnnnnnnnnnnnnnnnnnnnnnnnnnnnnnnnnnnnnnn

SEQ ID NO: 22730 - DNA, 2115 bp, Oryza sativa
  unsure (1)..(2115): unsure at all n locations
taacaaaactggattatatcaaccaataagtgtcatgtatctaacagaatatatgcagaactcagatagcatctcatcgccacggacatgagaaactgagaatctctgcagaatgcgccttcgcatttgcatgagaacaacaacacaatcatcttccccagccccccaaaatcaccccccacgagcaaatgcatcaatcccctagcgcaactctgacatcatctgacgccgccgagagggggacagcatgagcggagaccggcaaaaccgagcgagcgcatagaatttgagcttacggccctggtacatgtccacaggattcgggtgaggggagctcaccggcgtcggggaaggaggagtcgacgtggatgtcgaaggggacgttgcacatgcggaggtagaggaggacggggaggcaggtcgggcaggcggtgggcagcccgaaggcggccttcctcgccaccagcaccttccgctcagcctcctcccactccgccgccgccgcgccgccgccgatgccatcgccgggagtggagaggattccttggagcttcgggaagaaaaaaaggccgagggtttatgggtttgctcgcctcgccgccccgctgcatctatgaagcccatcacgtacactgggaatccaattccggcccacatcacgtcggccctgggggaatctcgttcttgttggagtaggcccggcccaagtacagatgagcataagagaaaatgaataagtccattttaactctcatatataagtttagtcttattcatattcctaaactgcgatatgggatatgttgaccccaaaacttgttgaccccaaaactattaaaaccgatgtaatttaactttcttgtctgttttaagagcaattttcattgatttggctcgagctcgtgtggcggtgtggacgaagaacgctcctcctcgctagatgtcgtcgtgccgctgccaactgccattcttgagctcgtgtggtggtgtgggaaaggggagcataggagaaatactcggccacacgggtccctgacatgtgggctccacatatggacctagtcccattagaccaggtcaaagagccatattagcaaaaaccagcatctccctaaggccttccgccttgcctggttgggccagccatgctagagatggagatccattgccatatctaaaaaaccgatgtgcaagactagaagagtatttttgtcgatgagttcatcagctattggatttttgtgatgtttgtatttttatatctatctactgaatttattggtaaattctctgaatctttgggtctccgataattttggtcatggctgagaccgaaaccaaattatccgatactgaaatgggtcatctggctatatatgagctttaaacataaaaagtaaacaaaggagcaaccgtaatacccttagcccgtttaggctgcgttcgaaatgcgtattattgcatattattgcatattaattaagtattaattatttatttttaaaaaatagattaatataattttttaaaataattttcatatagaattttttaaaacagtttgaaaaaacgtgcgcgtgaaaaacaagagaggtgagttggaaaaactgagggaggaacacaggcttagtatatttcaagttttcaactaagcccaagtgttcatttggtaggagtagttctaggtgaagagtttagatgggtttgatctagtttatatactcgattcactctaacaatatcaacaccttcaacttaaccctttcaaatgaaacgttaacaatattatataagtaaaatactataaaaacgtgggtctgctcagcatatatataatggactaatacggatttgaaggctagtgtaacacaaatttacagcaattgcctctatcttcttgttcctctaacaaatcaataagccggcgtcatgatgttttaatgattctcaccaaatttctggatcatcatgtttcaaattttcaataaacctcatcaattctttttccgttcgttattttttttttcgatgagagaaggccatgttcaattctcacgcaannnnnnnnnnnnnnnnnnnnnnnnnnnnnnnnnnnnnnnnnnnnnnnnnnnnnnn

SEQ ID NO: 22731 - DNA, 7806 bp, Oryza sativa
tttttttttcgatgagagaaggccatgttcaattctcacgcaaaaactttttacactgtcacattgaatttttggcacatgtataaagtactaaatgtagaaaaaaaaccatttacacatattacgtgtaaattgcgaatcgaatctttttaagcttaattgtaccatgatttgacaatgtggtgctacagtaaatatttgttaataatggattaattagacttaataaatttgtctcgtggttttcaagtggaatctgtaatttgttttgttattagacaatgtttaatacttcaaatatgtgtccacatattcaatgtgacacgcaaggccaaaaatttttgccaactaaacaggcctaaactgctcctaatatatgtttggtataaggttttatcaatttttgatgtgttttttttttctaagggtgtgtttaattcacgccaaaaatgaaagtttggttgaaattggaacgatgtgataaaaaaagttagaagtttgtatgtgtaggaaaattttgatgtggtggaaaagttgaaagtttgaagaaaaagtttggaactaaactcggcctaaatataggccctgtttggagaactggccaagagttattttgagagctattttttagcacaacgaaataacccttcaaaaaatagccccaagttgtttggatccaagggttattttgagagctatttgaccttcatgtatcttcctatggagggagatagagagaaaagacactttttcagtggacaccacccgaaatagccccaattagcacaccttgggtgggttatttctaaatagctcttaaatagctcacccttttaatctttttggactgtttaatctatttgagggaggacttaaaaaaaatatcccttagatcaaagagaggcatagaatggacaggttcgtgcgaagtccacatcagtgggtcgggttcgtgaggaagtcgacgtcaggtgatctcttttcccgagtccactgtccaacagtaaaatggacagaaggccacatcgctgaccgatcctgatcttctgtgaggttcgagcgacacgcgcgaaatgccggtgattcccctggtcccatttaacctgctccgtataaatacaagggagagggagcagctcaacgcacaccgaacaacgaacactgtcaagctgcaacacacaagctgcctgcggctgcaatggcggatcgggtgatccattacctcctgcgcggcaaccagctgcagggccgccgccaaaccctcgccgtcggcgtcggccaccaccaccgccgccggctgctcctcctcgactccagccgcgtgttcatgttactcgccgtcgttatcctcgtgcacctgctcactgcaggcgcggccgccgtccagggcgccgagccgtgcgtcctcgtcgccgccttcctcctgtggctgctcggcgccgcgttcgccgtgctgtcgctcgccgccggccagttccccgttcttgctgccaccgctgccaccatcgcgaccacgctccgcagctacctgattggaggtctctagcccagctttgggtttggggacagtactagttctgaatgtactgtgcagtactttcattcatactctgaaatcgcacttaattttgtctctactagattattgcttaaatatagccgactagccatatatatactttctcatcaagtttcaactttcaagtcacctgttattgtactgtagctttcaagtgccatgtttatttaaatttatctattcagttctacctaaacaaacttaaattgctgtggccatattatatttatttatcctttggtgcgaagaaaacgggccaagcatagacaactaccttcttttctaaaatgtaaagattcctgcacattttaaaaaatatgtagaattttttatattttagaatggatagagtaattattatatatatacgacagtgttcctgaatcgtgacttcgtgaggagcacggagaaaacgtccacacgaattctacgtcatgcggcccatcgtaccttcgctttcgttctttcctgttaggattgtgcttgcccgtcttcttggggaggtctcatacccgcatcgctgcggcgtgcaagcgcaactacggtccagttgaaagaagagcaagttagcttatgtaaaacgagaaaatcattgatatatgattatttaacttttagttattataaaaataaaattaaatttatttgatattttaaaataacttttatatagaagatttttgcacgaaatatattgtttaattatttgaaaaggtattcacaggaatcaatggtagaatctacgtcttactccttttgttcaaaacacattctgttcagattcattgtactaagatgtgtttcggatgtgttccatcctagtactagtctagatttcttgggacggagggagtaataaagaaagaacgggcttacgtgcatcttccttgtgtttcatagattcttttgtttcatatgaacttaaacctaatgaataaaaactcagttggactcgaaaatagaccatgtataccataatagccatgttctgcctttttttttcttctcgtgtctttctcgccttacatattttttatccaggaaaaaaattataaatagaaactttgtacatgataattttataataaaaaaaattatacatacaagcttttgtgcgtataattttttcgataccaaaacttccctaaaaaacaaacttggaacaaattcgaaacaaaaaaaaagtaaacgaagaacaaaaatgtcatgtggggccgtgttgacgcgcggcggagtatcacttgtggccttctgggaggtggttgcgtcgattggttggcgcagctgcgttgcaacttccaagcgcgtttgaaaacgtcctcggagtagtgccatttgtgcttgcttctcgtaacgaaaccctggaggtttggagcaggagaggctgcaaattgccatcgcatcatggactagatggacaaatttctgattcataccgcaccgggcatgatcacaagtctgatgaagtgtttctcggctggattttgtaagggcatcctcaatatttgtggtgtagtgtaaccttaaggtgggccctatgaatagtgagccattgttaaagccatacccacaatgctatggttagaatttagccacaagataggcccacatagaatagaaaaataattgtttcatctcttgttcatgaagtgaatgagagagaaaaaatattttctttttcttgtggtagaccttaagcataaggtgcaccctaaactaatgctactttccacaatgtatatagctcactttacaagtgcaatcattaccttaaggtcacctttttcatacattgtggttgccctaaggtagtaactcaggatttgattttgagtttagggcatgtttgaggaagcttctgacagatgcagtttttcgtccaaaacagtcagtttttttttccagattttaagaagatgtagttgtagaatccaaaaaaatgaattaaaaaccccaatcagacccttagacatgccacaaatcaacataacagaaaacgccatggaatacaaccgacttcacagcttctaaccaaaggctccaaagctctttccatacacctgcattttcaggctaacgaaattcctgaacaaatgaaaccgaaaacttctcccagcacgccaaaagacaaagcgagtggagaacgagactgctctcatcatttgcccccgaggaacaaagcaaggttacatggaggaaaccataacatagaaggtgggttaactacaaatgcacaaattttaaaaagggaaaaagtataaaatgtgctgatcaaaaaccttaatagcaatcgatcatacagtcaaatttctacttcttggctgttaactggctacattaggacggcatgattcctatgttcaacagatcaagtttcaccaaattaatcaaataatagttgcacacaagcaggatatttgtatgccaaaattacaatctccaaaataaagttgcagtttggtgcatcactgcaattttattttggagattgtaattttattttggtgaccaaatcataagcagtgtagcagaacaagcatgcatggtacatgaaacatcagtcacaaccatggacaaaactgcaccttggtggtagtatctcaaagtacaaccagaataagtataaagcatcatcctatcaatcatgtcaagaaaaaaaaacacaactatatttacatcttagttgaaaaactattgttccgcagaaacacctttcaatgccacttcaaagaagtacaatgctcctcaggcagtttcaaaaagagaatcctagacatcttagtactagttcaagtatggtttcacaggattgagttgctcgcaaatttaatgaatcaatcatgaacacagttagggcttattcggaatggaggagaaacacaggaaatgaaggatttgggttcctatggattgctttactgtggcgtcattcagatcacaggaaaacgttcataggaaatacatagggaaatttcctgcactagccatatcactggaagatcacaggaagaaaaacgtccatgctgacctcttttttcgctcccttcgcgtgggaacgaggcaaatcatgccatcaagcaactaaagcacattattaggttgattaatgttgtttaattcactagtagtatgtgataattttgtaatagtgcacctattttcttctaaagattcctatgtttttcctttactccatccacacctattcacatgaaattcctatgttttcaaatcctctgttttacacttgcattcctatcctattcctatatttttcctattcctatgttttttcaatcctgcattccgaatgagcccttaaaacgccgatcttcctacgttaataatagcactaaagctaaagggggcttaaaacatagatatcccggaacagatagatctttaattctttgttagcgtagaacccatatcatactgggaaaaaattaaagtactgaacaccagatcagattcattgtttgaataagtctaacacagatttatcatagtcaaggatgcagcttactagagtatcacattttgttcccaaattattagaaagagcataaaaccaactaaaccaatgtgaaatcaagaaaattcaggcacaggtacaagataaagtaacaaaccatccatagtatcccctcaagttcatagttggcccaaaggttcgtctcttgctgttgggggtaagtctgtcttattactgtctaaacaagcccccttttgtaataccaccatcttttgttgttggctaatgactgttgttattgttaagttgaattgcccatgagcaaagagacctatggtggccacagataaagattttaacctacagtcttaaaccatattccatacataattactgacattcccataggcaaggtacatggtgaatagaaatattaaaaacatctaagaagctgaactatgtagccataggaattctaggtctttcgaaacaacagaatcaccttacagtttgaattgattcactaaacacattcgatgacaatataatcacatgcatagatctcaaacgattttaccctttaccctacacccttgtttttcatagtacctatctcccttaccacaataacaatcaagcaaggcatacagaaatcgcaaaattgaacaaacttaagggaattcactgtcatagataaagcatcgaccgcccaagcatgtccaacataaaattaaaacacatgattatcagatagtttggtttagataacaagaagcataataatgataaaaccatctaagagcagcaggcatcacaaggcacagcaaaccagcacatcaagcctcaggcgccggctgcgagaggccggccttggcgagcagcttccccatcgcctcaggggagcacacctggtactgcacttccccggtgccgggctgcaggaacacctcggcgagctccagcttctcggcggtcaagctggtcgaatccatggtcttgctcaggaccttgagggcgagggctacggcctcctcccgggtcaggccgtcgcggtagtcctgcttgagcatggactgcgccgcctggctgttggccccgacggccgcggccttccagccgctgtagttgccggagggatcgctcatgtagagctggaagccatggtgcttgtcccagccggcgaagaggaaggagacgccgaaggggcggaggccgccgaactgggtgtacccctgcttggtgtcgcagagggattggacgagctgctcgacggggatgggctcctggtaggagagggcgtagcgctgggcgtggaggcgccccgtgttaaggaggatgttggcgtcggacatgatcccggcgacggcgcaggcgaggtgggagtcgatcttgtacatcttctcggcggagcgcgaggtctggaggagcttggaggtgaccttcttctcgccgacgaggaccacgccgtcggccgccaggacgccgagggccgacccggcgttcccgatcgcctccatcgcgtactccacctggtagagacgcccctccggcgagaagatcgtcgtgcggctgtcgtaccggcgagacatcacggcggcggcggcgagagattggggttttctccggttagatttggggatttgaggggggagaagtgaggggagaggtgtgaatcgggtgaggttaaggagagagacctacttgtaagacaagaaaagaaaagagaaaaggccttatgggctggatttgatttgaatttgtcatggaaacgaatttgtacatccgagccccctatagattctaactttttcttcaaacttccaacttatccatcatatcaaaacttttctacacacataaatttttaaattttttctttaaacttccaattttagtcaaacttccaattttagcgtggaactaaacacacccgaattgaagtggggtgggggatgaggagatatttagaaggaaaaagtaaaccgaaggtccctgatcttgtcatcgaattaaaaaacgtcctcaaactgcaataccagatatacggcgttccttaactaatcaaaaccggtcacaataggtctttcggtggttttgactccagttttatccgacgtggcggctgagtcagcgtggaacccacgtgggccccacatgtcaggatgccacgtcatctctctcccttcctctctctctcagtcttctctgccgcgggagaggaggagggtagcaccgcgacggcggcgggcggtggcggcggctgcagcgggaaacacggcggctccgaggcctacggcagaggccagcgagcgagtgagacacgcggaggcgggatcggcggacatgcggggaggtcgacgagctcctcccaagtccaaatcctccattgtcggcgagctccactgcgtggaaagggaggaggtggggtggccgcgatcgtcggtgaggagctcgaaggcaggggcgcaaaggaggcggtggctcggtggctgccaccctctcccagctcctccccctggccacagaccgccgccgtgccgttccatcagccgccccatgctcggccgcctaccgccaccgccctttgccacacactcacttaccgccgctctactgcaccggccgtcgtgccctcacacgccgcctccgtcgggcgccgctcaaccctgctcgctgccgccacggtgctactcccccgcgtcaaagagaagaaaaaaaagaagaggaaaaagaaaggggaaagacagtatgc

SEQ ID NO: 22732 - DNA, 5071 bp, Oryza sativa
caggtcgactctagaggatcccccgagagaagagtgatagagagagaggatgaagggagagaagaggggaaacagagagatgacgtgacatcctgaaatgtggggctcacgtgggtcctacgctgactcagccgccatgtcggacaaaaccagggtcaaaaccacgaaagaaactattgtgaccggttttgattagttaagggacgccggatttgaggacattttttaactcgatgacaagttctgggaccttcggtgtactgaatccaattttatgttaggggtgaattcatcccaaattcaaaagttctgatattgtcatcgaagaaaaatagcattgtaaacaatacttcaagtgtcgtgtggttctgattatttgatctttacggctcataagccatagaaaataaactaagcaaaaaaaaattatgtgcaaaactttttataacgatttaaaaattcaatgcttaaaaacaaaactacaaggaaaaaacttaatattaaccatttaaattttagctgcaactgctaagacaaccaaatgatgaggcatgatgggtcatgtgaactaccgctttttctttttaaaaagcatctaatataaatgaaatttttataaagaacacttaagaaaatgcgaaaaattatataatatttgactctatttagaaaccgaactcaccactggaagtatgtagcaacaagcaaggagtagcaaaaacatgcgcacaaagttataaaaacttaaacatgggtattaacacgcaattttcgtaaacaaatgatcttcggtgtcaattgacacattgatatgggtgcaaaaaagctttacaaattgatacaagtaacatgtacaaaactttcaaaaaaaaattaacttgagattacaccctggctataaatgatggtagagcaacaaaactataggctaaaaatcatgaccacaaaccaaactgtacatcaatattgttgctttcctcttgacgttacacagtaccttttcctgtacagctcatgtaaacccagctcaatgcccatacaatacagacataggctcatgaacatgctaagaagacagaaggaacaaaattaaaacaaccagctttgtatatgcacatctgaacacctcatgcctttcgatgcttcacaagtgaaacccatttccaccagaggtagacagctgatgaagatatcactgtagcagctatggaaagagcagcaattcctgcaaccactcctcttcgcttttcatcgtgccttgatgtaagcgccacaggaggggggctggcttgcgtctccgcggaagggaatactgagaaagtagagcattttcttgtcagtcaatgtttacctgataaccagaaaaaaggtaatcaagaaaaatagaatatgtactgtgagtctgtaatttacctcttattgctgacaccagaggaccataagttccattgcgtggaatacagcaagtgcctcgcccattccagtagagatgtattttcaacactgaggtggtgacatccgctgtataatttctgttaatgggtctgttggaaccccctgcttccttggaaatgtcaaaatctgtcatgatattccgatcctgcaggtaaccacacatttttgttcatgttttgcccatatggtctggatgtgccatttgttttgctttaagattgttaaacttggagagagagagagagagagagagagagagtgatcagacctgaatgtcgatgttaaataaacgccttcctgatccactttctataactatctctgcaaagaagagttgaactgtatatttcccactaggcaagccaaccacatagtaccataaggaaccagttgatgttcttgccgttctgtagagctcaggtatgtttgttccattgccggtagttacaataccagaagagttactaaaaggatcagtgcccacatgactgactacccaattattattagtgtccacatgaaagtctgctgctccaaggttagcggagtcgtcattgaacatattcgacggatctgaaggaggagtatattgcttgcccccacagttcacagcaaaggatacaggatctgcatttatggtgtgatgatgaataagactcccaaatagactggaatgatctaaagtgaacctttagaagcattgacaaatctccaacagcactataaatatttacatcaaaacggttaattgcagcattatcagcatgtactagtactagtagtcttataggaaagtaaggtatgttcataagtcaatggtcaaagttttttaaacgtactagttaaacctgttgtgttgcatcctttcatgtcgacacaattgaggagacgaaggttttcactgcatgataatagagaaagtaaataatatgttgcatgctattttggctgttcgcatatgaaggttaccaacccaaatagtatgcacggaaaacagagcggtcaattagcatgtgattaattaagtatttgctaattttttttttcaaaaatgaatcaatatgatttttttaagcaactttcgtatagaaactttttgcaaaaaagcgcaccgttttcagtttgaaaagcgtgcgcacgaaaaacgaagcaagagagttgggaacttggagttccaaacacaccctaaagtaatcaagaaacaaaattagtaaattctaatgcatactagaaggaatgcttgtacgttctaaaattatcaagtctgcgttgctgacgctatcagcctacagtcaagtttccaattcacgcattctccttgttaagaattattttacctccccaaatcctctaacacgggttatgcagttctcttaacaaataatatgtcctcaatctcatgaaaaatataaaaaggaatttctaaatgtttgcctcaatctcatgaattgcatagcaaacttgagagcccttcagtcttaaactgtccttaaccagttaaacttatttgattgtttctttaaacaatagcaagaaagagagcaaatataggagcatagtgattaaattattacttgttcgatgatggaagtctatttcaatgagcttatatgagtatgacaacaatatcataaaccatttcaagtgttgcttacctgccaactgagcttcctgcaccaatcgaagttccaatataatttctatgcataaaagacatgttcacaaaataatgagtaaggccactgtaacaatcagttgagtctagtgcttaatacaagtaaatggcatacatccgcatctttctatcagcagaactgctaggaagccttcccctaagcaaaggattatatgtgacatccctgtagttttcaataaaaaggaaaggagaattgttagacaggtttaatatcagattgtactttgtactagggaagaaaatctatcctacttcaacatatgctctgtcgatttttatgatcggtaatataatttatagggtgcacgagaacaaggagagatggtgacacaaatttatactagttcaggccctcgaatgaggtaataccctagtccagttagcgtagattggatctacgaggtgtgtgcaaatcaacaatggagtggctgatggtgggtataatggtgtctaacctctctagggttcctaccgatgccttttatatagtgctagggcatccggcggcatgtatggcgcgatatccataataatccgggtatctaccatctatttacatgggattggatagactttcttatctcttatccctttctatacaaaaatgttgcatgggcctaaggcactcgacccaccctatgcagtacaacccaaaggcctcctctagggcacccgggtaccgtgtcccccacatgctccaccatcaaattaggcactatgagcatgctgaacttgaccacattgcatgaaatgtaaaatggcaaatagagttgcatctaattctgccttctcttttcctcttattagcttgggtgaaggaggattagctgacaaggaaaggatttctcttatcctcttatcagcttgggagaagaaggattagctgacaaggaaaggatttgtgctatattgccgttctttctcatttagtatttgaagacggttgtgtaacagtatgcaccttgacagagtacgaaatattttaagtagtagggattgcttgcaacagtagctgatgaaaatataacatataatagttgcccaggtggaaaaatcgtgccatttgttttccatccatgaagttcacattataaaatgctttttcctacacttcaatcagcaaatgcaaacagcagacttacagagcaactagtgattgaggcatttgatcaggcagagatccattgaaattgttttcacctacataactaacaaataaaaaatcatcagaaaggcagggtaaacaataacttggaaaaataaaaatggaaaagaataaataataatatatgcaccccaatgaccaatagtttattgatttaggcctagttcttttcttcaactccaaatttcaacttcctcattttccgttagcacgcttttcaaactgttaaatgatactttttttaaaaaaaatctatatagaagttgttttaaaaattcaaataaatccattttttaagtttataattatcaatacttaattaatcatgtgttaatgagctttctcgtttcgcgtgcgctaaaaatgtctctcaaacttgaggcaaagaacacagccttagccagattcaaactgataatttgaaataaacatgttagctctcaagatagttagataaaaccttcggtaaaaagaaaaggtaattagataaaactttaaaatgtataaggtttccaaattttgcgcacgaattagagcttagaagctgactctacaacatactgggaattcatattctgaaaagtatagcatggtcaattacaaattcctgaagtgctggtggaagactgaaaatattcgtaagtatagcatgatttcagctctcaattagaaacaatagcttcccagaacacaatcctacagttgaacaaaagtatggcactgcaagaatttcagaagtgacgtgttcagatgac

SEQ ID NO: 22733 - DNA, 9351 bp, Oryza sativa
  unsure (1)..(9351): unsure at all n locations
nnnnnnnnnnnnnnnnnnnnnnnnnnnnnnnnnnnnnnnnatattgaatgtagatattccaagccagactagtagacaggcaaaccctggcacaaatgcaaccaagcaaggtctctagaaaacgaagactttcctttttggcaaggatagcaatgaggaaactcggacagcaaagatacattaatttcgccatccatccttaatagtttaaagacaacatgatagtttaaagatgtcgcttgtctatgtcattactgactgaaaggtcatatcccaagatacatgtaaagaaaagctgttgagcgacctggtcaacatgtacaatgggttttaacttgaacttgcaagcactaccaagttccctaacgcaagcatctcatccgaaattaattttcttatttaacaaatcatatttcacgaagaatccaacttacaggtactttaggctactatcgtactgctgaaggtcaattgatcctgacaagttgtttgatctcaaatctctgcaaacataaggcaaattgagagagtaagagagagaaacaggcagagaaggagagaatcatcgcaaataaaaacagtagttatttcaatgttcacattcattgtaatattgaagattaatatcagaatacatggtttattgtattgtaacgtttttttgaacaacaacaaaatcaaataggcataggcttctgcagccaaatttaaagttgttgcctgcaaggtgcattgacagcccacccccctcttttcccaaattgaagtgtttgagattccaattatgtttcggtttgattaacataagatttagtcgttctttgaaactctattagaagatggggtcacgatggttctgagatcaagcaccctcatgctactaagcaacatcacctcacttttttctagaacactcaacatcacctcactgacagcaaagagcacaaaagagggcccctgttcgacatagacaaggattgtggtccccagatggagagtgtgccattgagcataagcaaacaaaagattttctgaaacctacacgtatgttaatttgttcagattcttcagaatttggttaggaaacttccccgtgaatccacaattcctcagagatctgcttagcaaaaacaaagcatgtacttagaacttgtatcaaccaacaacaatcaaaacaaatagtccaatgaaaagaaataaggagtgcgacagttgcaaacgtacaacgttgaaagatttacccaatctcctgtgaaattaaaaggatagccctcggtatcaaggtcaccaatcatgctgcaacagaaggtggttaatgtgattaataatgaaatcagattggtgtgaatttcaacaaatgataatttggttgtcctgactatgggacagataagaagattctctagatgataaggcctaagattaaatacagtattacatcaatatcttccagaatacctttacttgtagtatgacaacacgaaaactaaaagatatttcattgtaacaattgaaattagttatatacaactgcagaagtaagcattttaaaaatttatcagtccaaaaatgaaatttctttttgtcaatgtaaccgtgattatgattacatctacataactctttatatgccactgcaatattaaaaatacaattattcttttgaaactggaggtaattagtcaagtttaggacaagaaatcagtgagctttagatttagagttaactaatgaaaattatgatagcagataattgattattgggtttaaacttgtaggtctcaatacaatcatttggtaattgtacttctggaacagttaagtagtcatttggccttgccaaactgttatagtggcacatacaaatattttccacttttggaataggatcagcatagtctgctatctttggagagcaacacgaacatatccaatttctaccctttataacggtgtacgactgattgtgctgttaataaaacaaacaattaaagtggcttacagattttctatattgatcaatttagagaaattttctggaataggtccttgaagtttcatcccatacattctcctagcaagacaatcatattagttctcaggttggaaagaaaggagttacagaaaaatataaggacaagtagttatgcatacaaatctgtaagattggcaaagttcgcaataaatcctggaaccattccttcgatgtcattatcaaacatccacctgcatagaatgccaataagttaattagtaccccctccgtcccaaaatataagtattttggaccttgatacaatcttcgagatgctactttgactaacaatatctataaaagtaagatgttttaaataaaaaagagttgcatattatgatagtttgtttaatgataaatctaataacatcaattttacatgattgatcatttttatttttttgcttttaatagttaaagtaaaaaatatttgacttacactatgctaaaatgcttatattttgggacggagggagtattacctttttctgaacaaaatacaatgtaatctaattatttttcaaacaggccttgtttgtgatgttgatagtgaaaacaaataaaatgattcttttgtgaaaatggaaatgaaacacacttacagggattgtatacttaaaagtgcagatgcattaggaaaggactcattgagccggttattgttgaagtgcctgtagatttggaggtaaggtcttggtgtctttgccaacaaataatattgaaatagacaacttgagcacaaagaaaaatatgaggcacggagattcttcacatacaatgtaatacttacaatgtaaatatgaagtggataaaccattggatagtttctataattacagacaggtcctaaagtaacacagctagaaaccaaagtagtattgtaccaaaaagggctttgctatcagagacaggcgatgatgctatctcaaacttcaaaggagtatgtctggatatgaaataccttggatttttttctaattttagaacttaatatatttttttataaaaagttaacatcttatttaaaaacaaaccccttggccatgagatgtgtactgctgtggcaaaacagtgctgctacagtgctacaccacccaccatggtggcagcattgtcttgactcttgccatcctatgacattcctcctgattagcagttctttttcatgtgccaactgaagtagtctggagaaaggctccagatttggaaataagttgtgaatgagtttattttaattctttaaaaaaaggttcaaatattaaaaagaaataccttaggtacatgcagatagtttctcgttaagggaataagtattatataaatatgaaagtgtccaaggcattaggcaatactgggaagtcccatggcattcaacaagttggatgtaccattacaagaatgtaacgcaattaagttcttataaaattgatgaatgctgctgcaaaggaacaaaaagttgtttcataatcaccatgtttccagcttggatagattgctgacttggggaggtatttgaccaatcaggttgttattacttaaatccctacagaaagaaaagaggactagttacaatcaaaagttcccttatgtcactctacaagcatctagcagttatatctcaccatactactgcaaaggagtgtcactaaagatgtttgctaccttctaaagccagttggataatatgtaaaagaatggtaaattagttttggatcttagcagtttggttaaaatgttgcataattggatagcacaagtttttaaaaactttcattatattcaaactcacaatgtgagtacatttgacatgcacactggacaaacatcaatcctgtctccaaatcgctattcagtaggttggcaggatatatgcagtatgaaaataaaaaccctctaaatatatgaaagcagcgtcgtgtacatccttttggatgcagaggccgggttttaatccattttctaaaaaaaatgacctatgtataccgaactaccaacatagcatctgaaatgcaagtaaagagcatttgcagtgcagaatagattctcattctcctcagaaaatcatcaatttccaatgcatgtgcacagaacattagattttattccaagtatagggacatcatgcacttcatggcagctaattacaacacagtaacaacttgtcgcttgctacacaaacttgtgtgttgagagctatttgattgtgattattaatctgtaccattaaattataacatggcattacacctataacgggttgttctagtatcaagtgaatatggtacagatgaaagaagtgtctgaagtaagaaactagtgtacgtgaatagtaaggagtaagaagaatgcgtaatagattcttctcatagcaccatttattttactacctctgtttcaatttacttgtcgttctactagtttctcatagaacagcaagtaaattgatacggagggagtataccatacatgtatcgacaggtccacattaggcatggaaacgtcagttatacatattattattttaccccagtaaatactaacaagtaacagccttctgagtaatgattataacaactacaaagcgcatctctatcgaagaaatcatgaacctatcacaagttcacaacagatcaattgtagcatttcctaagataagcagttttacgatatcggataccgatgacaggactcacagagagaccagctccgtcaaactgaagagctccgctgggataaaggtgatgttcctgtagccggtgacgttcctgcatcatccagggtgagaacacccatcatttcatttccttcccccacaaagtgaggcgtcagaaaccaatcgaggatttgaggtgtgcacgcttacaggtgcgtaatgcggcactcgttgctgctgcaagagcagttgatggacgcttccatttccgacgaattagaccagacgagcttcccgcacgggtggtacccctgcggcatggtgccatcctccagtccccacttctcgaacaccgtgtgcagggcggccgctgcggggacgacagagagactcggtcaccacacacacacgcacacatccgcgacgacttcgagctagccaactcatcgcgattagggcatcacatgagcgagtgagaaaaatccgtaccatcagagatgttggtgctgtttctcggcggcgacgacggctggccggactgagcggcggcgatggcgagcgagacgagcaggatgaggagggcgaggggggcggcgggagaagccatgggcggggcggcgtcgggtggagattgacttggtgagggggaggaggaggtggagagtggagacttgaggggtttgggaggttgaccgcgcgtgggttcggcgagacgaggtcgtggggcttggtcgtcggagacggagagagcgggggctccgcgcggcggcgggagacgcggcgcggtggacattttttccagaattgcctcccaacttgtcaacatgagtccccttcgaacacagcaattccaaatgggtattttttaagtatgcaataagggtatgcgtttccaaaaaataataaaaataaaaatagtatgcaattcaaaaaaaaatgtatagacaataagagtgtgatatactccctccgtactcataaagaaagtcgtttaggacagcaacgcagtctccaaaacacaactttgacttcttgtttttataaaaatatttattttatatatatatacttatacttttatgaaagtatttttcaagacaaatctattcatataatttttatattttcaaactcaaaaacttgagagttattcatgatttatattactaaggtttgacttaaatattgtcctaaacgacttcctttataagtatggagggagtatactatacttccttcgttccaaaaaaaaaacaaatcttggctgtgtatatggacaaacatacatgttgtccaaatacataatcaatgtgtgttcatatacatagttaggatttgatttttttttttggatggggagagtacatatttctaacttctactcatctgttttctgtgcgcatacttttcaaactgctaagcaaaatgtttttctaaaattaaatatataagaaaagaatcatattaatccctaacacagcaaagtcagcaattccatatggagtttttagaatgaaatatgctagttcaaaatctttcgaatcaatggagtacaaattcttttgattcagagatgagaagcacaaaagtttcccggataaaatgtgaacagtatttgtgccaatttgtttgattgagtaaagcatacactcaaaggtgtgaagaagcactaggtaatttacggatgctttaagctttataatgttctcagtttgtttgcatgcatactgtaacaagaaggatatggtagcacatctgcacagcgaacaaaattgcttcagggaaagtaaggcactttgcttagaccaaatgttattacatttcacacatttggaccaactcaagcatacacatgttcaagcatacaatggcatagctatcctttatatatttcatattccaggagataccacaggagaatacagattattgtgtaactacagatatcttgtatgatggtttctatctcctcccagggaggatgtgattacagctgcttcttagccagatttctgctttgctcaatagaagggtgaactctttggtactggagtatggcccagacaaggtgcttgaaagagaactccggccaaagagggtctggattctgcaaatgactgaacgtcgtctgccacagaaggaaattgctcaggcgagtctcacctgaggtccggatcacaatgtcaggatcggggcaaccagcgctgtacatatggcggtccagatctgccactgaaatgtctgaatacacaccattattcgcaacactgtcagcatcctccctctgcagtatatccctcctttctgcacagaccttattgaccgcattgacaatctcagaagtggagttgtatggcatgcaaacagagaagaccagtcccgtgttttcagcagtggtagccatcagtttctcagctgctaccctcactgatttgctcaacatgtccaagttcccccagaagttgatcttacagttaaccttgttgatgacatttctgttttctagcagttcattgatcttttcctccattaactccatcaaggatttcacctcagtcggatctcgcttaaaattatcgatgctaaatgcatacaccgtgatatacttcacgcccatttcatagcagtagagcaggctggcaatgagagcagagaagcccaccctgtgaccagagccttcctggatactcctgaatttagcatatctacggttaccatccataataaatgcaatatgcttaggcattgggccatacgagaggacagctacaatgcatttgcggatgaaattctgcagactagcaagaacaccagtcgcaattaactcatcagtgttctccgtctttgaatcctaaaccaaaaaagtaaaactcaagtataagaatatcagcgaatgacacagctaagcacaaaggaaaagtcgcagctctttgattatctttacatgactaataatacctccacctggatacttgttctacataagagatttaactatatatcactgcatatgaatctaaaacataccactgaaggtgagtaagacataagtgagccaagcattttgatggggaggaaccaacaagcagtatcagacctgcaaactggaaaagaaataaaattttcagatttgcttgctcgggtcaagaaaaagaaggggcacgtgtttgccataagaacaggatacattaaaaggctatagattactatctattttaagcatgttttcctgtagggaatactaatttcagaagaatggataccaaaaatgattgatatttaatataagttctctggaaaatacatcaaactctttatatttagcaaagttttagcagggagtatttgatagttaaactgaaaggtatagcctttggatttaccatactatattttgattgacttcacttaaatttcctaacaaagtgagacaaagatgatggctagctatgcagatgttggggctccaatccacgtgtgtatatcgggaagatttcccatcaactgaagttatgatgatgtaatactcatgggataaaggcaaaaatagcatacttttccagagtttggaacacaagacaacaaataaagcacctgcacttctctttcattaacaagataagcacactttttagctatcgaaatccctatgcccttgtaggctaaagaaagctttcacaaaaagggaggaatttctagccagaagcttctaacaacgactagtaataacaagcacaagtgagcaatcaatccagcacaaataacagctggattagcatcaaccaaaccacagccacaccctcggatccgccccacaaaaaaagaaccaacctgagcacatgcacctcctcacaggtattccatcgaacacgtggtgagcaagcaaacgcgagtagcaaatcaagaaccccgaggaggagcaagcggagcgcacagagaatgagagagagagagatccacacctgcgtggctcaagaggcggcggcggctggtgtggtgagtagcagcggtagaggtaggagatcggggtggcgctgtttctttcttccccctttatagccgccgctccgcactcacgcagccaaacaccccagtccacccccagcgagcgcgacggaagaggaggactcggaggaggggggaaagggaaagaccgcgacgcgccgcgccacgaccacgaggcgcctcgcctcgcatccccgtcgcgaagattctctttgtttgggtcttgacgtctcctttttttatgtcgacttgtgtgcctcctggtggctgctggtggtggtggtgctcgccccgcgggcgcgccaccgccactccctcgcctcgcgcccgcgcccgcgcgcgcgccagtgaaaagtactagtaaaaaatactagtggcgaaacgggcggtgtcgcggagagccccccgcgggtgtggagcaggttgggtgggtgcgtctccgcgacggcggcgccaagcttggttcgttcgaccacctcgagctggatttcctttcaggaggcggcgggttgtccgccggctcgtcgtcggggcttggccgatgggagattgcgggggaagaaaggggaattgggccacctaaaactcagcttttccaaggggtgnnnnnnnnnnnnnnnnnnnnnnnnnnnnnnnnnnnnnnnnnnnnnnnnnnnnn

SEQ ID NO: 22734 - DNA, 3675 bp, Oryza sativa
taaaactttctatttgctgtcacgtcggatgtttggacgctaatttagagtattaaatatagactaataaaaaaactaattttataaatgagagctaatccgcgagacgaattttttaaacctaattaatctataattataaaaagtttattgtagcatcacattgtcaaatcatgacgtaattaggctcaaaagattcgtctcacgaattagttcaaggttatggtattggttttgtaattagtctatatttaatacttcaaattagtgtcaaaaatccgatgtgacagggacttggaataagtccccgttttccaaacagggcaagtcttgtcatcgagttataaaatcgtcctctaaccgtaaaaccagatatcggacgtctctcaactaacaagatcgttcacttgaggtccttcattagttttgactccggttttgcctaacgtagcggctgagtcagaatatgacccacgtgggccccatatgtcaggatgccaaatcagcatcctctctcttttcctctcttctctccctttcaggatgggaatggttaggatatggatcgaacctaaaccgttttaagtgagttcattgatccattgtttaatagggttaatctatcatgagtccactatatcaatggggtatccatggatatctaaatggatcatctacgttactatagagaaaaaaattcttattacatgtatgtaaaacttgggctcaaaatttttaaactcgcgttcacattataaaaacttatcaaatttaattgaattttgcagagatgatttattatatggagaagcaactttgtacaaattttaagccatctagacatgcgggacccacgatgcattactaagatttaaaaattctagttacatgtgtgtaaaactcggatccaaaattctagttacatggagcaggttgggtgcgtctccgcgacgccaccaagctgggttcattcgaccacctcgagctggatttccttttagggctccggaggaggaggaggcgggcggtggcaggttgtccgccgcaccggctcgtcgtcgagccgaggccaatgatcgattgcggggaagaaaggggatcgggccacctaaaactcaactttttacacagggatttgcaggcaaggagtacctatgcatctttcgaaagatttttatgattatatcacacagatttttattctttggattaaaagccaatagacacagtaaaagataaaaagtaactaagaaacatcataatggacactaaattaccatatcttcaaagaaaaagaccaaatccaatataaatttcaaaacttacatacgaagattcaaaaattacactgtaacttacaaaagttacaatgtaagtttcataaattatattataacatacaagaaaatacactataaatttgagtgagaaaatcgagggacagataagaaaaaaatctttcgagtgagatatagcaaaatcgttgcaggctcatctcatcgcagcccatgcccatctcattgcaggctctcacggcccaactgactcctaactaaaacaaaattatttgacatgtttaagtatacttaattagtttaaatacagatcatgctaagcgcgaggcccactttcacttgcgttagcgaagatttacagttgtttggcaacttcgagttaaagatttacagggtcttggtctcaacagctaatgatgaattgatgatatactatccatcactgttaactgttcagcattcataccggaggatgatgccatgaaaattaaggattactagtacgagtgtcatcctttcagtgcaacaaccaacagaccttccctgactgcacttgacaaacgggggccaatcaaccggctccaaacaagacccatgaatttactacagtatctgctgtccttctttcgcagtgacagaaataattgagagacactaattgctcatctccctccttaattaggattgtcccctgccaccacattcgtatatgtcagatgttctataccctgtcgtatgtacgtccgcctaaacaagggtccggctaaccttttaatttttcgttttcacttttgtttgtgcgccatgctctattgaaatttagcatatgttacggtcgtaaatatatggtgttcagattgtagctaaaataaaccttaccaaaataattttagcaggatttcttatgtatttatcaatttaacaacaagctaaacgtaactattcttttagcaactttaccatggttaaaaatgacaccgaagtaaacagcccctttatcatttgagacatcgatcagtgttttggagtttcttccttccaacattgcaatgtcttaacagatcagtggtgtactagtacaaaactccaagtcgcggtttacaacaaaagaaaaaaaatagacgtttaaccctttttctttaccacaaggaatactccatccatctcataataagtttattttgtaacggagtttataaaaatagagaataattgtatttggtgtagataaagtgctgaaacagttacattgggattttacaaagtagagatattctatttattttaattttgtattggtagatataaaacgagtgaaaaataaatttattttggaacgggtggtatcttgcaagcatcgggctgccggaaccaggccggcccgagctcagcgaggccgagaaagcaatcgaacacggccaatcctcccctttcccctcgcacaccacaccgcggcaccgcgcgcgtcaccggcctcgctcgcggcgcgtcacgctgctcgtgcgtgcggccaccactaccaccgccgcgatcgctttcgcgcgcacacacacgcaacgcaccaagagtccgagactgcgcgacagggcgagcgaggggggaaaatggcgtgatctgcagcaaaacgagaggggaaaacgcaggaaaacgagcgggcgacgcaggattctgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgacataacctaatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaatccatgtttcgacagttggcgcgccaggtaggggttgcgtcgagtttcctatcaacaagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcgtactgatttttaatcctagattaatctcttgctattttttgttgttgttcgcatataattacgcggcactat

SEQ ID NO: 22735 - DNA, 2445 bp, Oryza sativa
tccgcctacacggctggcaaattatgcagccgctgttgggcgtttacgacttcaccacgggcttgcctccgtcgccgcgaattggtcctcccgcctacacggtggcctattatgcccccctgtttggcgtctacgacttcaccaccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccatcagcttgccttcgccgctgccgactggtgtttccgcctgcacggctggcctttatgccgccgttgttgggcgtctacgtcttcaccgacgggcttgcctccgtcgcccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcgccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcttcgctttcaccgtcgaccgccttcgtcgccgccgactggtgtcttcattgttattgatggacgactttgttcccatattggccacttctgccatcaccaaggggaatattacaaagctaagtcatcatttattttattctttatatgatattttgccttttcctctgcctcactacaccaattggtcttccattgagtagtgagtcgggggctacagatgttatatcgtattttttaaacaattttcataatatttatcttgattgcttgcgacataatctgagtacaaaagtacctatcgagttatggagttctatcttcctatgctttctgttcggtttgccaatggatggttgcctttgggccgattcctagcacccgggggctcgttggatggaccgaataacgcaaggtgctaagtattattcagaataaatcaaaagcatagagataagataatttattttctgctcttaataattgcaaaagtacccgagtagtaaactccgatccgtgaaactttgttccattaatgacgaactcatgacactcatatgcatgtttgggaagtgcttaggccgactcccagtgcttggtggctatgactagtcgggcagagtgcttaaacgtaatgagtcatctgttcggggaaatcaaaattgacaagaggagaaatacatatttataaatattttaaactgcttgaatttttctcgagtattatatttatatcagatactactcatcctatatgtttgttctgcaggatccagatccagatatgcataaaagggattcatggctttaagcttatctcttacgctccaggaatggatcagtcagaacaccaccaccggctcgcctcgaccgccgccgactggtgttcccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgcattcgccgccgccgactggtgtttccgcctgcacggctggcctattatgccgccgttgttgggcgtctacgtcttcaccgaccggcttgccttcgccgccgccgactggtgtt

SEQ ID NO: 22736 - DNA, 6893 bp, Oryza sativa
tggtgtttccgccggcacgcctgccctttatgccaccgttgttgggcgtctacgtcttcaccgaccggcttgctttcgccgccgcggactggtgtttccgcctgcacggctggcctttatgcccccgtagttgggcgtctacgtcttcaccgaccggcttgccttcgtcgccgccgactggtgtcctcgcctgcacggctggcctgttatgccgccgttgttgggcgcctacgtcttcaccgaccggcttgcctttgtcgtccccgaccgatgtcctcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggtcaccgcatccgccgctgactggtgtcaccgcctgcacggctggcctgttataacgccaactgatgctatcttcttcacggctggctacatcgctgtcactactaataggcatcaatatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgcgtcttcactaccggttcacttcatcacggcaacacaactttgtcatcatggtggaccgacttcatctttattatcttcggaaccagcaaactctattgctgctacttaacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaataattattcgacgacaagatgctacagttctcgactctatgttcagttgtttcccaactaatcaaagagtcgggggctacacaaatacaaggctcaaaatttgacaaattttatataagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccgtggttatgcaacttcattacatttgattggtggcatctttactaccactgacatctttcgttacttctgatgagcaatttcgtcttcatgttggtcatttcatctccatgccgactgcatcagctaccatcaatggacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttatttttggagtatcccataagggataatcattcagatcagaagctattcatatgagctacacttggtctatattacccggaagatttattactcaggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagtacatctgttaaagcagtgtgcgcatggcgtatgcccaatactttggaaatttctttattcacaatatacaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagataattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaatgtttctatcttgtaatcctgccccccatcctatataaggtgggcaggaggccctctagggggcagatgacataacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaatccatgtttcgacagattcgtcgtcaacggcgcggcccgggccggggaacacctggggtacggcagtagtatagcatagcagcagtagtcaagcggtgttgggtgttggtgttgtacggcagcctgcaggggggccagagtggtgtggacgtgttgccagtgcgcgccatggttggtttgattttcgtttcttccagagggggggtggtggggttgagcgcaaccaacggtttttttctcttttctaaaaaggaagaaaacgattccgtccagcgattttgtgctccgctgcttttgggcgataattttgtgatctctgggtggttggtatgtcgaggttgtaacacgtttcttttcgtgtcgacactaaggccctccaagacgaaaaattttggcatgtcacatcatatatatggataaatattaagcgtagtctaataataaaataaattacatattccgcctataaattgcgagaccaatttattaagtctaattaatccgtcatagcaaatatttactgtagcatcacattgtcaaatcatgacgtaattaagcttaaaagattcgtctcgcaatttacacgcaatctacgtaattagttttttttcttgtctatatttaatattccatacatgtgtccaaacatccaatgtgatagggtaaaaaatttttgtttggaagtaaacaaggcctaagtgtccctttgatttggaggaaaaacgtaaaattttaaagtttttcaagcctataggaaaaatttatatgaattgattgaatcatatcatatcctttgaaattcgtatgggatagacaatcctacaaagattttggaggaaatttagcaaaagctcttacctcttggaaattttattttgagtctatctctcttatttgatttctatgtttttttacatgttttgcaattttgttttacacttaaattatatcaaaatcatatgtttaattctctgttttctcctatttatacttatgcatagggctgagctaaaatacatttgcaaattacatagtactagtatttttgtaagattagtattttaatagggattatggagtgactctaatccttacctatcctatgccgtctctgcccatggtttgatggacttaactgaaatggtggtagcaaatgtcagaagtagaagcacaaagcatattgggatgcctgttttaaacgtgggatttcttttctatttttttagttatttcatatgaaattctttgtaaactcgtgcactctaaatcgttttgtgagtcacatcacttctcaggcccgccaccttgttttaggtgattaccttaaaatgacaataaatctgtccatttcaactcgatttttttcaatatttctagttgacagacagtgaacccatttttggtaccagtcgagaaattgtggtggtgacaacattgccatatgaattatccagctcaaaaggaatttgaagtgtatacaataataacctgacaaaattattttgaggggatcaattccattgcctccttgagcaatctatgaccatgaattttcagttgcaaagttggtttatcagccacatgggatgggactgaaccctaaccataaactaggtggcaaacgcactgatgcagctgtctcctcctcctccactgtgtgaaccattttttatagtgcagcttttgagcctgaagagagagggcatcagcaagcaatcaagcactgaatcatcactgcacaacacaacaactctggctcacaaactctgaactttttaggttggataacgctgttggtttcagcgtttcagatgacaagaataacaaagaaatatctcctccaatttgcagtgaaaacgaacggcaagttgacagccacatcaagcaatgacactgcacatacatagaccactatgatcagtattgacaaccacagtatctacagaaaattttcaactttttttcgtcagagtgacacgctcttggttctttcttttcccttttgtttcacatcacaagagggaccaaatggaaagcaaaatcacaagatatcccaataggccatggttccgtgtgcaatctaccttgacctgttgatgcgcaagaaaatggcctcttaactgcagcatcaccagtgtctccccacatatattccaaagccaaatctattgcccagagaagggagaaaagaaaacagtaccaaccttgcataaaggttcaggaacccatgcacagatgtacatgtatgtactctctctgatctctgcttctgcaagaaatgcatgtccttttagtgcatatcatgtcaatcttctcaaaacattaagcgttaagcatcaatatctctttaaatatttagattggacacatgaaaaatttatgggtagattttatatcaccaaatgctactctttccatttcaaaatacttactttttaacatgttgtttaatgtgttgtataaatttctaaaaaagaattatagtcaaaattaagaatgtttggcttagcacaaaacaaatattttgaagaggagggagtaatacttttacgatatacattacaattttttccatgttatacatacatgttgcaataggaaaatggttagccaaagtttgtactccctccatcgcaaagtaatacccgattggacacattctattacgaatctggaccagtattaggagaaagtattattttgttaaccattattaaaaaaaatcagtctcccaaagctgccacctttgctggttttcttggtttgttcagtttgttgcttgtgtgtcccccagttgcatataaacatgggcatgtcacacctcacaacccccctttgctttggccattttctcaagcacctaatttgcttggatccttcttgcacttgcaacttgcaaaacaaccaaaggaaatactagtagcatcatcaagcgaagaaggtcagctcaaaagggcgttgtgtgcttcgcctcgcgaaatgagagtcgcattgctccggagatgatggtcgccggagtaatcaggagcaaccaggatggcggcggcggcggcgggacggtgtccggtgcggcgaggattagcccggcggtggtgttcgtcctggtgatattggctgtggtgctgttcgtgtccgggttgctgcatcttcttgtcagattcttgctcaggcgcggccgtgggcgagatggcggcggcggcggcgacgcggaggcggcggagggtgtggaggagtcggcgttgcaacggcagctgcagcagctgttccacctgcacgacgccgggctggaccaggacgtcatcgacgcgctcccggtgttcatgtaccgggaggtggtggtcggcg

SEQ ID NO: 22737 - DNA, 5506 bp, Oryza sativa
taccccgccgctctgttcgacgccgcgttcgacgagatggccgacgaggaggaccggaagcagcaggagtacgccgtgttccccgtccgcctcggcaagttcaagaacctctccagggcggtcggccccgtccacgaccgcgacgacgccgccgccgccgccgccggcgtcggcgtcggcggtggcattatcacgcgagaggaaggcgagtcgagcagcagcagcttggacgccaggcggtgcttctccatgggctcctaccagtacgtcctcgccgaggcgagcttgcaggtgtccgtacaccggaggcacggcgacggcaatggcagggcgaggctgagagggctcgccggcgccaacccggccggcaacgacgccgccgccgccgccgacgggaagaagatcggcgccggcagcaagggcgacagcttctcggtgtccaagatttggcagtggccgcggcaaggcaaggggaagctgccggtgctcgcctccgacgactcgccggcggtggacggccggctgccgtggccgaggagaagccccggggcttcctgatgctgatttccatggtgtgtttgcaatttgcaaaactttttcagagctaattctgctcatctttttaacaccgtattaatcaatctgttcatagccaattcgttccattctacttttgctgttcgattgcatcacctcgtgtgttcatgatgaacaaatagcttcatatagaggatttcttactctgcagaattagtattggtagttgcaatactaaacaaaagaggctaaatttatgaacaaaaatactagtttatttcctatgggctatggatatccaccatttgcaacgctggaataactgcactttgccctgaaagaaatgcctgtgggccaatcagccaatgtggtagagttgatcaaacatttaagtaagaacaagtacttgttttaatagtagattcttgttgtcttagcaagcaactgcttgtacactactctttgctttatcttcaagtactttgcaagttctccacaactcaagctatcgttagtttacacgcattgacgcataggattgttttctgacgattgaaaataaacggtttagcatttaggcttaatttaagcttcctttctataatacttgagcagttgagctgctgttgcagaatttcaggattgtatcaaactaatttttcttcgcagttttcctgccaagcaacaaccattagagtcatcttgtagttattaatttttgttttcaggatctcctgttgatgatgacaaagagagaaaggaaaaaggaaagaaacacacaagtcatgccagtttaagcctaccagtgttggcctcaagaaaaaaaaaatacagtactacagtactacttcctccatttccattaacatcaatttgaatgtgagaaatgatagaatgacttacattgtgaaacggagagagtacatgttagttagtgataaaaaaagaacaagttagttacagaaactttattaactgaagtaattttttttatcttagttccagtggagaacactttcaaacaaatcttgtattgaaaataaaaaaagcaaatgacttctaaaaaacctatacccaatgactacaatttcaaaaggttggcgaagaattatcaactaaaactgtgctttatgatgtggctttgggggagtaattaaattggcttccgggacaggtagggcggacgcatccgccaaactgaaggcagcatctgctatcgatcaaagattcaagcctgcattaaagctgcaagatacttacattaattaatcgtgttatatctcagccacgtctcgtcttattgcttggacgggagcgtttcgaaacggccgaaagcgatagacacaggctaagtactcgtgcactagtgctcgttcacttcggtacaagggagggtttatcgcctgcaaactgcagcatgtgaagagctggtcctgagtgagtgtggttatgtgtctttatccgatattaaatgaacattaattagctgtactaatcttgtgatagtgctcagggcgtgtgcgctctcaggtccaaaatgggagaaaaaagtttggcgggttccattgaaaacttgtaacgacgagtgtttgcaaagcatggcaatcttggtaagagagggcatattttggactaggggtggaaaaaaacgccgaagcttatgacaatgggtcggctcaaactatagtcgtaatgagtccagcagagctagttttcatttttcttgtaagctaaacaagcgactcatttaataactcgctagtataaaagatcactatatacttactagtattttaagttacatctaaagtatctggcatcaatatgttagtatacgataaatagacaaatttaaaattataaatgttgacataaacaagatagaacttactattaacgagccgagctaggtttttaagctcgtcagggttaacaagacaagccagccagggtcaacaagcatggctcatataacgaactcaaacaagccgagctacctcgttatctagtacctgttttggattaaagggcaaggtccccttcggaacataatttttataggattttgccagtaattatttcaaatcccgcaaaatccttcaaagatcctccgttccaaaggaggtttgaaattttgtgctgcgctgcttgctactgacttgtgagtggtgatgaccgaacagacacacagacactaatgcacacactagacgggcaccccatccatcaggcaaaacatggggcaaggcaaggtgtcaaatgacaataaaggaggctttctggaatctgaacagtcctgctattagtactggagcagtggaagcaactattcagggatggtgctgatgctgagacaccgatgaatgaatcatggataaggggatcagctttcacaggatgtacctcgatggccaggagactcgagtgctttaccaggtcatattttgtcgagcatctcctccgattcatgatgagtttgtctgtgacagttaacagggttatcattccacaatttcggcttgcattgcatctgggaagagatgacgggagtcctcattccagatattttatcaagaaattgcagcccgatagttgtgtaatgaaataatctgccaccggataaaacaataaaccaattctggatggttttcttttccttttgtgcagattataaagtctttccagccaaaaaaaatgtccagttgtccaaaatatgccagtggggttttaccatggaacaggtacgtaaacccaaaaaaacaaataattacattgaacaatatcatgatacaacacattcctttgctgcctgaaatgagggggaggctgaaaattttagttatcctcaagtgatatacagcaccatatgaatacattttgccaaaactgaagatgtagcattaattgctgccggctactatacaatatagaaaggaagaatgaatggccaaaaccagctaagtcgtgtacataactcactagaaggcaagcaaaaggggaagagcagaaaaaagtaaaaagaaaaactcgcctttgcttgcagcagttggaagagctatcacaacattatagacacaggtcaaactacaatccagcaggaaaattgttgatttgcccttgctccagcctgtcctcaccgttcactttgtaagttatccggatacgcatcgcaaggggtttctgtgcggtaaaattcagaaacggagattaggaatcacaagtctagaaagaatattgaaccttagtgatggactgtttgtgcaccaaatagttgtctatgtggaggatggtaggactgactacgggaagctttagtgatggatcataaaatcctaattctgctcgcctgatattgtatgatgcactaaaatatgcatagatgacgcaactaattccagatataacagcaacgaacaatgtatacttacggatcatactgaataaaagcatggaaacatgacaggtataataggcagctattcatggtggttgtgcgaatcagtaaaaacacacatcatcttctgttactcatgcatacagccagtgcacctaatagcaatactgtattttaaacctaattatttgatacgtgtaagatgaacctgtaattggtagatctccagaaatggagtttttacttggagagttgagatgtaattaagctcgaaatatcaatggcacaaaggcaaaaggcagcatataggtaggagttatgacaaaagcatgtaaccttggcacatggattaactcttgacttataatattccaacttaactactgagctaaaactgaatcgttatggttacatatgctctttcaagcttttaaagaagactattaaatcaaagaaaccagaaataggtcataatttgtttctgcggggcacaactcctttattacctgtccatgttggttatttgtgacactgaggctttgtgtaacagaatcatttccactggcaggaagcgtgttgctgctagcggggtccaaacgcaactggataaactgaaatccaaattcagcagaaatgaaatataagcctcgagtattttgtatgtttcacaactactaaagcaaactacaaactcatctgaatgatggaatttcaaggttaaagtgaatagcaaaaacaactaaaagtatcatgtcacccactcccttgaaatttacaaacgttttttatatattctaataacgatattaaaggaaaccaaaagaatacagatgtgcataacaggctatcagccatcacaatgatgcttgaaaatatagattaaagtattcttttaaaaattaaatggccagtacacagagtttcaaactgtcagaaaaaggaaaatgcaaataaataacctcctcaatagatggtttttggtatttcaagccaagtaatagttatacaaattttatacagaaattaaaacagataaataaatagttggttcttaagtcctaacttttttactaaaaattccatttctgaccagttaatatgagcatcagaggtgaccccaaaacaacagtttgaaggtaatacctttggtacagctgcctgaaagatgaaatccgtgaatgtattagatgtcaaatttgtaaagctagcatgaattgtagtctcctgaggttttccagactgcttcttaaaattgaaagtgatcttcaaagctgcactctggaaagctgtgattggcgggtaagctgtattctcatctggtgagcaagcaagcatagcaacagtaaatatcataatcatttgtagtgctccataatgttagataatagtaaggcagtaggatctgaccagaaagagatgtgcttgaggacaaaccatcaagaagatcctcaacttggggtgtaacaggtgcaactttagtctcagctgcatggtattaagataagtaagcttggatcagcaacatatgaaaaacatgcaaatattatcatcatgataacttttaccttgaccagg

SEQ ID NO: 22738 - DNA, 8573 bp, Oryza sativa
tatgtaggaaagcttcctcatcaaacaaatattactgacataaatgagtttcaaatgtgagaatatgagcatcactggcttcacttgtcaaaccaaatatgtactgaatgaacaaaaaagtaagatcaaaacctgctgtagatgtatcagtcaagcctatgcccaaaagatcctgtaggaaatcattaggtgctgtagtaggggcggaagtagtcgcaggagcatcgtcagaacttaaatcaagcaaatcagctagaggagccggtggtggctttgctacaccatttggaagcttaagcgagcttccaggagttgctgcagcagctaatttatctgatgaaatagttgcttgtgtggaagcagctctcttagccaagtaactagcttcatctatcacaggcatccgctcaagcaaagatgatctgttcatacaacagcatcctcaaggttaatctatcttacagaaacaaatatattagagaaagcacccacagcaatggcagaatctgtcacccactttatagactgatgcctctgtataatggagttgaattcaattgacctctgttgtagttcaagcacagtattccctttattctgtgcaactatttcctttatcctcctggcaataagataacagagtatggtgacaaaatgcaaaccatcttgagatagatatcacaaatcacgctacttatattaaaatatttgcaagaggatcaaaagaataccacacaaagactaacagaaacttcaaacaaagggttggtacattagctttgtttttccatcacaagcaaagttgtttggtgctaaaatcatatttgtatccatgtaaagaaaggtaaagtgaaatgaagagagatttgttaccaacaagtatggcaatcagctcgtgaacatttcaatgttattcagtatgttaattaacaagaaaccagttcataagaaactgagtgacctacaaaaatgtttgaaaacaaataaatatttccttcttcgtggcaagttttcattatataataagcacaggcagtttgtgctcatattaggacaaaatcagaatgggatgatcctgtggcaatagctgttctacctcagatcaatcaataacatgaaaccagaacgactgaaataattaagatagctatacaattcatttactactacaaggtcaagttaaatgataacttactctgaagtcggtgggaatcgggaagagagcttcaagagagatactagacacatagcccgagttgtcacgtctgcagagtatcgtttaagagagacctctacagcatccacggcatcagattctgttacctgaacaggttacacaaaaaaaccaagctgttttaaaatttttaaactggaaaagcaatggtactaaacgaaaaacatactgagaagcaccagcatacactggaaaagcattgaactaacaaactgacgaattctataaagcatttcgtggtgaaccatctacaaaagacatgtggataggtggaaatgatttatcatgtagcttttccttttgaccatcattacatatagcacttgtaattcggtaattccaagttgatcgttacaagaggtattatgagacacttttagtgtgtctaagagttatcacttatcagtcctaaaaataaactaagccaaattgaaagcatcacatgcctgaacaagaactgcagtaatgtttaattgcatcctgacttcttggcagaagcatgcagccaatgagaatggtggcaagaattgttaactcaccgtgattggttcctctatgtccagcataccaacattgttcaccagcatttcaccatactcaccaatgcaccatacagctaccctaaccaaactttcctaaataattcaatgtagaagagattcaggtatgtcagataagtagcaactcaatggtatagatcataaagaagactgactatttctccatacctgttcaccgcaagctagcaatgccttgtataatgatctcactgagtatccttggagttcagatgcattgcttattaagactattagagcatgccatacatcgtccttcacataatttccagcctgaggatgtacaaggtaacataattcaaacaaaatggatttttactgattgaacggtgcaagagaaaatatccccatagttgtgcttctgtacataccagagataaaaccttgaacatctggtctaagtaccaaagtttatcttgggaaaacctatttgaaatgctacattattattgtccataaatcaacaggagacagaaaggtataaatcaacaggagaaaaaaacaaaattgaacaaatataataaagggacaacacaggtaaatgtcgtaaaatgaaatacttgttttataggcttatagcctgttaactaaaccaatgcagaagatagtgtattatgttatgttgatctgacatgattattatcctcctgatagaactatgtgcaaatcctttgctatgtaaagaaaggttaggaatgatatgaaaaggaaggaactatgtattctcgttaaacaaattgtctacccttatttatatttccctttgctccacttggggtaggaaataatactgtaccgtatgtgaagtttcaccattaattgtataggatgagtatcctttttgattgtctgttacgtttcaaaatgcatgtaacaacaggatacaaaggacctttgaaacatttacagaatatgcaactaagagttcttacaaaactagtagagatgacatccacgaaaaattgaccctgaatcaagtcggtcagtaaaaaaaaagataaggagggggttatgctacgtcaagtcttacttttcaacaattgagcatatctttgctgtgaggtcgtccttgaagtcctgatcacttacttccaggtaatcaacaagctccttggtcaaagattttgcatttgcatcgttgacaagaaggtaaacaagttcaagggcccttttgcgaatagatacatcagcatcctggaaaaacatcagcagttacgaattattgaagtgtaaaagaaaaggaacaagaaatctggtaacaataaagtgaaagtgaatagtaggcacatcaacaacgcaaactgcagtagacataaaaactatggcaatgctgtttttttctttaaaatgatcatgcaatcatcatttactacgggatcaagcagaagaaattttccttaatgcactcggctaaacctgactagaaatgcaagaaaggaggatggtctgcacttgtcactagttatgattagctgtagtctcaagaagtgcggaaataaacagtatactttcaggaagctaccataggtgtgtctcagaattttacatacatgagcattattttacttccctagaggaatgagaataaatccagagcacattaactggagaatttaccttgacacactctaatattgttgctctatgcctctgcactgcttgcgtgtctacctccatggccttcataagcatgttcagagcaacatatctgaaagcacagtatgcacactgagaattatctctcatatggaagaatattttactagtcaaaacacctaaatcatacaaatgtgttattccctccatttcatattagaaggcattttaggtttgtcctaagtcaaacttcttgaagtctgaccaagtttataggaaaatgtagtaaaatctacaaaaccaaattagttccactaaatccaccattgaatatatttttgtagtatacttttttgggtacggaatgttgctacgttttcctatactagctgaatgcccatgcgttgcaacgggaattaaaagaagactttaaaacctcaaacattaaataaaatggtcccattgtaaatcattcacatcatatttttcatcattttgtatatcactttaaaataaattttccttgtgtgatggcttctggttggggaagggataaaagtccacctatctcactatttggggacccacaaggtagtggtggtaggtggtggcagattcaccactcaccaccacaattagggtcttttaaaggagtatagaaacttggtccaattcatagtacaacttactcctataatatgagggagtacaaaagtaatagtccaattcatagtcaatcataagcaccaagcagtagtaccttgaagtttggaacaatgctcagggtaagtaacccattgaattacaagaaaattaactagcaaacttttactttaaaccctttattcacaaaagttaagaggcttgaacatcagttgtccaagagaaaagagtgaattacctgatgttattatcacggttggacagaaatctacccaagatattgattgccagcacacgtaaaccactagtagcttcgatgcccattatagtctcaacacattcatataaaatagcatttcctgcgttcttatttgactcagtttttgttgcaacctggaaatgcaatgcaaataattcgatataagatacagagcacagctgcgggaaagaagacttcaacaaaaaacatggtttactaaaagaataattcaacaatgagaaaaacataatcatatcactgagttcttaatccaagagtaacaaactaacaatgctacaagacctaaataaatatctgggattagtaccactgaagacgctcatttcgatttacaatacattaataataatgcaatttgtgagggtgtaatgatcatgaactgtctacaaaatgatcagaacagatgtgatttgcatagtgaaatttctgttgtgtataaaataaaaacaaacaattcacctgagcaagaatatcattcacaaactcactgcaatctgcatctccttgacccaaaattcgcatgagcttaagcactctgatatgcaagaacggatccgtaattccagcaatgtcatattcaggagcatatgaactattggacacatctctcagtattctgaccaaaccatcaaggcagttctgtagaacgaaaattttatcagaagtactgccgcaaatgaatacattagtttgatatgatattgtaggtatcagcaaccaacaaagtgaacacactatgcgatagaacacaaaaaaatcctgcctctttcaatgaacatggtattgggtcaagtgtcacatacataaacaatgattaactattatactaatgcttttaaacgactctgtagtgtcaatggctcaatgcatcatcaaatgaattatgaggagcaggaattggggttgacagtttggaatatataggatgctaaataagcagggatttagccataggttattagtcccaagtcccaactgttaactagtctgatggatctgaaaattctatggtggtgattccaacctttagccggaataattcattattcagaagaaacgaataaaatcaccaaactctgcacttccagtattcggcaaacatcatctctagtcttcctatcaaccacgaccacaggaacttggggactgtactgcattcccagctttcccaccaaacatcataaaaccatcggacaaaggattttttgtacagttaaaagatatacagcaagtgtgtcaacgcctcaacagacacatcaccagaaaccctattatctactatttgtgcctacacatggatgtttggatgttcaaacatcataaataccacactgggaaagcaacaaatggttcaacaagactaaatcaacaatactcgtatgattttaacttgatacgttcaaaaaggtataagtttcaagtcagtaatttgggcatcggagacagtagagtggcagctggcagtaattagatatcaagaatctgatgattggtaagagcaaaaaaactgaaacaaataagacagtttggtattattccaagggctttactgaaagggtatgcgttaatatggaaagaggagatgaaaataagtaatttgttacatagtaactttgagaatgcaaacagaaggtaataggcagcattgtccaaggaaaaaatataacggttcctagaatgcatcgtaccttcctcaggtactccaatgcctctttgcttgctttacaaagttctgcgcagagctgaacagcagatatgagaaccccgtgatgtttttccttcagtagtgaaacagcagagcccatgaagttctctgccaaatctggaaccttccgtacgatccttatagagcataaggcagcctacaaaacagccaaacctgtacaattagtatgacaattcacctcaagtatttcagaaccaaaaacaacaaaggcaagacacctttgcagggtgaaacgacagggaaataaaaggctcgacatgtaataagctttgaataatgatggtatagacgacaacacccacaaaacaaagaatgattgtttgagttcaaattgacctttgctaacttacccagagcatatgctatgagctattaacctatcacattacattattacgatttacaagtactaataaacacagaacaagactcatggaatggacatactgacatcatgctaaaaacagacttcagtagaaactataacatcaagtctaaagtaaacatataccttcttcttggtatttggttccctactttgcaatagcctctccacctcaggtgacagatcacgcgccatttcagcggagcaaatgttgccaagagcacagagtgcaagccccacaatgaactggttcgagtggttaagatctctgtccgcgttaagtactaccaaatgctcaaagcagaacatagcattctaagaaaaatcaaaacagatatggagcataagtatagtatgggtggatactgcttgagcgagttggtgacgagcatgagcacctcctgccgctcgtcgagcagcagcatgaggccgaggtacccgatgcgcttctcggggaagcccgcggcggcgatgagcttgaggcactccatctggccgaagtgggtggggtacccgagcatgtggatgaacatgagcttggccatgttccggtggcggtagtcctggtccccctcgctgatggccgcccgtatcgccgcgcactcccgccgcaccaccgcccgctcctccgccgccgtcttgcacgcgcgtatcgcccgtatcatgtccctgcaccacaaccacgcgcgcggatctgaggaataggaggggatacgagaggagacgcgggtggtgatccatccgaggcgagggggagagggctaaccggaggcgggtgccggaggagaaggggttgatggcgaggtccatggcgaagtcctcgacgatcttctcgacggaatccagggtggggcgacgggggagggatctcgccgccgcggggcgtggggggcggcggcggcggcggcggcggccgggtggatctgggaggaggaggagtaggcggtggcgatggtggtggtggtggtggtggtgggaattgcgatttgcgaagaggcccctctcgctcgcgttggggttcgtttttttgaggattagttggggtgatttgggatctgatccccaccacgctgacctcactggctcactgacatgggtaattccaagtttccaacggtgtcgggaactcgggataatcaacgtggttcacttttcatctttagcattctttctagggactgtagcataagattttagtacccttcgattttatatgaaatcataggaaaattagggaattttaatcctaccgaaaaattcaaagcctttgaaaggattgaatcctatctactcgtgttgttttgaaattcctatggaacaagaaatcctataaaaaatttgaagaaaagttagcaagtggtccaactccttagaaaatttcccttgtgcatctctcattcgattcctacgttttttttcagcctaatcaaaataccatttatgtgtctttccagtgttccgtaatttttttttacacttccattcatttttttattccttcgttttttctaatcatatgcttcaaattagcaatcattcatgtattgtttccatgtgttttgcagtcatatttttcatacacttgcattcctatatttcttatccaattcccgcggtctactcaagcaaccatttatatatttttctcctcgattttgcaaacatatgttttatacttatattcctatcaacatcacgtacttctaattctctatgtttgtcagtcttgcgtttcaatggaatccttagtggtatatgaacttccttaggtgacattagatatatagtacttatactttgtattttgtatatcatgaacataattgcaacttgttttccacggataaaaatgcccaaactatatagaggtgacaatagtgtaagcacgaggcgtgcaatggatttatagtaagtggttgtgtcaatttcaattgaatatggcaatataccgtgttgtgtttgtgagagtgtatttggtaaaaaaaggtatgaaattcatcagtgtgttatcttttaagtcaaaagctttaatgacaaatgtttcatcatacacatatagttaaccttgtgggtatgaaatgctaaattacctaatgcactaaaataagatc

SEQ ID NO: 22739 - DNA, 6523 bp, Oryza sativa
  unsure (1)..(6523): unsure at all n locations
tatcatgaacgataattgcaacttgttttgcgcggagaaaaatgcccaaactatatagaggtgacaatagtgtaagcacgaggcgtgcaatggatttatagtaagtggttgtgtcaatttcaattgaatatggcaatataccgtgttgtgtttgtgagagtgtatttggtaaaaaaaggtatgaaattcatcagtgtgttatcttttaagtcaaaagctttaatgacaaatgtttcatcatacacatatagttaaccttgtgggtatgaaatgctaaattaactaatgcactaaaataagatcaataacaattcgtttggatttgtaaaattttgaccatcaattcaatattagagcaaccttatatagtgaacttatgatattattgataatatttttcaactcaaagctagacatcattttttcttattttaaaactaagcactcgagaagttaatgttggtcaaagctttaaaagtttaaccaaatattgttataaacatcaaataattaatgattgaacgaagtaactattataatctgtgaaatgttgccttgaaattttttgattttctgctatgagactaggcaatctacattttcagtcatttaaaccaagcaaaatcccctgatagattactttctgtatggtgcatacctagcattaatcaacaacttcatctccagggaattttggtgataggcatccatagctaaaataaatcttatagttgaagctagtataaagtatgatgttgtgtgggcccacattccatacttaaaagagacaaatgcttgaaccaatttgtttgtttacaaactccatgttatacatctacaggaaccgaacagcccacctctctaacaagcttgtagttacatagtagataagaccatagcttatgtatgtctcatagagtcatagagcgcaaggctaaccttaaaaggtctatagtttagtgatgatcaacatggaacatagccccctgttaaccttaaaaggtctatagataaaatgatagaaaaactaaacactaacgtcttcaaaaggagaattggcacttttgttttttatgaaagccaccctgttttcaaagtgatggcccctcctagttccctacttgagcctactacttattatgctggaataaaattgtatggtagctttgggtacttataattttataatcccatatttgatattgtaagccgttctagctatgtcccaagttaaagttagtttaacttaaacaaaacttatagaaaagtaattgatacacacaataccaaataaaatacaccagattacatgtttcaaggtggattttagagatactaatttaatgttgtagatgctagtatattatttctataatcttggtcaaagctagagatgttcgattcagcacaaaactaaaaacacctcataatagtatggaacagaaggtgtaatcttagcaactggtgaatgtattctgccaatgaattccttttcatatatttttttatgttgtcataggataaaactagaaaagtatattttcatcattccacaggaaaaagagaaaaaaaaagaagaaataaaactgaaagaggccgccaagcccattatctgctggacgacaaccaactcgacagataaaaatcaggcccagtaacctgacgcaacccggcccggcccatgaacccaccaaggtcggctccaatcctcgcgcgtcgccgccatagcctgcagccgagccccacctataaaaatcgcccgagccacccgatcccatcggcttcctccctctcccccttctttttttttcccctcccatttttttttttaatctcgacacctctaaaaccctcgcggcagcagcggccgacgggcctgcccgctttccccgtcgccgccgacgatgtggagcggcgggccgccgccgccgacgatgtggagcggggggccgccgcccgctccggcgatgggggccgggccgccgccaccgggcacgggcgctccgcctacgccgacgncggcgggcgggggcccgcccggtggcgttggcggcggcaagcccgtgacgccggcggagctcgaggcgcagctggtggagaaggcgaggaagtggcaccagctgaactccaagcggtacggcgacaagcgcaagttcggcttcgttgaggcgcagaaggaggacatgccacccgagcacgtccgcaaaatcatcaggtaaagtctccagatccgcgccgagttgttgcctgtggatgtgttttggtgttgtggtgctttgtgctgtagttgtttgtagcttaggacctagggggatgattgtggttgccctctcgattgaggctattttcgttactagtgtatgatttgatacgatgtttgaaatttatggctgtaactgtgttaagtatttaggcatggacttagctgtgatctgctgctttaccttatcatcatgttactgttgatatcagctgcttatgttctattgttactggagtatgaagagagtgaaaaaaaatcagcctgatcggtgcagccgctgctctctcgctagtagcaacgagcagctgcagtcagcagttccgttcacgtcctattaaactgctttcttacaacatttggaatgggatattggaagtcaagttttgatagttatgggaatgttatggtttttctaattaacccaactcaattatgattgtagatattgtgtaatctagttatggtggtgatttttttgatttgctaattgtcttggctgttaagatgaatctctttatggttggggtttgtgccatttgtgcctgatcctcagttattaggaatggtggcaagtgacatgttctgcttgaatttgctgtcatatatcccatcttcaccatcaactactgtagttcatgtgtatgttgcggacaatttatttatgattctatttattgctgatcagggaccatggtgacatgtcttcaaagaagtacaggcatgataagcgtgtatatcttggagcactcaaatttgtgcctcatgctgtttacaagctattggaaaatatgccaatgccctgggaacaggtatatttattgtgacactctttgatgtgaacattgatctagccaagtagctattggtgagattacttatacaatggcaatacagaatagaatgacggaactcttgttttcaggttcggcatgtaaagatcctttaccatatcactggtgcaataacctttgtaaatgagatcccatgggtagttgagcccatttaccttgcacaggtactgatctaaaacaccttatcttttttttttcttctttgccctgttctgggaacaatagctactgtacggatctgtcataattgataggcattatataacttaatctgatctttagctttgtacttcttatttttgtacttaaaccatctcaaacatgtgtgttccacagtggggcacgatgtggatcatgatgaggagggagaagagagataggcgacatttcaagagaatgcgctttcctccatttgatgatgaggaacctccattagactatgctgataatttgctggatgttgaaccactggaggctatacagttggagttggacgaggaggaagattcagctgtgcatgaatggttttatgatcataagccgcttgtgaagactaagcttataaatggccccagctaccggaaatggcatctatcgcttcccataatggcgacactctatcgtcttgctggccaacttttgtcggatttgattgatcgaaattatttctatttgtttgatatggagtctttctttaccgccaaagcactcaacatgtgtatcccaggtaaccttattgtgttcccttttataacttctaagttttttttactttaattcctttaattgtcatacatgattagcatagttgtagcattgatcttatggttatatcaaaatttataccacttggtatctgactgctggcaaaatgttgtggaaatttagcttgtgctaagaaatgggtttataccaaaacatttttttttttgcatttacgtgattttagtgcattaattgttactcaatatttgaagcatggaggaggtagtttatgtccatagctgttcatttttatggaacatctgtaactgtaacatggggatttatggtaatgaagtagttaatggctttattaattagatgatgcatgttgtatgggcgacagtgtgagaaggaattaagttttcctgcatacatatgtctgtgagcttggggctttgaaaattagcaagcaggttgggatgtaaaatctgccttctctactgttctattcaccccttctcctgtaagcacgaatttcctttttctttttttgcaactagctttatatatgcttccatatgagaatcttgcagttgattaatatttacactgaaacattttcaaaactgttgaatgggcatccaatggtagacataatttgttacattggaatgttttatgttattttttagctttgtacaaagattgtgacatgtaccttttgctgttgctgcatcataagctcttttaccatattaaatgctatgttgcaggaggtccgaagtttgagccattgtaccgtgatatggagaagggggatgaggactggaatgagtttaatgacatcaacaaactcatcatccgccaaccacttaggactgagtacagaattgcttttccacacttgtacaataacaggccaaggaaagtgaggcttggggtatatcatactccaatgataatgtatatcaaaacagaggatccagacttgcctgcattttactatgatcctttgataaatcctataacttcgactaacaaggttgatcgtcgggagaggagaacaactgaagaggatgaagatgaggacttccgtctcccggatggtgtggagcccctcttgaaaggaacagaactttacactgatacaacagcagctggcatttcattactctttgctccaaagccttttaatatgagatctggtagaacacgtcgtgctgaagatatccctcttgtatctgaatggtacaaggagcactggtgagtgccattatgacatcctttataccttttcatgatccccttttgccaatgttctgcctgatgcacttgaactttcaaagctaatcacatcaatctctcgtttgcagcccaccagcttatccagtgaaggtgcgtgtcagctatcagaagctactgaagtgttatgtgctcaatgaactacatcataggcctcccaaggcacagaagaagaagcacctgttccgttcactccaagctacaaagttttttcaaacaacagagcttgactgggcagaagcaggtttgcaagtttgcaaacagggttacaatatgttgaacttgttgatccacagaaagaaccttaactaccttcacttggactacaacttcaatttgaaacctgtgaagacactcacaacgaaggaaaggaaaaaatctcggtttggaaatgcatttcatttatgccgtgagatattacgacttactaagttagttgttgatgcaaacatccagttccgcttgggaaatgttgacgctttccagttagcagatggcttgcaatacatattctctcatgttggccagctgactggtatgtaccgctacaagtatcgtctgatgcggcaaatcaggatgtgcaaagatctgaagcacttgatatactacaggttcaacactggtcctgtaggaaaaggacctggctgtggattttgggctccaatgtggagggtgtggctgtttttcctgcggggtattgtgccactgcttgaaagatggttaggtaatttactggccaggcagtttgaaggtcgtcattcaaaaggagttgctaaaactgtaaccaaacaacgtgttgagtctcacttcgatcttgaacttcgagctgctgttatgcatgatgtccttgatgctatgcctgagggtatcaagcaaaacaaggcacggactatactgcagcatcttagtgaggcatggcggtgctggaaggcaaatatcccatggaaggtcccgggcctacctgttcctattgagaacatgatacttcgttatgtaaagtccaaggctgattggtggaccaatgttgctcactacaatcgtgagcgtatcaggcgtggtgctacggttgacaagactgtgtgccgtaagaatcttggaagattaactcgtttgtggctgaaggcagaacaggagaggcagcacaactatttgaaagatgggccatatgttacacctgaagaggcagttgctatttacacaacaacagttcattggcttgaatcaaggaagttctcgcctattccttttcctccactttcttacaagcatgacaccaaacttcttatactagctctggaaaggctaaaggagtcttacagcgtggctgtaaggttaaatcaactgcagcgggaggaacttggcttgattgagcaagcatatgataatcctcatgaggcgcttt

SEQ ID NO: 22740 - DNA, 1069 bp, Oryza sativa
  unsure (1)..(1069): unsure at all n locations
caggatgtatgggacactagtgacggacagtgtgttgtgatcctccagacaaaatttgagaagttcttcgaaaaaattgatctgacactgttgaacaggcttctgcggttggtcttggaccataatattgctgattatgtcactgcaaagaacaatgttgtgttgtcttacaaggatatgagtcatactaattcttatggtctcattcggggtctacagtttgcatcatttgttgtgcaatactatggtcttgtgctggatctccttctgctcggtttaacacgtgcaagtgagatcgctgggccacctacaatgcctaatgagttcctcacatatgctgataccaaagttgagacaaggcatcctatccggttgtactctcggtatattgataaggtgcatataatgttccgctttactcatgaggaagcacgtgatttaattcagcgttatttgacagagcatcctgatcctaataatgagaacatggtcggttacaacaacaagaaatgttggcctagagacgcaagaatgaggctcatgaannnnnnnnnnnnnnnnnnnnnnnnnnnnnnnnnnnnnnnnnnnnnttttgggacatgaagaccgccttccaaggagcatcacaacgttagagtgggagaacagctttgtctctgtttacagcaaggacaaccctaatctgctgtttagcatgtgtgggtttgaggttcgtatactaccaaaaatacggatgactcaagaagcgtttagtaacaccaaagatggagtctggaacttgcagaatgaacagacaaaagaaaggccagctattgcctttctaagagttgatgatgagcatatgacagtgtttgagaaccgtgtcaggcaaatccttatgtcctcagggtcaactacattcactaagattgttaacaagtggaatactgctcttattggtcttatgacatatttccgtgaagcaactgttcatacccaggagctcttggatttacttgtcaaatgtgaaaacaagattnnnnnnnnnnnnnnnnnnnnnnnnnnnnnnnnnnnnnnnnnnnnnnnnnnn

SEQ ID NO: 22741 - DNA, 805 bp, Oryza sativa
ttcttgtaacgtcgccgctgcaatctgtgttcttggttttgcttgctgattttgaggattctcggcgcgggagcggaggaatcggtggcgggagagagaaattggtgcagcgggaatgggttttgggagggcgaatcggggatttcgcgctacggtttcggcgctagggcatgccagggcgaggctacgccgcccacagcgcgcgcgacccgggtcttctccacgctgcgtgccctcgatttcgcgaggttttgcgttgctcacctaggagacgaggaacctagtttaggcgcgggtccaagcgacacggcggcaaaattccgacgtggcacgactaaggcgcggtccagctagacgcactgtgagaggccttaccagtaatgtttggactgcaatttgtgcagcaaagttgccaatcgatattataagttcaatattgcctagatctttgcacagtagagtttttactatgttctggattatttcaaacatttatttgcaatttgcgatctaatcaacctgatactttctaggttataagccaaaacccagagctaagaaggaacgaacagaggaggaaaagaagttcaggcgaaaagcaaagtatttccttgcgacacagctcgttgcggttcttctattcctatcgctcatgggtggagccgatagctcagagctagacgatgaggacggtgtagattatgaagattaaatcctccctttgttgtactgcacgattctttctgaagtgttaatttgccaaagcaccggttgtggtgcttgaaaatgttcttcccatggttag

SEQ ID NO: 22742 - DNA, 877 bp, Oryza sativa
  unsure (1)..(877): unsure at all n locations
tggcctattatgccgccgttgttgggcgtctgcgtttttccccgccgggcttgctttcgcccccgccgtctggtgtttccgcctgccggcctggcctattatccccccgttgtggggcgtctaggtcttcaccgaccgggtttgctttggcttgcctttccgctgcggctggtgtttccgcctgcacggctggcctattatgccgccgttgttgggcgtctacgtcttcactgaccggcttgccttcgccgccgccgactggtgtttccgcctgcacggctggcctattatgccgccgttgttgggcgtctacgtcttcaccgaccggcttgcctttgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttctccgccgccgactggtgtttccgcctgcacggctggcctttatgccgccgttgttgggcgtctacgtcttcaccgaccggcttgcctttgccgccgccgactggtgtttccgcctgcacggctggcctttatgccgccgttgttgggcgtctacgtcttcaccgaccggcttgccttcgtcgccgccgactggtgtcctcgcctgcacggctggcctttatgccgccggttgttgggcgcctacgtctttcaccgaccggccttgcctttgtcgttcgccgaccacttgtccttcgcctgcacggctggcctttatgccgccgttgntgggcgtttacgtcttcaccgaccggcttgccttc

SEQ ID NO: 22743 - DNA, 501 bp, Oryza sativa
  unsure (1)..(501): unsure at all n locations
nnnnnnnnnnnnnnnnnnnnnnnnnnnnnnnnnnnnnnnnnnnnnnnnnnnnnntggcatctattgctttaccacgttttgtaagggaaaaggtatatcttgttagtgctttggctgatttcaaccctaaatgttgtatgtttacatgtctgatcataagattctgttgcagggtgtccccatagagtcccatccatctaaacttgtcgggagcagtgattctaaaaatagatattttgactttgacaagcttgctgaggtctgctgtctgatcgaatctgtttattctaaaaatagatactcttgcctatgtcagtgaatgttctgacacgctgttgattttaccaggttacttcaactgtcacatacaatctcaacaaaataattgatattaattattaccctgttgaaaccgcaaaaagatcaaatatgcggcacaggccaattggcattggtgttcaagggttggcaggggtaccgagctcgaattcgccctatagt

SEQ ID NO: 22744 - DNA, 784 bp, Oryza sativa
tttggtttcctttaatatcgttattagaatatataaaaaacgtttgtaaatttcaagggagtgggtgacatgatacttttagttgtttttgctattcactttaaccttgaaattccatcattcagatgagtttgtagtttgctttagtagttgtgaaacatacaaaatactcgaggcttatatttcatttctgctgaatttggatttcagtttatccagttgcgtttggaccccgctagcagcaacacgcttcctgccagtggaaatgattctgttacacaaagcctcagtgtcacaaataaccaacatggacaggtaataaaggagttgtgccccgcagaaacaaattatgacctatttctggtttctttgatttaatagtcttctttaaaagcttgaaagagcatatgtaaccataacgattcagttttagctcagtagttaagttggaatattataagtcaagagttaatccatgtgccaaggttacatgcttttgtcataactcctacctatatgctgccttttgcctttgtgccattgatatttcgagcttaattacatctcaactctccaagtaaaaactccatttctggagatctaccaattacaggttcatcttacacgtatcaaataattaggtttaaaatacagtattgctattaggtgcactggctgtatgcatgagtaacagaagatgatgggtggttttactgattcgcacaaccaccatgaatagctgcctattatacctggcatgtttccatgcttttattcagtatga

SEQ ID NO: 22745 - DNA, 400 bp, Oryza sativa
ggtaatgatgattagcgccaccagagatagccgcctatgatgacgaagtttcccatcacggccagcagagtgggctatgttaatgaggcttgacaagatgttaataaagatgacgatgtcggtgatccagtcaatagcgatgtagcagccgatgataccgatgagatcctctatcgccagttgcgtagtaggccacccgtgaagccaaataattggaggagagttgatgttgttgccccactcgtctaaaccgaaatatttgaagttgttgaagtagaatgtcgttccgaagcaaagatgaagataatgactcctggagttgactcattggcttatataaaatttgtcaaattttgagccttgtatttgtgtagcccccgactctttgattagttgggaa

SEQ ID NO: 22746 - DNA, 591 bp, Oryza sativa
actgcttgttggttcctccccatcaaaatgcttggctcacttatgtcttactcaccttcagtggtatgttttagattcatatgcagtgatatatagttaaatctcttatgtagaacaagtatccaggtggaggtattattagtcatgtaaagataatcaaagagctgcgacttttcctttgtgcttagctgtgtcattcgctgatattcttatacttgagttttacttttttggtttaggattcaaagacggagaacactgatgagttaattgcgactggtgttcttgctagtctgcagaatttcatccgcaaatgcattgtagctgtcctctcgtatggcccaatgcctaagcatattgcatttattatggatggtaaccgtagatatgctaaattcaggagtatccaggaaggctctggtcacagggtgggcttctctgctctcattgccagcctgctctactgctatgaaatgggcgtgaagtatatcacggtgtatgcatttagcatcgataattataagcgagattcgactgaggggaaatccttgatggagttaatggaagaaaagatcaatgaactgctagaaa

SEQ ID NO: 22747 - DNA, 726 bp, Oryza sativa
  unsure (1)..(726): unsure at all n locations
nnnnnnnnnnnnnnnnnnnnnnnnnnnnnnnnnnnnnatatctctggattaacaacaaaaatgtttctagattcaagaacaggagagaaacttcaaaaaggttaggcactggtgctgaatgattgtagtaggggagcagagaggcatcatcatgtgatggacctcacgcagcactatctccagcacttggcagtcatgctcgggagagtcttgatctctgaatgtcaatctccagatttcattttgcattttttttaaatggaatttgagcgattttcctaacagaatttatttcactactccagatttcaatatgcaaaaagattatagtaaatatttgttccaaacaggctaacaaaaatttttggacattagaaagcgtggatttttagcacagttcttctctcccccatatatgctgatcccacataatctgatgttgcaatagtgcacttcatgttatgcaaagcagccacaaaagggtaatcatttgttaaccattcttgtgccagctttctatacacatcacaaaagagaacaaaggaagaagcactctgattctttgatttcattcagctccaaaagaataaaaagagcagaatactttgactttgcttgatttaatgcatatctgttcaccatgcaagggtggctttttcatgaaggcattctagtatgggtttctaaattaaaaggaccaacttgaactgtttacacaggaccagg

SEQ ID NO: 22748 - DNA, 432 bp, Oryza sativa
gatttgtgattttgaggtcgcatcgcgtcgccatggacccgtgcccgttcgtgcgggtgctggttggcaacctggcgctgagaatgccggtggcgccgccggcggcgggtgcgggggcgggggtccacccgtcgaccgcgccgtgctactgcaagatccggctcgggaggatgccgtggcaggtcgccgcggcgccgctggtggttgccgatggtggggagcaggcgccgtcgggggcgctggccgccgcgttccatctgtccaaggcggatttggagtggttcgcgcggaagccgtcgctgatggtctcgtcgtcgtcgtcgtctcgcgggccggcgacgctgaaggtggccgtgtacgccgggaggaaggggacgacgtgcggtgttagctctgggccgttgattgggaaggctaccattccggtggatc

SEQ ID NO: 22749 - DNA, 1096 bp, Oryza sativa
  unsure (1)..(1096): unsure at all n locations
nnnnnnnnnnnnnnnnnnnnnnnnnnnnnnnnnnnnnnnnnatgacgactttcagaactcatttctgggattcgaaattcatataattagcatgggtgttgtaatcttctttttttggtacaaatgtttaagagttgcatgcaacatatgtcatgaacaacaatggtagttatgacaatatgaccttaaattcaatcagattttagactagtcttatgccttccacctatgattatcgtacagcagagtatagaatagtttgttatttttgtataggaagctatacaaagctcaaagttgcatgtaacagatgccatgaacatcccagtgaattagggcatgataaacctgaaatccacattggaactatatattggtagaatacttgagcattactatcgagtgagtacttccgtttcgtattctgtatttgtttcgagttactgtgttgctttcaaattctcacaccatacaactcttccatgcaggacccgatggcctatttgagaacaagcaccattaagtactgaacagcgcaccatcagaagcccagtgaatgcttaagaaaaattctctggttgttccagtgattcttgttttcagtgaaacctatttttcttgcaacaaagaaataagaatgacaaaactcttgtgttgataatcaggatttaactgtgttgttagttgttacctgttttcttcattcacagcagtgatcatatgcatgtgttctgtttcagaaaatgctgtcatcatcacaacaagctttgttattataatcttcctacgccatttctgtgctcttgctctttatgggatgaaacctgttccgaaaattgatgcttatttatgcttatgaattttcacggttcagtcgctgtcaaagctggatgtacttctttgcttgatcaacagattgcatagttgggaaatgttgagaaattgttaccggaagctattgctacaggaaaataaaaaagaagttactggaaaataacatgagcatcgcttaaaaagattgcctagatggatacacggctttatagtaacaagcannnnnnnnnnnnnnnnnnnnnnnnnnnnnnnnnnnnnnnnn

SEQ ID NO: 22750 - DNA, 2038 bp, Oryza sativa
  unsure (1)..(2038): unsure at all n locations
gccaagtgagcaaaagagattgtttaacagaacgcataaaacgcaacaataactacccttaatcagcatgagaatcatcaagccttcaagttaaacatgcattgctttacataagtaaagctgattaccttaagctttacaagttgtttctctaacattccaaacaaaccaatacattgcattaggccttgttcggtttggatgggattgacgaggattggaggggattgagggggaataattccacaccacaataagtgtggaaaaaatcccctccaatccctccctcatggggattaaccaaacaaggccttagttggtagcaataacattgcataccaagctgagtgcaggaattctacagttttcagttttttttggcaatctttggcaaatttttcagtacgcaactagtgcacatatgcagaccccgacaccccgtaaagtttatattcatatattcaactgtgaaatatcaacaatcaagatatgacacccgtccaaaaatttcctaggcctattatgtgcactaagtatgtataagtttgaacagacaataagtaaatctaatggaccataataggttcagaaagggatccaattgatatacagttcaaagttcaaacactatggattcttacttacgaactcaaggtttcaaagttcacaagaaggcttcaaccctcaaattccagttctgccaaaaaaaacctctacttggtggtaatgtttcctggaaagtgatttggcatttttaaaggtagttttagtctgtccaatttaaagaaaaaaaaattgatcgattattgttaaggacaaccagtatgtagttgattactatcttaaatttggtagcaagtctgcaatggccaacctaaaattctaactttctaagtatttacaaagtagcagtctaaataattcaatcaactgaactgagtattgcacacagaagttctttttgatatgaggaacattgcagcaaagttaagttacatgagtgaattcagtattatctaaacataaagaagaatcaccaatccagctattattcatggaaactgggaagactgcatttcctttaggattggctaatttcctacacttagttatacctataatatctacttcttctagggctaactaggtataacttcaactcacttatttaccgtgcaaaagaaaatgtaacttacagcttcacatagtttacaggcgatgcaacgctcttctccagttggatagcgtctgagagcatgctctcctcggaagcgagggctcaaaggacccttctcaaatggatagttgatctgtaaggaggtaggataagaaggtaaatacaagcatgcaattacattataaaggaaacagtatgccaaattcaccacttaactgtaacattcttctcgaagaagtacttgagtgtcagcatcaaaccgcggaccatttcagtcaaaaacaatgtgttgatgctcctttcaaatactgaagcaagaaagttcaaaataagcattaaagggaatagtggatcacaaacttttccgatgcatagataaagagtatcattagaaattcaccagcattccaatctttcgctatctcctttgcaagcttctctttctcctcatcctctggtaattaggaagaaaaagtataagaaaaaaatagcgacatcacaccaattagaatggaacttcatgagttgttggctaggaagttctgcagactataataaaattactacacgcaggcaaggcgtgtttcatcatattggtttccagacataactacactgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22751 - DNA, 712 bp, Oryza sativa
  unsure (1)..(712): unsure at all n locations
nnnnnnnnnnnnnnnnnnnnnnnnnnnnnnnnnnnnnnnnntaactcttgatgagaacttcctttttagaagtcatttgacaagaattcatgtaaggagaaacacttacaaatgaatatgtgtccccttatacatactcaaacccaaaaaaaaaacactgccgccatattttgttaacaaaatccagtacattaccttcagttcaataactaaacttaggttaaagtgttaacttcataaagaagttattgcttttgtcttagtactttttagtgctaaaggcacccttaagttagcaccgttcaggtgatcataaaatcaagtttcttttaaaaggaatatgccatgatggactcaattttcagagcaattggtaagatcataagaacagttgtacccatgctaaactcatgcataaaaatgaggagacgataaaatataaaagtcttacttcgatgatctcaacatcctggagaagaaactcctgcttccctcactttgttgagtgcatacatcactcaaacttccaagacacacttcaaatttgtcatcaagaagcacactgcttgcctggatatctctacagttataatgaaaagataaggggaaaaaagattggcttgaaagtattaaaacatccaagaacttggacagcatgcatcaaataagaactgccgagtaaactaaaatgaaatagaaagatgaggcgcct

SEQ ID NO: 22752 - DNA, 1028 bp, Oryza sativa
  unsure (1)..(1028): unsure at all n locations
nnnnnnnnnnnnnnnnnnnnnnnnnnnnnnnnnnnnnnctctgactagaaatggctggtactggttcctattgtcttgatgttttatcctgcactggcagatccaggcacaaatcgtatgaatgaagcagatcaacaagcacctgcaaagctgaaattgcagttatttccaatcaatgaagccacacgaaaggcattggaaaaggtaaatatgcctgtttgttgccaccaagctgcaatatgaaattatgaatcatgtgtttcctgcagcagctgtgttagcacaacagctattactgatttactattggctcggacactcaaatcactgtggttgataaaatttctcaggataaatgggactaatggaatgtggagtgcaaataaccttactagcactatttaccttatgaattttcgatggtgtttgagatattgatagtcctatcttttttcaacaggatgaacataatccacatctggaactcacagttagcgctaggaaaaaaatatcttctgtactagaacatcttaaccgcaagtggggcagctcaaacattgcgtctggagagcttttgctttttccatattgtgctcaccgagaagatttagctacctatcagagatggaccacaagagatacagttgtggtggctgatgtttttctttctgtgaatagcccgcctgtttttcgattaaggtatggatgaattcctgggtaacaaactataatattgtgataagaccatttgttgaaagccgtaacaagtgctaactgttgtcgccaataaggtatggttggttttcccttgctgagcttgaaggaggaagtggaatatcttcaactcattttaagaattgcatgatgcctgaagacatccatgccaaatctccctcagacgcttgtgtgcagaaggatggtacttttctcaatagttgtgctcctgaggaacacctttgtaattcaaaagatcggccggcattatttcttgctatgacatttagtacaggcaagagcgctaaggggca

SEQ ID NO: 22753 - DNA, 828 bp, Oryza sativa
aaaccttatacaatggttggaaccatagtgatcctggtcttatggttctgagctttcgcacaatctttgatctggtaaagaaggatgacagtaaagatacgtttgaggtctcatgttcatatcttgaagtgtacaatgaggtaatgtgcaatatatagtttcttaaaaaagttaactattagtccttaaattctctatactacatataaactttcgtgaaaaaactctgtgctttctgaattccaggttatctatgatttgcttgaaaaatcgtcaggtcacctggagcttcgtgaagatcctgtgcatggtataatggttgctggtttaagaagcattaaggtttctagcttcctctaatctgtttaatttttgtgataattagaaaacaaatgccttgtagtaatagtgtcaattctggcattttttgttttgttttcttcatatttttttggccatcctaatgcttgtaacctcttttgtgcatataatatcctctcgtcattgagccaattaaggaagagatgatttttaagttgcactatttaatttatctgcatggttttttttttgtcctttctggaagaaatacttgtagataccaaccctttcagacttcttcagctatttattcatcttttttcttttaatgattagttcatacaaccaatttctgccctttgtaacaacagcaagtggtctactgtgtttgcatgccattcctcatcatattcgtaaaaataggcctagtcaacattccattcacctctacatataagaatattttgatgatcaatcttttatttgcttaggttcactcagcagata

SEQ ID NO: 22754 - DNA, 701 bp, Oryza sativa
agaccagcagggataatgacaagatccattcctgtaagtgctgcctcaagctggttgggcccaaggaaaccacggacctacaagggaatttgggtacagttatttgttacatcagtatctatgcacagataaataactaatcagtaatccattcgataaataactaatcagtaatccattcgaactatctgaaaatagtggagtgcaattgtaagttgcaagtaaaaaattatcatttttttcacttctatcctttttagcttgcaggcaaatcttttctctttttttcctttttttataaatgaattaaaaatttcaataacaagaggtttacctacagtaccatttactgttgataatgattaaactgaaaaggaactaacataaggtggctttctttttcaacacaagataagatgttatcatagttttctatatatattttttggacttcactggaacaatagaaaaagcgagatctcattgttggcaagtcgtttggttaactacaaggcttgtttggcaacttgagggaaggggattgggagtttacacgagggaattgatggtgagattaagatgtgaatttgatttttcatcccagtctcttgtttggtagaggtggtggaaattgatagggagtttagttggagattagatcattaatgaaaacggatggctgagatttgtttaggcgaagt

SEQ ID NO: 22755 - DNA, 816 bp, Oryza sativa
gatgaattcctgggtaacaaactataatattgtgataagaccatttgttgaaagccgtaacaagtgctaactgttgtcgccaataaggtatggttggttttcccttgctgagcttgaaggaggaagtggaatatcttcaactcattttaagaattgcatgatgcctgaagacatccatgccaaatctccctcaaacgcttgtgtgcagaaggatggtacttttctcaatagttgtgctcctgaggaacacctttgtaattcaaaagatcggccggcattatttcttgctatgacatttagtacaggcaagagcgctaaggggcaagagcagcacagtgattttcccgccttatggtttagcaggcagaagcaagaaaaagattccacaaaccaagttttagaggtccaacttcagttccatccatatttttgtcaagtgaacattaatctgctatcttctaattgcttctgttatacttcaggctaatctggggatggattgtgctataatatctgaaggagagtgggcagatacccttactgatatcagtgttggatacttactaacagaagcatccataggtactaatacagattgtccagggacagctattgccaaaaacacattgtttcttgagaatccctgcagctatgattcatttgatgctgctgttgctcttcacgcttctcgtcataaaacagtagagcagccagcccttgcatcccattcgaccatctggggtgctgaagaaacatgtgatgagttcagttttaacttggcagcatctaggaagcaagaaagttcaaacacttcag

SEQ ID NO: 22756 - DNA, 1580 bp, Oryza sativa
tccaacagcctcggctaccgcttcgacctcctcctcccgggcgtcgaccacgccgtccccttggcggagtcctccatcgccgcttccaagggcggcaagttcgccatcgacctcacctcgatgcagccccagagccggggcggcacgccggggtgcagcccgcggggcagcggcgacttcagccagtggccgctcgccagctacagctaccgcggcttcgtgatgtcctcctccgtccagggcgaggggcggtgcagcaagcccacggtggaggtcggcgtcccgcacgtcggctgcgccgaggacgcggccgcgttcgtggcgctcgccgccgcggtcgacctcagcatggacgcgtgcaggctgttctcccacaagctcaggaaggagctctcccacctgcgctccgacgtgctcaggtgaccaccgctcgccgccggtgagcttcccgcggctcacgagcaaaattgtacataagtagttgagactcttttgacacgagatgttctttagttggttcgttggtgtgttagtgttagtagtggtagttcagttttggtgatcagttggttgagttttagatagatctctctctctctcttttatcccctgcgagtgtgcttgtgttcttttggattggctactttacttcaagccaatctcggtaacttcctttcagatgtctataattgggagaaatttgtgaccatatgaacctgtttcttccagaactagaaaatcgaaagctcttgcggttccgattctgatcgtgacatggaatcgacgagctcctccccatatgttacacaaacccaaaagcttcattttagagttcgtttcaggtgacaccgtacggccttcgacattgcttttgcaaagcggcatgagcgggggagtacgccttccctcccaaaataagtcgattaaaattcatttatatatcttatttattttttttataattagtatttttattattgttagatgataaattttatgtatgaattatttttaatttttttataatttttttaaaaaataaaattaacggtcaaatatagtaaacagaaacaagtactccagtcaggggtagatcatcggctcaaccgctcccgctgaagcagtggatcggtcaagcaagctgcggcaaaaagagaagagaaaaagaaaaggaaaaagtttcctttgccctgatgagttgagtgagaacatgaaggagcaggcagcagctggatgtcagtggtggtggagtggagtacgggcgatccgtctcgctgccgctggcagtagtggctctgctgctgctgctgctgctgctacgagtggtgccagtgtggaccgtggcgtaggagtagtactagtgctacgagtggtggatggtttgttgggattggcgactagggccatgcacatttcccgttggttgtctgctgccatggagctgtggctgggtccggctccggtggggaaaaaaggaatccaacgcaaccacctcccctgtgcccacaccaccagcacagctacagctctctcctttttcttcatcatgttttctcactaatttttcctagtatttgaac

SEQ ID NO: 22757 - DNA, 4881 bp, Oryza sativa
  unsure (1)..(4881): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactggtgggagctgcactacgacaaatggccctatccctccgtacgcacgcatatatatgcttcccatttgatcaattcaaccacatttttctgcaccaaactcgatcttatgaaaatgcgtgaacttctcgggtgtacatgtgtgtatgagcaggaggtggagaagatgacgctggcgcagacgacggggctggaccagaagcagatcagcaactggttcatcaaccagaggaagcggcactggaagccgacgccggtggcaggcatgaccttcccgacagtggaagctgccggaggcggcttccgacactccggccacgacggcggccttgcggcggcggcggcggcggcggcgctgccgctgtacatgggcagctggccgttcgttgtggacggcatgtaccggctcgggtcttgaagcctctggggatcgcatgatgttcccatgatcagcctgtgggacggtgaaatggaaaaactggtgaatcttcatcacgatctttcctctcatttttttttcttttttcctttttgtgtgtgataaaagctcagatgtaccacgtactactgtctgcttcttcgcaaatggatatgtaattgaaagctttaattctaaacatggcactccttctgttttgtattataagtcgttttgatttttttcattaaactttgttaggtttaactaatttagtaaaaaatatagtaataattttaacacaaaacaaatgcatcatcaaaaattttcaatatttacatataattaaattaatttaatgttatagttgttgctaaattctcatataaacttaattaaacttaaagaaaaatggctaactagattaaattagtatataatataaaatagaggtagtatattattcttgggcaagctagctctaacatctaatggtgggttccggccatccgagcttaactgcaatacaaggtttcacacgctgtccttgaatgaactcgtcgtgtcctaccgatcggccatcaacagtgagtgcgttctctgatccatctccttggaacagcacctttgtagggtagaatccaacttatcaacaactgcacgcatcctctgtaccataataagtacattttttatatccatttcacacatacaaataaaaaaaagaatacttccactttcttagatcgcgatttaattatttcatctctttatacatttctaacatatttattttctacattcataaactcggatataatgactagttagaaatgaatctaatttagaaataaagaaaataaaactaaacttgttttgcattgccgcgcgcacaatgctcatgcagtggcagctcctccagctgctatggatttattactgtctgtctagatttgcactgttagggaatttctcatccagttgttggttagagagtaattgccccaaaatcaagttgccaagttgccgctcccccacccccaagtagcagctcgtacgtgcagatgacgacacgacatggatactgtctctgagagcaggtataatagcaagctataagccagttataaccacatatcgagaagaagagagaagagagaagaaagcgggttatagatttttaagccgactgtaatgcggactccaagacgttacatgtatgagaggtgggaccgaatattaataatgtagtatatttttatagttaactattgtatgaatggactattacattagctataattgttttggagccaacgggttggctatactattaaacttgctcttatgaaggcggcaggctgcgtgcacttttgaactgtttgaaaaaggcccgcactcctgtctataaaaaaataacagacctggtactaaagtgtgtcccatcttaataatataaatataaattcgtagtattaaaatatatcgtatcgtgtacttatatttgtcttttatttacataatgagcggtgacttatttaaattttttatatttgtggtacaacttatatatttttttaaaaaaataccttgaatttaaccaagtgttgatgtaaaaacacgaggcctgggagatctgcttaactctagtgcaggtccaaaagcttgcctttaggttcgtaagcgtgccagttgatcctgcaatcaacaagaaataaagacaaagaaaccacggttaaatctataaacgatagctgatcggctaattgccgataatatatcatttatctttgagccgatgtcatatgtgaatcgatcggtagtcatgaataagtaataaagaattaaatctactcgatcggctgtagatattaacaatatataatccttatgtcaatatgtacttaaatcaagtgattgggatagatcggtcgccatgccgagacagtataaatcacttagatcaaaatatatattaacaactggattatatatgttcatagcatagccgatcagatagatctagcatgtatcggctaatactccgataccactctaaattaagatattaaagcaagtaaaatacgtcaaacagaagcttaacatatttaattacgacaagatcttaatataaatggcagatttaacatgttaatcaatcatgtaacgtaaaagtagttaaatcaggtaagatcggctgaaaccccaatactactctaatcggcaactagaaagcaggctagagaataatattctaagcccgatttagtagatcaaacttaactgatgcagcactaaatatgaaaaaaaaaacaatatctaggcaatcaagccgctggatgtttcatagagtggtggatatcctatataatctaagccaacattgctatttaacctaatcggctgccttctaacaatagatgttagccggttgtaggttaaataacaatattgtcgtggattatatagaatatatgataactcggcgaattacatagataagattagagtatcataaagatggaagcactaatcctgagaacgcaagccgccataacaagttttacctctagttgaagatcgaaaccgatgcagctcaacccgaacccgaaagcaagaactcgtcgaaacaaaatgaaagtaaaaaggtggcgatgcgccgagattgtattgaacatgtgttagtttgattacatgggactcggggtctatttatacccgagattacaaaatatgcccatatcggacacgactcttatctctaacaaactctaagataccataagtttttacggcagacttttgcccaaacatatctctaagaaaattacataaaatatcctaattaatagatacaattgtcttctcaggactctatccatgcacggcaatcctcatgaagctcgttaacccaacctgacaatgtataccgtgtcacattgttagattcaacttaatcggctaaccttgtccgacttgaactctgctgattaaggtcgcagccgattcggactcagccgattcttactctgtttccgaaacaatcttggacttggattccgcttcaatctaatctctatctttgatactcgaattaccaaatttagtcgttaacaccaagttagaagaaaattggttaaatttgcataataatacattaataaatgagatttttttaaaaaaatattcacacatgtgtatgtagacacacacagctggatttttttttcggtggtcccggaatctctagatccgtgataatgaggacttcatctgagagtgtcttggacgacaaccatgctggagctgcagcatttactgccgtagagagccattggccattgccaaaacggccaccagccctgatgaaatgaaaggctatcagttgtccatcgcaggagaaattaatacggtgcgacctggctgtgagagcaagtttaatagtatagcccattactagctctaatttatctatagctaatctaatagtttatttatataataattgtttattatactattaatatatggtcccacctgtcatacacacatggcgtcttaaagtccgtactgtagctggctacagatctgtagcacactactcttttctctcatcttttatcttattaaatatgtttatagctgactaatagtctgctattgtacctgctctgagacagccgtgcaggaggagctgcagcattggtagtagtttggtaatacttccttcattataaaataaagaaatttactccggtccaacaaaaagtatttcgaggtattgttatctcacggtatcaaatcgtttctgaccattggatctagctaggcatgataggtattgttagatccaacaatcggaaacgatttgataccatgatgtactggtatctcgagatagtttttgttggaccaaagcaaatccctaaaaataaaataagtttatttttcattacatataaatttgtgaaagtaaatacattgagagtacataaaaagataaataattacaataaatacattgagtagtatatgataaagtaagagtattaaaagtcttttggtttatattaattattaagatgtatgagatgtgaaaaaatgaacttatttgaaacaaatgaagtactatgtatgtagttctccctccgtcccaagttataatgcgtcttttttttagaaaaatcaaaatnnnnnnnnnnnnnnnnnnnnnnnnnnnnnnnnnnnnnnnnnn

SEQ ID NO: 22758 - DNA, 4055 bp, Oryza sativa
aacatgattcagtttcttgcaccgttgatttttattcttgtcatctagaattctccatcgattattcgatctgcatgcatgtatatatgtgcatcaatatgtacatcaatatacggcatgcaggatcgatgcgtgcatgcgatcgaatagctagcgatggcctgcagagacgtgtttgcgtcgcacacaagcattcaaatgcaaattaagacagcttatcatttctatcactttttaatttgacacctccttctgaaacttaattaattctcattagctagctataggatagatatatatagtaggtcgacacaaaagatggagtatagtataacaacagattggattctaaagactcaaaagtattggggctgtttcctgaaggaaaccatcctatttcatccaataattagtttcgatatcttacaaagaggctgggaagctgccgtgtgtcaaaaacacacggtaacaagccaaaaacgcccgggaacagagttaccgtgtgccaccacacggtaacgaacacacggcggcttcaccactttgccgtgctcagttcccgtgggggtatgcaaaaagcgcacggtaacactagtgaccataccgggtgtcctgaaactcacgggaacacctatccctaccacgtggcaaattttaacgtaacggagttcaccgtcaaatgaacagtaggttcccgggtgcaaaaaaaaaactcggtgctccctccgtcccacaatataagggattttgagtttttgcttacaacgtttgactactcgtcttattcattttttttttttgcaaatataaaaaacgaaaagttgtgtttaaagtactgtagataataaagtaagtcacaaataaaataaataataatttcaaaaaaatttaaataagacaagtggtcaaacattacaaccaaaaactcaaaatcccttatattatgggacggagggagtatcatcaagtgtgttaccgtgctctgactaaaactctcggtatgctccagtgtgttaccgtgtgatatagtaaaataaacacacgggaagcaatcgttactgggtttgtacagtggatataattcttttttatttctgatttccatttaatttcttttttattgtcacttatttcatcagaaaagaaacacatgctacatacaccacagctcacatccatataaggtgaaactacataattcaccaaataaatttaggtttcaacatacacatgttaattaaagaaatatcaaagctttaagacaagctagcttgcctaatctacaaattcagacagtcatgtgacatctcaacagatgaagcagctacatatatttcatcttaatatatctatcagcagaccaaagcaacaaattcttccatagatcaataattcaatatcgaatcagtcaagatgatgggtggctgctgtttgtcgccttgagttaatacttgagtgtagatccttgcaattgttagatactggtaaggagacaagatagcaacacatgtgtaaaaccactgtgcgattggtagaaacagaatggatatgaaattctagatttgacagatgtttccgataattggtaaatatgaaagcttactgagcagtgctgaaagaaaaataatctagcacaagataaagttccatgggcataccgtttactttaactaaaaacaatttcaaatgatagaaaggcaaggaaatgtaaacttgtttatcgacatgaatcctattaataaactattagaatgtgataatgataaattaatctacagctgctcactgaagtctaaaattacttactcagcttattgcaggaaacacccgagtggaatactagaatctgcacatgaaaagataaacagccagcatgaacagtagatgtcatggacaggatatgagaagtgagtattgtttcagtcagttaccaataccaatttacactacctattagtaccaaagcaattactgcaattcaatcagttacaaatttacagttgtactatgggagtgaatttctaggcttcagtatttaattcatactaccctgtttttacaacaaggcagcatacatattgagtgaatgactacgatacaaaatcaaaagcaagtactcatactattgtgtttcaaaaatgagatatataatgcgatagtcagcatagcattttattgggaaaaaatgtcagtcacaaattggtgaggcactttggagaactactaagagattgtataaagagcatatcacatcatgagataacatgagctttaaatttttgcatcatatagtgagataacataataatcagggaaaaataactgcacaaatctatcaactagtgatgagcacgagttagcatgcatagaacacgaccttttgtagttaaaatgcaaaggacatgctgtgaagtgtcaacttgcagtcattaacacaaacaccttgtaagcataattcattgtatcttgtggactgcagttttgctgatttcttcactgacccaaccaacccaacccctgaattgtcctttaattcatttcctcctactaaacactgcactgatataaaaacaacaaagttgctcacatgggaattttatcactcctgcaaactatcagctcacacacgtttttattaactctatacactaaacttttaaaatcagcagcacagcagacaaattaactaaacagatccattctagtcaatgtgtgacaaacgctatataaatctagtacattttagaataaaatgcacaattcgtgatacttactactactgtgtcagaatgaaatcgggtcaatgttcgtgttggtgcacgggacagcaaatagacggttgactcctgaaaattagcaagagaaaatcagatccttaaatcagattcgattgctcgaacaagaaagagaaataggatgggactgaggatggtgggaaataaagccacagcttaacatgaaacccggtcggacaaatctcctctctgcgacagcgagtagcagtgggacagaagggattggaggcggctcgctgcactatcccctctcaccaaacgaggcaacgttcttgcgacaccacgcgctcgacatcaccggagtggatggccagatgagggaagatacggcggtggtgggtggaggagcggaggagctgcaggcggatctagggttggcggcgacgctcggtggagaggagagcaaagggcgccgctgccgtccacatccgccgccgccgccgccgtcgccgtgaccgctgcatgcccgccgtccagatccgtcgtcgtcgtcaccgtgcccgccgtcgtcgtcgccgtgcccgctgccgtacgtcgaggaagggagcaccgcgcatgggaggttggtgaagggaggccaccgccgttgccgagcctgccgctgtcgcgccggatgggaggtcgaggaaggccgccgccgccggtgccgagcccgccgctgccacgcgccgcgccgcgcagcagccgccgctcccgctccgtgcctcgctgtcggagagagagagaggagaggaggaaagagtgagaggctgagaggagagataggaataggataaggatggggaaaattaaaaggtaaaatatcaggataggaggggagggagaagaggagatgaaaaaatttggaaggatgaggagggaaaaaaattagttttaaaatattaaaacttcgaatcgaattttattatactaaatgaactcatgtgaaaaagttgtcgaaaacaaagttgtataactcattgagatctaccaattttattttggtcatttctccatccgagtttgattaaactatataaaacttgaattttaaaatataagaaattcaaataatttttcgggtagtaaatgatttcaaatggaaaagttgtcaactacaaagttgtataacttattaagatcttcatcttttattttggtcatttttatatatgacttcgtttgaacagtttgaatttgaatttaaaattatgacaatttcaaacaacatttataattactaaatgatttcaactgaaaaagtcatcaataacaaagttg

SEQ ID NO: 22759 - DNA, 23558 bp, Oryza sativa
cggatgaagaaatgaccaactatataagagatgtatattttgtgaacaatcttacaaatcactttgtcggatgaagaaatgaccaaaatagaagttatagatcttgatgagttatacaactttgttattgatgactttttcagctgaaatcatttactgaaataataccggtaagaacacaataacatgatagagcatgattttagaaacatttaggaaaaagaatcatccaatttggagttcatatgagtgagatacattagtttcaaagttttcaaaaaaaattttgcaagcggctacttaagacgcccgtatggaaaaatcgatttttccatgcgggcacttaagtgagccgtatgcaaaaatgaggtcgtttttccatgcgggcgtcttaagcagccgtctgcgaaaaaggcgctcgatttttgcaaacgccactagttgtggtccgtttgcaaaaaatcatggggctcgtacagaaaaatcacttttgtagtagtgtgatcggttggccttgtatttctaaagccttgcctctattatcgagcttgtgacattgagtcaatctgcataatctgcgtacggtccttatagtccttacaccttttatcacagggtcccaaagtaagaaatagtatagaaatatgtcggaagtaatcagggcatttaacttttttccacttttaaggtgtgatcattaagaatttgccacccacaatctatgacatgtgggctctcatgtgcctatgacatatgggtctagcgacaaatctttaattaccgcttgtaaaagtggcaaatagttaaatatttggcatgaataaccaccagatgcaataatccctgagcttaatgaggcccggattcggttgtatgaatggaagggagagggaggggtagccatggtggttgagaaaggatcggagataattgggagaaagtgtgcctaattaattgtgtattattattgtaaacttgaaagatagctttttaaagtttttttataaaatagttttttaaaaaattgaccgtatgaattatatttacaaatatttatatttaaaaacccgccgtatgaattatgttcgaaatacaatgttcaaatgttttattacccttgaactgcattaattttttcaatagcaaccgacatgtggaccatctctgtactactttgtagcttctagcccttcccgagcgtctagcagaaaaataaacacgggaacttttaactccgttaggtgcgaacgaatttccacttctggccaatggaacatagcagaatatgagcacgtgcaccatggaggttaccgtgttcttacgcgctacacacggtaagtttaaagttaccgtgtgctaaacctagcacccggtattttttcctgggttaccgagttcatagtggtacactcggtaagttaccgtgtgtttacgggaaacacacggtaacactctgcagcacacgggagcttcacattctctagtagtgaaatcgatccaattttgtcggcacgtgtaaatggtgcatgtgcacgtatagcaaactgcaaacatggttgaattgctaatcttatatcttgtcaattaggtaagtatggacaaaaatctgtttgccagtggactgaaaatctatttttcaaattcacttctatttttcagtgcaaaatttatatttccagaccttcccttattttcttttcatcctatatcaatgaaagtaatatattttttctgtccgggggaaatttgatctcttaatcattcggcacttaatcttcttgcacagaccgtacaataattttttttgggttttgtggtatcacaaattaacaatataagtgatttactccatccaaattttgctgtttagtttggataaaaaaaacacgaattcctgttctccatggtttgttgatgttaaatgttcactcttctaagggtgatttttctacatgtgtatcgaacgatcgttattgtcccttgaaagggtaaatatatttggatcattcatgcatttatgtattcaggaccaatattattttcttaagatcatagatttagactgtatacatgggaaatggtagcgactattgaataaaaatgtgtcttggttccagtaactggataagattaacattaaaggtaacttgtctaagcaaccaatggccaaataactcatgaactcaccctttcttttcagaatccttctttgtgaataaatataactgtctcattatggtagtgcccgagttgtgtagttactgataaaaaacatccaaactgaatttggatgctgcatttaggatgtcatcggtatttcatttttttattctctcactgatttggtttcatttcatttgggtagatgttgtgttaaatttgttccaaataaatcacaaacacagactccatccggatcgtcctgctcaccgctctctccaaggtgagtactggaaaccttctctcttgtggcaatttcatttagttatgtatttcattcagctgatgaattatcctttgaccatggccattataaatgaaatataagctggattgcactatgtacatgatataacttatatgcttggacaaccatgtttctgatttatattttagggggggaccatgtttctgaaatttatcatctggaaaaaaatcccttacattgcttactgtacactaggacctttcacaaaaatactaatgtattttccaacctttataatgatttcctacaaaaatacctattgtatactgtatactaaaatttctgagtttaacattgcagtcttccgaattgatacaagactcagagatgatacactaagtgcggcaaaggtgagtcatgtgtggcaaatatatatatatatatatatatatatatatatatatatatatatatatatatatatatatatatatagtttttgctggcagatataactctcaccattgatcaccattgagcaaaacaccacattcataagtttaacagctatttatctaaatttaatttttcaaaaaaaagttttgtttaatggctgaaactgcacagtgctactatgatctttgaaccaaataaattgtctgagtttcctaccaacaaattgatttgttcacggatttaggtggtcacgggccataataaatcattgagaataggccatataacattcagttatgtcatcacacacattctgattttgacaaaattaggcaacatagaaatcaatgtatgcaagtatccagatacctaacaccattggctgcttattgtttcgaggggttcactgcttatattttattgagcttagctatattgtatttctttaaactgcataaccatctcattgcatagcccatatctttatagcaccgtaacaataacaactacatctctacaagattactactgtgataagaaatgaaggattggcggtacataaaatgcctcaagttgcctggaacaagcaaccatttgtagatccaaacaatattgtcgttgttattgcatacagcttgtttatataacatatatatctttcagcctcaaggtggagaagtttgatctctacataaagaaatagcaatcggtgttttctgcactcaaatatgtaaataagctatagtgtgtcagatattacaatggtgttcagtatagagcacacgtgcagacaacatttttgcagtgggcttatctatgaatatttttttattcatcttttgcatggttagcatgtgctgtatgtttcattcaattcgatctagatttgtaggtacgtccaaagggggcatgtgcatgtatagtaaacatgagttgggttactaataactaaacagatgtagtgtatgtatggagaaaaatatgtttgtcagtggaccgagaattgcatttggagatataaccaataaccaaacaacaggtgtaatgaaatgggaagttcattgtatatattactattgatcccttggaaaattaagatcatagaaaaatatttttttgctaacattaaattttagaagttattaaagacaaatagtattgcaccgtagcgtttagcatgggcatattagttccttcttaattgtaaactgagcgagcagcagcggcttcgccttatgccgtagcctcgtgcaggatgaaccacagctgagaccctgtccgttatatttcctctaagggcatgtgctacattagcacaatctgtctctgggatcatcgggagattaatccattttattacaagacgaatacccttcagacaggcatgagcttcggcctcctccgcaaacctacaatgtctaatcagcttctaggaaaaacataacataaaataaattaatgattaacatatattattaaagatcatataaaaaatatggtttataatttgggacggagggaggagtactacgtagagagctattggttatttatctgtacgatgacgacgtgaaaccagagcacagactttttatatttaaaaaagaaaagaaaaacagagcagggcgatggcccaatcctacacggcccattttctcggcatgaggcccagacacccagtggttatggagcccagccctgcgactacgagagtccgagtcaaccagtcagtcaacccaaccatacattttttcggagaaaatttggccatgttattttcaacttattaccggattatttgctccactcttaattaaaaacacgtttctataaaaaaaagattttctctgtggtatttgtttagaccacttattttagatatttgttaaatttatttattaaaatatttaatttagtcctatatatatataatcaaatcatttaatgatctaaattaaacagagctacgttattttttaataatggaatagagtatcccgacctttactcagaagagctacagctaattattactctctccattttaaattgatatgcatatttcataggtacaccaagaccaagaaaaactaataactctctcatactatatttactctagcaacaaactcaatgcatgcaccatccccactattttctagccaatagcaaatcaagatattgcatgtgggttataaatacttgtgtgcatagatgcatataccaatgtccatttactccaatgcacaaataacaaatagacttaataaatgaacacaaatatgtagatcatttaggaataacctaaaaaaaaaactatatatagatcaatttggaatgaagggagtataatcttgcactctaaacaaatctacgtcatactcataccgtcgtaattggctggccgtggcagcgacatcacaggctcacagcagtggatacctagtgcacacgattgaaacggccactggggaagtttaattaccagtccacagctcgccctgaagatcgagttaaacgcgaagttggtatatacatactccttccgttttgaaaaagacaacgttttgaaaaagacaaaatctagggtgagtttgtttccaactttttcttcaaactttcaacttttccatcacatcaaaattttcctacacacataaactttcaattttttcttcaaacttttaattttaatcaaactttcaattttagtatggaactaaacatagccctagattagtgttcgttcagattcaattttagaagcttttttagacggatgacgtgtagtaaagcctcaaatcaactttcagaacaccagacaatataaattgctgcaatggtttgaaacccgaaatcaatttttttttagaacttaaacccgggatcaattcaatctcgttccaattaataaactgtactacattttccgtcaaattaggcgggagatattttgctctccgcatatgaagtagacgagatggtcatcgcctggcacggcacgagcgtcgccacttggcagagaggatatcattcaatatggctctctcgtccacgttaaccaatgatgccaatcagtttctctttagagcaagttcaatagtatagccaactactaactccaattcatctatagccaatctaatagctcattcatataatagttatatactacactattaatatctagtcccacctgtcatagacacaccgcgtcttagagtccgtgctacagctggctacaaatctgtagcccgctgctcttctctctcctgatttatcttcttaaaatatgtttacagctggcttataggctgttattgtacctgctattagagtttagaagaacaaaatgctgacaaatcctggtcatttcttgaccgtatgaattctagaaaaataagattagtactcccttagagcaggtactatagcaggctattagctagctgtaaacatattttaatgagataaaagatgagagagaaaagcagcgggctacagatctgtagccagctgcagcgcgaactccaagacacaatgtatgtatgacaggtgggatcatatattaatagtatattaagcaactattctatgaattggctattagattgactatagatgaattggagctagtagtgggctatattattaaacttgctcttaccgacctttgaatcgatttcagtgacgtctcgctcgatctcgtcatgcctgcagatgactcaattttctccacgatatatccacatcagcgtgcatacaagtgtgtcaaagctcgtgccagtctccaacacacggaagcttccggctgctggtcccggtatcttgcacttgggtccaaacgagacaacatcacacaaggaaaaataaaatcgcatcttccaatcgcctcacactgcagcggcgcgcgtggtgatctgtccatttctcatttgtcgccgccactggaaaatcagaggagacgaagacttccagcaaccatgtcaagctgactcccaagcttatatgccgcgccggcttgcacgccctctgctccacgagacgcgacgcgacgcgacgcgcgcgcgcactggggagagtgtctttcttgctgcaatggctgagaagaagggggtgggttcacttcttcccgggctcgccgtcgtcctcgttggcttcgtggtcggcggcgccgggagcgacgaccggttcgtctacgccggcttcaccggcgcgccgctcgcgttggacgggacggcggccatcacggcgagcgggctgctcgagctgaccaacggcacggcgcagctcaaggcgcacgcggtgcacccggcggcgctgcgcttccacggcggcggcggcggcggcggcgcggtgcgctccttctcgacgtcgttcgtgttcgggatcatcccgccttactccgacctgagcggccatggcatcgtcttcttcgtcgggaagaacaacttcaccgccgcgctgccgagccagtacctgggcctcctcaacagcaccaacaacggcaacaccaccaaccacatcttcggcgtcgagctcgacaccatcgtcagctccgagttccaggatcctaacgacaaccacgtcggcatcgacatcaacagcctcaagtccgtcgccgtgaacaccgccggctactacgacgacaagaccggcgccttccacgacctgtccctgatcagcggcaaggccatgcaggtctgggtggactacgacggcgccaccacgcagatcagcgtgttcatggctcctctcaagatgtccaagcctacgaggccactggtgtctgccgtgtacaacctctcacaggtgctcgtcgatccggtgtacgtcggcttctcgtcggcgacgggcacggtgaggtcacgccactacgttcttggctggagcttcgccatggacgggcctgctcctgccattgacatcgccatgctgcccaagctgccgttctatggcaccaaggcacggtccaaggtattggatatcgttctgcccatagcaaccgcggtgttcgtcctcggtgtggttgtagtggtggttttgcttgtcaggaggagattgaagtatgctgagctgcgagaagactgggaggttgaatttgggccgcaccgattcacatacaaggacttgttccgagcgacggaagggttcaaggccaagatgttgctgggtataggaggatttgggagggtgtacaagggagttctaccgaaatccaatatggaggttgcgataaagaaagtgtcccatgaatcgaggcaaggcataaaggagttcattgcagaggtggtgagtattgggcgtcttcggcatcggaacctcgtgcaattattaggttattgccggcgaaaaggtgaacttattttggtttatgactacatgccaaacggtagtcttgataaatacctatatgatgataagaacaagcctactctggattggactcaaaggttccgcatcataaaaggggtagcatctggcctactgtatattcatgaggattgggagcaagttgtcattcattgagatatcaaagcaagtaacgttcttcttgatagtgagatgaatggacggttagccgactttggtctagcaagattatatgatcatggtgctgatcctcaatcaacacatgtggttggcacaatgggatatctagccccagaattagcacgatcaggaaaggcatcccctctaaccgatgtttttgcattggtgcctttctcctcgaagttacatgtggacgaagacctgttgagcaagccatgcaagacaaccaactcatgttggtcgattgggtgcttgagcattggcagaaaggatcacttacaaaggtaattgatgcaaggctccatggcaactacaacattgatgaggcaatcctagtgttgaagttagggttgttgtgttcacatccattgcccggtgcaaggcctagcatgcgacaggttgtgcagtatcttgaaggtgacatgcccttccctgagctaacgccaacacatctaagctttagcatgctagctcttatgcaaaatgaaggctttgactcttttgtcatgtcaacatcgcttccatcagagacgatgatgaccattggcacgatgagtggcctctctggaggaagatagtacagtagcacctacttgttagtttttttatcctacgaaaagttttatttccttggtgtaaatgtttgtaatatttagagtaaattacaattcattgtttaccttttgaacaatctcaaagatagtgcatggtagtgctaatgcttacaaaagcatatcctctgccttacaatagaggaacacagtaaatatatctagtaatgcaaacggttgtaatgattcaatgtagaataatgtagcaagttgtattgtgatgacgtagtgtagcagaaataggtgtgctcaaaatctttttggattgaaccgtggacctgtagcgatggatttcaacatttgatatctccgtgttcaaattcggtatgacaactgaaaagagctaagtgctttgcaattggtacaagttcactttaggtcccttaatttttcgtcgagtttgaaattcatccctaaaaccgcaacactagatatgttgcgtccctcaacttgcaaaactagtgcaaataagatcccaaggcgatttcaactaatatggcgcctatgtggctgatgtcacgcctaccatgggacccacatgtcagtgagtgtccggttaaaaataaaaaaatgcaatgcagaccacatcatcacccatatctttcccctcttatctcccttcttcctctctcgccagctcccccgccgctcaacccgatccgactcgatcgccgatcgaccaaccgccaccaccaaaccctctcacctcctccttcgggattccagcctccgcctctccggtgtccgaacccacccaccctgccacccgatggcgagatttcaccatcgccaacccatacctagttacaaggctcgtcgtcatggaggcattttctttgactgattagttcgaaccgagtgaatcgactagcgagtggtggactagtggacctggtggttaccacgctcaaagcaaggggcaccggagccaccttgaccctgtggataggtcatctcctacccggccaaactggtgactagtgagtttcgcatccgtgaagtattggtctctctgtgaggagaaactgcctacttttgtttagttatttttttgtttgggtatacttagatcatcatgtcgatgttccgattttagtttgatttgtcagtcgatcggctctagtagtaggtctgatgcctggatgcttagcgttgctcgtttggtggtggggagtacctattggatgagttgatcgacatcgctgctaacagccttgatgtggaggtagtagtttaactaatgacgtcctagctctccgcacgggacacctgcgggaacacaacgtttttgtgtgacctggtcatgcttgctcatttcccagttccttagcccctggatgtgcgggtcgccggcatccactcccctctcggcgcctgtagcagccgtcatcctagcaaaggcagggaaagggagagagagagagagagatagagaggaggaagggatagaagaggcgaaagaaaggggatgatgatgtgggtcccgatgcaatttttcaactggacattcactgacatgtgggtcccacagttgtttcttttttttagggtaaagagagattttattaatggctgaacatagggttacattcttgattcagaagatcaaggatttctgcaggagcacttaacttccactccgcatcaattcctgaccttaacgccatttgagctaaagcgtgagctatcctatttgaatctctctttatgttgtgcacctgcacctgcaccaaacattgcattgctgctcttacttctgaaattattccaccccattctgctctggaagcgcttgttgtatttaggtcagctaccacattaccattgtctaattctataatcattggcatatgcacccactcagtagctatccgaaccccttccaagcaagcccatgtaggcgcccactcagtaatcattgtcctacagttgtttctgactttaagtgccatgtcaatgcccacgtaggcgccatgttagttgaaatcgtcgttcaaatcgtcttgtgatcttatttgcattggttttaggagttaagagatgcgtcatatctggtattacggttatagatgaattttggactcgacgataagttgagagaccaatagtgaagttgtttcctttgcaattcgctaagggccatcccgagctgtttaatctgtattagttgtggtttgggcccaagtggcctaggtgccatatgcactacaggccagactaaatcacaccttaacatggaatgacccgctacattccatgtaaaatggcccgctatattttagtagactattcctatggggtggccttgcgggccagtaaaatggcgccccatttgcatttctattgtaccctgagaaaaaattaagttatatcatcacaaatcagtggattaaagtcacatcataaccactgtccactgattgatttttctcagattgatgtgaatcagaaataaaccactcgcttatttcaggtttaagtcttccttctaaacagtgcgtgcggcaaatccattggttctgtgtggaatttacccaaacaacgcgtcatatgtataatgcacaaaccgtatttactgattaattccttccacacttgaggaaaaccaaaacgtcacaacaaaacttcaatcttcaatcacaatactactacattgcatagtaaagaagcttttggtacacggctaatgttgttagcctgtaaagcgtgtcgttggagacgtggcagtggaagccgacgggaacgacatcgccacgaagtcgtcgtcgtcgtcatcgtcgtggcacaggaacgccggagtggccacgtccatgtgccccggcgacagttggtccaggacgtcgccgccgccgccgtcgagccactgcaccacgcgccgcatgcctgggcgcgccgcgggcagccggtgcgtgcacagcagcgcgagcttcagcatcgcctcggcctcgccggcggcgaagccgccgccgagcctcgcgtccaccgcgccggcgatctccccggaccgccacgagcgcagcacccagtccacaagcacgagccgctcgccgccggcggccgcgcgcggctgcacggggcgccgcccgcacacgacctccagcacgaacgcgccgaacgcgaacacgtcgctgcttgtggtggcctggccggtgcgcgtcagctccgggtcgaggtaacccatggtgccgacgatggtggtggtgctcggctcggcgccatggtcgtacaacctcgctacgccgaagtcgccgagccgcccgttcatgttagaatcgagtagcacattgctcgccttggtgtcacggtgaatcaccacctactcccactcctcgtgaaggtagagcaaaccggatgcggcgcctttgattatgttgatcctctgtgcccaatttaggataggtttaccttcaccgtacaaatacttgtccagactaccatttatcatgtaatcgtacaccaatagaagctctcctttacgccgacagtagccaagtaattgcacaatattacggtgtctaagccgacctaggctcacaatctcggcgatgaattctctcatcccctgcttagaatcatgacaaattttcttaatcgcgacatcaatacccgaccccggcataactcccttgtacaccttcccgaatcctccaacgccaagaaccatgtcatcatgaaatcctttagtcgccttgtgtaagtccttataagcaaaacgatgcggtccaaactcgacctcccaatcttccaccagctcaacataaattgccctcctctgcctcctgaacaataagaacataacaatagcggctaccactgtcactgataggctaacaggtaaccaaattttcacgggcatgtgcttggttgacgcagctgtggccatgacaggagggaggcttggcaacttggcgtagtccaggtcttgggctatgccggacaggctaaagctccagccaagaacgtagtgagacgtgtcgtcggagcccgtcgacgacgagaatccgacgtacatttggtcggagaacgccgcggagaggttcgccggcttcacggacagcagtggcctcgccggcttcggcttggtgagctggtgcagcgtgacgtcgaggcgcgcgtcgccggcgtcgtactccacccacacctgcatggcgcggcggctggtggctcaggttcctgaacgagccgccgggcgtgtagtaccccgccgtgctcgcggcgacggagtccagcccgttcacgtcgacgccgacgtggttgtcgtcgatgtcgcggaactccggcgtgtacatcgtgtcgagctccacggcgaggacgcggccgctcgccgggtcgccgttggtggcgcggttgaagaggcccaggtactcggccgcggcggcgccggagaagtcccgcgtcgaggagacggcgaacgcgatgccgtgcccggcgaggtcggtgaacgacgacatgatgctgaacacgaacgtcgacgtgaaggaccggacgccgccgccgccgccgctcccgttgcggaagccgagcggccgagcgtagaacgcgtggcccttctcgccgctgccgccggttagccgcaggaggccgtcgggcgtgacggaggcggcaccgtcaagcactagctcgccgtcgccggcgccggcgaacccgttgtaggcgaactcgtcgacggcgccattggcgaccgcgagatcgagcagcaggaggagcaaaagcgttgcaacatgcatggctgcgacgacgagaacgagacgtgagacgatcgatcgagcgaggcgtttcgcgcgcttttgtgaagcgttttggcgcgctagcgtggttgaccggttgtggaaatcgcatggcgacgcgtggactgaactcacactctccgtcagagaacgagctggtatgttcagaaccaagtgaccacagtgcagcgttcgagcaaagtgtacggtagcacagcacgtttgattttggtgtacaagagagtgcttgacggggtaaacggatcggactaatttggattacgacgagccgacaaaatcattccctgaattatggtatcgtcgtccacaagtctcctctcagactcaataactcaaataattgcacgagaagtggtttctggttggcagttatcgcatcatgaaacttcactattgagcatctcctgcagagtatctaaactaaactctcaaacagtttttagagcgaaggaacaatttttagtgtgaagggataaaaatcgagatccaacaggatccctattaaaaccccaaaattggaaggcacccaaatcctctccctagcccccaatcctggggctctacaccaacacccatcttttttttttttggtgcgggtgaaaaatcctagcgtacgcttctcccgttgtactcgcaccctcactacgccgccccgcccttctcctttcccgttgtactcgcaccctcactacgtcacccccgcacttctccttttccgttgtacttgcaccctcactacgccgccccgcccttctcctttcttgcgccgacggttgtcgtctaaccatcttaccatttatgtttatagaatatgttatttttaaaattatataatgcttgtgaacttgcatatgtgtgtgattgtggaaattgaattttattgtgcattttgcaatgttgaaaattttgaatttcaatttgaattgtggtcttcaaaattgtaaatttgaatatgattgaattctatgtgttttaaatatttctgtttgaattattttggtgctaaactaggtataaatatagtgtatacaaaatagaagagaatgagaaatgtggcctgagaaatgggggttgttgctgaagtacaagtcaacttttggatcctcggacagcctccattagatcttttaagggctttacaatttacaatataagttattgctggagatgcttggcagcatcatagtttctcccaccttcgtcggaaagtagattccgccaaatgcatggtttatttgatttgccattataccaaaatgttgcagtgctaaaatctaggtaattttaagtactgctatttttttaaaccggtgtatattatcggcacatcttaatagcaaattaaacaataacaaaatactctttaaagtgctaacaattcaacacggcacattttggattcaaacgagaatgcttgcatgggcataatcacttaacgtgtatttggtctggtgacaagatgagatgggttaggctcatccctctttttttttttttttaaggatatgttttcatcagtacacgtttggtagataactttctctttaaagaaatgagagaatgtggcccaatgagagagagtggattagattagttatgtcgatttttaagtacaaaactgaacccgatctagagagtattcccttttagggatcaatgtatcccacctatccccgaatcaaatacactgaagaataagttcacccttattgatcatcccattatgtccctttcaacttaaaaatatgtttatagttggaattagggtagtatgatttaaaggtgaaaaaaatgtattcaacgtagctttgaaaaggtaaagaaaagtgtattcggacttgttcttgtcaaacactttatattagtcaattgccgttgcattgtattttgaaaacagttatactcctaccttaggaattactactaggagttaggtcctaacttcaataactcctatggagattttagcgcacacaaaaagagaaaactcattaacatatgattaattaactattaactattataaacttgaagatcaaatttatttaatttttcttaagaaaacattttttatatattaaaaaattcgtatattttaaatatttaaaaatcgtgctaacagaaaacgagtacaggttagagtttgaagttgaagaaaaaaacaatgacagtggttgaaatttcctacttcctctgtcctaaaatattgctacatgacccacaaattcgttgttttacgatggtagcaacattttgggaccgatgtagtatctgtgatttcaactcaacggcccaacaattgaagcccacaaaccgcaaagcccacgaagaccaccagcaaaaataaagaagaaaccggaggtcagtttcctatctaatctcgatctctccacccgtttcccccaaaaccagcggcgccaccacccaccttcccccatggcatcggcggcggcgagatccggcctccgctcgctggcggcgcgcgccaaggcgaccgccgcccccgcggcgaggcgccgcatgtcctcctccgcccacgacgacgcccgtgagtcgtcccacctcccgtctcctcttccccgttttgtgtggttttctcgttgacccatgattggcttctgattcgcgtttcgatctccctatccccctccccctcgcagatgagacggccaagtgggagaagatcacctacgccgggatcgtcacctgcaccctgctggcggcgtacaacctctccaagggccacccccacttcgacgagccgccggtcagatctcgtccttgatttatccgggattctggattagctattgtatgaatctgattcgtggaatctgtgattgtttcaggcgtacccctatctgcacatccgtaacaaggagttcccatggggtaagtttgttcagctatggcttaaccctatctatttgagtacttgttgcgatgttctattgagatttatcgcgattaatattctgactgaagtcaaatggctggtgtatgtacttgtatgcggattgtgatagttgcatgttacggtatttcattttgccgaaatacccattcctttagttctggtcgtttataatcttggtgattgttcatcgttttctgatgaaactaccgatttagttgactagtttgactgtgataactcgccgaatatcatttacgattggcatagatatgtctgcaaggattttttttttgtctgcgcaagaatattataatttcatgtttggagattcgatcacatttcctaagatacttagggcaacaccaatgtctgaggaacacttcaatgcctagtctgcaaacattgggactttcaccagatacttaccgcacattgagatggaatttgatcgtacattgtgcttgcaatattgcatccagttcttggtgtacattttgctacacaaacttatagttgtactatacctaatcactctagaaacctttgagatctgggatggtaattttaagttgtattccatttttctgcatgacgactttcagaactcatttctgggattcgaaattcatataattagcatgggtgttgtaatcttctttttttggtacaaatgtttaagagttgcatgcaacatatgtcatgaacaacaatggtagttatgacaatatgaccttaaattcaatcagattttagactagtcttatgccttccacctatgattatcgtacagcagagtatagaatagtttgttatttttgtataggaagctatacaaagctcaaagttgcatgtaacagatgccatgaacatcccagtgaattagggcatgataaacctgaaatccacattggaactatatattggtagaatacttgagcattactatcgagtgagtacttccgtttcgtattctgtatttgtttcgagttactgtgttgctttcaaattctcacaccatacaactcttccatgcaggacccgatggcctatttgagaacaagcaccattaagtactgaacagcgcaccatcagaagcccagtgaatgcttaagaaaaattctctggttgttccagtgattcttgttttcagtgaaacctatttttcttgcaacaaagaaataagaatgacaaaactcttgtgttgataatcaggatttaactgtgttgttagttgttacctgttttcttcattcacagcagtgatcatatgcatgtgttctgtttcagaaaatgctgtcatcatcacaacaagctttgttattataatcttcctacgccatttctgtgctcttgctctttatgggatgaaacctgttccgaaaattgatgcttatttatgcttatgaattttcacggttcagtcgctgtcaaagctggatgtacttctttgcttgatcaacagattgcatagttgggaaatgttgagaaattgttaccggaagctattgctacaggaaaataaaaaagaagttactggaaaataacatgagcatcgcttaaaaagattgcctagatggatacacggctttatagtaacaagcagggtaacatgataaacagattatatcagcttgaaagatgcagcgagttgtcctgaagatcaaaccggacgaaataatctcatgctgtcaccggagagcattccgtctgccattttcagtcttcttccatgtcgttcgtaatcgtgggctccaagcctccaagtgcctcaatattgccagttgcttttctgtgattgtatcgcaatgacccggtcacaggaggattcaagcttacaccagaatcatttaccgatgtgttaatcactgcagttctgttcatatcatctgcaacgccattcaccagtggaccagcagctatggagtcagaagagttcgtgtgaggaccaaagctgatgacatccatttcatctgcctgaaggtgacggagatctccgccgtcgtcgtcttcgtcgccgggaaggccatcgtcggcaatgtaaccgtcgccgtcgtcgtcttcttcttcttcttcttcaccggtctcgacgtttccctcacccgcttgatcaccatcgcccacctgatcagacgtgacgccccgttccatttcggcctcggtggcaacattgctccggccaccgatgctccgacgaacgccatcaccatcagacgcgtcgccggcgaagacaatgaagcccttcctgcccagccggcgccgcgtcacctcaccgtccatggcagcgccgccgccctccacggccactgcacgtcgccggttgcgtgtgagctggtacaccagccagacactgacggcgactagcaggacgacctggaggatgtgctttggcctaagaagcttctttgatctgtggcatctgctggatggctgcctcagcatagtgaatcagtctcagtttgtgtgtgtggtggtagacttgttagtgttcagctccagattcctcctggagcaatcagaaaagttttaaggtaagcaaatagtctgaactttctgatggttaactatgttcaaaggaattacatgatctatagctaccagttatgcgccacaaatcacaaatgtttattcagaattggaaatgcagttgccttgttcatgagtttcagttcagcggagcatatgggtggctgatgaacagcagtgtaattcagaaccattatagcctaagaaaacaactgcttgtaacaagatccttatcagatagatagaacagtgtgtttaccttgcaaaatgaagctgtgaaagcactgaaaggaaaaaaataaatcttttatctcctcctggaactgtagatgcaacttgcaaggaagaagctagagtagcagtagaagagaccgtcgtatcttcttcctcttgctcgctacaaacactgctgcatctgcaagccccgatgaatttctgacgacgctttcacgccccaatgaattactccactctactccaccactgcatctctggttattttctcagcggcaagtgccacagtatcatgaccgagcacacagggtttgcacgacaccatgaacgccaagcgagaagcaagcaagtgagtacgagagtacgagagtacgagagacatactgcctccctctcaaaataagtgcagacataaagattcgtgtttagcgctttaatcacccgtcttatttgaaaaatttataaataatattaaaaaaattagtcacaaataaagtactattcatattttatcatctaataacaatgaaaatactaatcataatctttttttaaataagacgaacggtcaaatgttgaacataaatagtgctaaaactgtacttattttggaagggagagagtatatgtcgcatgagcaaacaataaagcacagaagtcacacagcgtgaaagcaacagtagcaaagttcagtaccaacagtagatgggcgcagagagaaaaggagttcagaatctgatcaggatagcaacggatcgggccgaacgaatcatcaaatctcgaaaagctgactgcgcagagctcgtagtgatggtgttcttggttcggtcaaatcgtcaaggcagcggcttgtactactgtatgcctgtgatgtggtggtgcaggcgtgcagcactagggccatgtggctgcatcctgcaacagtgcaactgctactccaatatgccaatactccgttagtacgttgtatacatagaaaatggctgtttggttcttaactaacattgccataactcactttagacaatgttaggcaagtgtggtttggggcttgccacactttttgtggcctataaattgtaagccaccctttgacaaaattaggcaaagaattgagtctatgacatataggataaaatagtactccctccgtcctaaaataagtgcagttttgcactattcacgttcaacgtttcatcgtttgtcttatttgaaaattttttatgattagtatttttattgctatcagatgataaaacatgaatagtactttatgtgtgactaaatatttttaattttttcacaaattttttaaataagacggacggttaaacgttgggcacggatatccacagctgcacttattttgggacggaggtagtaagaaagtgttgcttgccataactatggcactgaaccaaacacaaagctaaagaggtgtggcaagttgaagtattaaaccaaacagcacctttaaacctcattattttgtgcctccaatatgccattgccaatactccggtagtagtaactgaagaactgaacaagaatacccccatagaaaatgtggccatggagcttcagctcggcccatagaacatgggtttgtatagcaggataggggcccaacaagattaggcactaaaacttattatggtaagccacaagagaataaaaaaaaaatgagaatctctcttcttccattactccgggcctgttcaccttgatgtcatttttaaccttaccaaatttttggtaaagttgcaaaataatggctacatttaacttgctgctaaattttagtaattatataagaaatcctgtcaaaattttaacaagttgccaaaattttggcaaatataagtgccaaaatttggtaaggttttttttggcatcaaagtgaacaggccctccatcctctctccacctaataaaaggctaatttacaaaaaaaaaattatgggtaaagatgcccatatctattatctattcataacttatactccatttatcttaaatataagatattttagatggatatgatatattctaggaaaacaaatctggacaaagcagccaagtcgctacagcacgtgctttccgtttctccagctgatcagtgagaagtactggtagtagagcgacacgccggtagcgtttcctccgcggatcgatcgatgcagccaacgcactcggcgcttgcagctctccagtctccaccgttatgcctttctgcctgcgtgtgttgccacttggcgctttgccagcaaacacatgcgatctgtatgaccgtagaacccacacaaccacagcaagagatatatattttctttgttttcgtaactgcccaatgctcacatcaaatcctcgtcgatcgtcaacgcgataaggatatatacacggcatatacaccgtgatgcttgttgagtactacctccgtcccaaaatatagctatttctaccacagtactttatcctaaaatgaagctatttttctacctaccttctcctctcaaccaatcacaactattctttttcacctactttctcttttcaactaatcacacacctttttcaatcattctcacctactttcttaatacccgtgccaatctcaaaaatacttacattttaggacggaggaagtacttgagttttttctgtcctttttaaagcaagttcttgtttttttggaagaagctatcccgtacaaacgaagaaagagattgaacgagtaaacatctctgacttagtctacacataaccagaatatccgagttacaacactcgcagttcgaattaaccatcctacccacacatcaattccagttggatgtaattacaaatgaagagagagagaggagggggagggagagagtaaccatcctcaactatggagttaagtgcttggctcgaggtgctcatcgtgcgcagttgccgccacatcattccctagttgagctcatgtggctaagcttggggagtaggagagcctcgagcttcgtgtccattttgcctcttttccacctattcaagcttgaggagacaatggttggacaagctatggtgtccatcaccattgtgaattgtcggtcgcgaagctatggccgatctagagagggaagaaataaggatagctcaaactccatcattctctctaaatagagcttaagccggttgctgcctctagcgctctccctgtggagaactcgagctccgtcactggtgtcaccacctgcctccttcaagagggtagctcggtcaccgtgagagaaatagagagagccagagaggtgaggcatatgacatgtcgatcctatgttattcttatgttgattggattgctaaatccattgaaagcagtggtcggattatttttctggtttgaaaagttgagcgtgttggatttcaagtttttttttagtttggaggtaatttagaccatcacaaaagttataattaggactattccaaacataagtagactactacttgtacttactaacactaactcccagctaataattttgtgtagtgctgaacatttttcgtgaacgcgtaaaagtattgtacggtatagtactaatccaagtattatatagtgccaaaacaatatcaacctatcgaatggacgcacagcacgtaagcatacacaaacatgctctacggttccgtacagcactactagtagcattaacaacgcgtaggtagtacgtacataacacgtacggcatacatcaattacaagttacagcacactaggaccgacctatatactgtacagttgtacagcccgtgatatatataggctagattactactagaaaaagcattttttccaacgtgggagtcttattttcacaggcggacatgacccttagagctaaatgaccgcctacaaaaatataaatcgaagtgaaatttgatgtccacctacgaaaatcaaggtgaaattgattttcacaggcgccgcttaaatggtccgcctgcgaaaatagacttgaatataaatagacttgggataggaggagattttttctaagtctccacaccttcaccactcacggccggtaagcttatcccttcac

SEQ ID NO: 22760 - DNA, 1692 bp, Oryza sativa
  unsure (1)..(1692): unsure at all n locations
nnnnnnnnnnnnnnnnnnnnnnnnnnnnnnnnnnnnnnnnnnnnnnnnnnnnnnnnnnnnnnatgaactgtggataaattgattcggtgtttttttttggatgaactggatgaattgaatggattggatggggaaggggtgtgaactggattgagaacgggaagctaccgccagaaacaggggtgactgcccaatttttttttagcgctcgaagctattttcgcaggcggacctggcgcgcgcctgcgaaaatcaactatttttgcaggcgttgaggtgcaggcggatggcttgtccgtctgtgaaaatatgattcggccgactgggaaaagagtttttctagtagtgtctatacgagttttaggaaccatgcaacttgcaaattaagcatttatgtgtgtgtgccaattaagagcaaattaacattgctagctagctagccaggctcgatcgaaagccacgggtgatccgacgctgcaatatgaaacgcgcgaacgtttattgaaggtcacaaacgaatgaattataactaatataaagttaaaaatgatttaactaaagttgaacgtctactgcagaataggattcggacaacggacatgctacagatcagacaatgaccaaacaactgtttctgtcaactatgctacagaaacctagaaaccgcctaacatctttttaaagattgacacttttgtgtgtcagatctgagatagggtcatgagtagactgaactgcagcgaaatagaccacccacatgatgaaaatgaagtattgttgaaatggtggatcagaagaacatctcaaggaggaaaaatacaaggctaaagcactcaagtcaatccacttattggtggtatggaaaatatggtgtgaacgaaacatgaaggtgttccaaaatcaagagaaaatcatgtcgcaactattcgccaaaatacaaaatgaaatcaagctatagagcatgtgtggagaaaaaaaacatcacgagaatatccgcttaggtttcatttagtgtgtgtttcttttatgttttcttccctagtttcccttgtttctctctttcactttctttggtgatattgtaaatactttctatttttcttaatataacttcaacttagcatggctttggtttaaaaaaatgaatttatttcttaaaataatcatgtccataaagtttttataaaaataatattgtttagaaatttgaaaagcgagtctcgttaatttgctcatccatttagttgaaaaagaacagtgcggatggaaaactaacgagccaggtcttgttagttactaacatgtgatttacttgtaaactctagtagaccaatctctgtgggaaatcctctaatcgtctgctgccttttctttttcctcatggatacctgtctacttgtctagctaatacacacaagctttcctcattcgttagctacaattgacaattgtacagtacaaatcacagccaggaaagcttgagctggcatgatttggatgtgtttctgaagcggatgagaacacctgtttgttttttcagataatgagaacacctgtttgaacaaattttcttactaatttctcgcgctcagtcgtcgtggcagccatttcagcccgcgcatcgcccgccgcattgtccgccgcacgcatcgttttctccgcgatcaatcgatcaaatcgaacacaacagca

SEQ ID NO: 22761 - DNA, 2565 bp, Oryza sativa
atccgaacgggcagtgcggctctgtggcttttgcttggctgggttgggctgttacgagatgagagatgagtggggagatctcggttggttgattcgttgggtttgcttcttttctggttccaaactagtactagctgctttccagcaacagaggctgggacctgggccacctgggactagtcggaattggtccgggcccacctgtcagtgtaactaaattgatggaaatgtcatttataattttcgtcccaagtgggaaatcgtttttggggtttttttatggaaatctaactccggtgaaaataaaaggtagttttatcgccattacggggtgctataataatagctttaaaaggtacccctccgttgcataaaaaagcacaatcgtaactataaatctagacgcatgtgtgtgtagattcattgttaggattggactttttatacgtgtctaggttcaaatcaaggattggtttttttggacggatggagtataaaagtaactcaaatactccctccgtcacagaatatagcaacctaggattggtcaatgtatctagacaccccatcccataataaggctaagggcctcatcagttgacataataaaccaaatcaaaagctaaaattagaattttcgaactttatatttgaagttgagtttaaggtattttcaacgtaatttttttaatattgacttttaagtcattacgaacaaatatataaaaggtttacctatagattactttgtaatgtataggcttattagggaatatgaataaccgatgaaggtttaatccgttttcacctctttgctttatttttcagatcactccaatccactctattcctattctagatatagttggaactgttagttagattttaactttaagagaaataaagagaaatagagctagagctgaaaccatatcaaacatgctctagatactagttttgaaacatgaacatataaactgagtttcttctctagccctaatagaaacctagagtatttgttttgtcatactaattcgccatgtcatgtgttaaacataccgttcctcttccgttactatagctatagctataacagtccatactttactaacttgttatctcatatgccatatacttgtcacgtactattctctccgtcccataataaagtaacccgaataggacacttcacagtacaacgaaccggacatgatactataaagtgtcccatccgatactaagttgctatattatgggaggagggagtagttgataaatcttttcacttctgcgaccaacagtttgttagcaacactttgtgtatctttgtcatacttttagtactaagagggtgtttagatccagggtgtaaagtttttgcgtgtcacatcggatatatggacacacatttaaatattaaacgtagtctaataacaaaacaaattatataatccgcttgtaaactgcgagacgaatttattaagcctaactaatctgtcattagcaaatgtttactgcaacaccacattatcaaatcacgacgcaattaggtttaaaagattcgtctcgcaatttacacacaaactgtgtaattggtttttttcgtccgcatttaatgctccatgcatgtgtccaagtgttcgatatgatatggtgaaaaaattttaggtgggatttaaacagggcctaacttgtgttgtgatgaaatggtgagaaaacctgttgctcaaacggattcgaactcaggctagcacgttgctcctagcagctccctaccagctgagctaggtgctgttctcacctcttgaaatcttgatatacgtccaacgacgacatggaaaaaccgcatcaaatccaaggcggcatcgagtcaccatcatccatccacggatcgatcgttaattttgttcgggagcgcggactcattcctcaccagtcagcagcagcagcacggagccgtttcacgttggtgagtcaggcgccggagctgtagacatcttggatcgcggcgaccgatcgacagcgcgagcgagctgtcgatcgcgcgcactgtgcgctccacgagcggagcccggaatgtctcggggatccaatgcccaacctcacgtactactagtagtacctccaagtcgaaggtcaggtcgtcatagagatgcccatgccgccatgcgatctcatgtgcaagaactgtagagattagtggtactggtaattaaaagattaagtaaaatgaagggcacgcacgggtgggtgcaggactgcagcaggtggctaatctagctggagcacgaaaaagcgacgatcgatcttgactgcatatgcgctgcgagccttttaaaatgggggaaaatagagcatagagcatggaaaggaatcaaaggatggatgacctgtccagttttttttgtttttgtttttttgaaaactgatgacctgtccagttccatacgttatcctaatcgcctcgtcatacaaatactggagtagaagtatattattattattccctccaaatgccacgattaaatctaatctaaaccctcgttgtcatccagccatgcgcac

SEQ ID NO: 22762 - DNA, 2993 bp, Oryza sativa
tagtacgagttacccgagtcatcggtagtgagaaatctccgcgccgcgattggatggccgatggatggtcgggtcgcgtcgcgtcgcgcattcaatctcgcgtgcgctggctgctgctgctgctgctgtgccagccaagccggcgcccatgcagctcatcatccacagcgctcgctgcgacggatcccatgattcccatctgcatccagccgtgcggccctgcgcgtgcggctctcctccgatccgatccaaccaaccggggtggattcgacggagaagcttcccgggatcgatgagcgtcgtgtgctgctacagtggtgacgggggcccttgctatggttgacacgacgcctcctgtgatccgttcggggtaacatggcgtgcatgcgtgtgcgttatccgtcctgatgacacggcacatatggacgcgaatacacgatgctcatctagtaggtattaaaagagctttgttcgatctgttgccgaaactaacgttatcaggttcagattataaccaaaataaatcatattaaatttagacaatttaataatattatcaagttttagcatgatttcttatttaattactagagtttcgtaataaactaaatggatgcatatatttgataactttacttaaaaaaatattataatttaaaatgacatcaatttgaacaagccccaaatgttagtatagtcaattcttgataagacaataaactaaacaagactaaatcaaaatataagaacctacgaccgaatagaacatttcctactattacgaatctggacagacgaaaatgtttcatccggttataggtttttatattttagaacggagggaataacatataaaaattcaacaaatttttaatcataaaactataccaaaatttggtgaggtgttaaacttcacatcttgatcttgtcagaaattttagcttttcaaattgaggggttttttttttctcattgaacagaacaaaccgtaataaatcaatttcgttctgtcggtcaaattaagtgcggttgggtctaaccaggcagtggggatgattttggctccgtccaatgtgatcgaaacgctttgagaaatgtagagtgcgatcagatttttcttagtggaccaacgcacgaatttcgcgtgtgccgatctatagctctcctcgtcaactacacatagtacgagcgagtgctgggaaggatggctcggcgtgcaacatgagatccccatgccttgggtcactcatttgccccagttaaatctctctactctctctctctctctctaacttgtagccaccatgaaccgcacgacggacggctgcagttgcgtgctcttctgctgctgctgctgctgctaccattgaaaatcctctttaatttagcggcaactgcaatctgattgcttgcccgcaagggcatgcatggtgtcggcatcagggccctcgtacgtactgtcgtgctacgctcaccaatcaccatgctttgctcgatgtcgtcgtcgatgtggccatgaaggcacgaattcatggtatcaaattgacgtactggtttggcattgctgatggcatgcacatgtcaggtgttcttcatggtggaggaaatagagaggcgagagagagaaaaaaagggaaacaaaatggacgattcgctgcctctccaatagatattgatggtatttgtgaatcttagttctttactttacgaataacgatattatctctggtgccattgttcctacttctacgacgatcagattacacctttacccgatttgggaagttgcatctgttgacgagtccttatgagccaattattctacacttcttacttgatgtagcttgttatataggttgtgattagggcctgagtttatgtctgagtatgtccttgaatcgctgttacatattcagcgaacattgaggaatctggccgaagggagaagcacaagattacctatgggtatggcccaaaattaattgggagaagcccaactgagcgatctcgcatgtactggtcaggtttccagcctaaccaaacccatcagaaaattctggcgtcgccttgaagaaacaaacgctgctcgcatactatcataaacaacacagtatgccgataaacttcagatatcaaagcaaaactgagaacagttcagggcaattgatcagaagcatacctgtatacacggcagtcatcagaagctttactgtaaccaagagattgtgtgagctttttgtacagggacaccacaatttacacgacatacatgtaacatcttagtacagctcttactatatatcttacacagcagaatgcgtccctcttgactgcaaagaacagcaagtccgcagctgttggatttcccacaaacagcttcacttggacaatgcaaaccctcctctacagcgagatgcatccttggtagtacttcactagccaatatagcaagcgacgagagcaatgaacggcgcccagaattcacagttctacatgatggatgggattgagtcattcttatctgccatgaagaatgacaggtttcgaaacgcatccaggctattcaccatcatgcgattccaactattctgactgtctcctaagagtaagtcctcagcttggtatctcacggatggtatctctaagtccagtggtccaagtgaatcagcctatccaaagagaagacatagtaagttatgatctgtgttgatagattatactagaaactaaaacaggcagggataggatatctgtctagtacccaatataagtcagctagagattgatcctttaacccagaatcacttttacttcgaggtggagaattggcacaaagtgcctccatatctttggcatcatccatacaaggattatcagcaacctttgctcctgctaagtcctgcaaacatgaaataaatcatagattaacaacattgatgtataaaaagtcgttttattctacaagagaccaagagatggaaacaaacctgaag

SEQ ID NO: 22763 - DNA, 12798 bp, Oryza sativa
ctagtacagaagatatttttttcctagcgctaactgtgagttccagatgtggattatgttcatcctgttgaaaaaagataggactatcaatatctcaaacaccatcgaaaattcataaggtaaatagtgctagtaaggttatttgcactccacattccattagtcccatttatcctgagaaattttatcaaccacagtgatttgagtgtccgagccaatagtaaatcagtaatagctgttgtgctaacacagctgctgcaggaaacacatgattcataatttcatattgcagcttggtggcaacaaacaggcatatttaccttttccaatgcctttcgtgtggcttcattgattggaaataactgcaatttcagctttgcaggtgcttgttgatctgcttcattcatacgatttgtgcctggatctgccagtgcaggataaaacatcaagacaataggaaccagtaccagccatttctagtcagagagcagtgataagaaagaataccatcaacggtacaaacattgtttgatgagggagataatgtccttgcatcaacattcactgtgttgcgctcaagctcttcagctgcatcagcgactaaagaaacaccagccatggcatctctctcccattttttatatgcagtagatgcaatgccaccacctaaaatacaagtccactgctctcaaaactattgtaaggaaaattcgacactttaagctcacataataaaatttattggattatcgacatttagctaagacatacagactgcatatcgcataaaatgaaaaaagtaaagggtgtgccacatgaaaccaaaaaaaaaaaaagcagtgtcacctgctctccttttctgtttcacagtaattgtggcagagaggtcccatttagttgaacctgacttgttattggaatttggttctgcacccctcttgaaaactgccccttttgaagatgctactttgctaccatttgagacatccacaggtaggagttttactgaggaagattcatttccagcagtcctgttcagaattggagatgaagaagaaaggcactcatcccctcgtggacacttttttctggttttattcctgtcctttagcagttgatttccctataaagttggatatatcacatgagaaaaaaaaaacaaaaatgaacatttttacagttacaaaggagtgggaaagtaacaaatggtcatgcaccaatgcttctacgaatgttttgaatctccgaggcttcagatgcagttttgatgcactgcagctaaatttttcaagcagagaccacctgcatagaacaaattcagtatcggagagttttccatgcaatgtaaaagaaacaacatcagatcaaatcaaaagcaatgacaataaacaacagacagtatctttcttgtgcatagactagaatgcaatctgcatggaaataaaaaatatatctttcatcagaagaatattctgaaccacgaagtatgccaccaaaatttcagagaccattttatgggacaggtctgacaatctaaaacagaagcagtaaatatgttaaggtgtctatacagtattggtatgaaggccccatagttctaacctactaggcattatagcagtaaattatagacgtgtcctctgtaaattaaaaggatcacgtacctactacagtcctaggttcctagcctactaggaaaaggatatatatcatgaagatagctcagcaaatttttgaggccaaacactaccctttgcaatcatgttatataaataatatcaagcagtagggaccacatctaatcagattaatttgcatgcagacattcattccgttaccagcggagcatagcagcaacagtgtcctttgaattttttgcatcaagtgagaactcaggaccaagaagtttcttcatgcgtcgaacaagacgatagtaataatgtctgacctatattgcaaaaaataaaaggcaatgaattttcagtccaacagaagaaattcaggttttctctaattgatgcaaatattatctataactttatatatgatgaacatacttatgctagctatgtgaggattgagagataattaagtgtctatgtatcagagagaaaactgtactgatttattggcagctatcacttaagcatgtccagtgcccacatagtcaacagaacatgcttagatgatcaggaacgagcagtgcaggaaaattcctctctaaatgttccagcctccaggtgcagaatcttaggtggtaagctgctgaggagtgtgctttatggccaaagatggacaaaatagggggataatatcgagatacatctaaagcctgaataaaacttagtgccaattctaaacatcatgttttggcattgagagcaataggtcacccggagtgcctaccgatgaacgaaacttctttcaaccagtggctgtgtagcagccggttgaaaatccgagagtctcaagtctcaatgccggagtttcgatacggtagcaacacttgtggcttggacgatctggaaggagcggaatgccagagtcttcaaccaaagttttagggcatggacagatgtggcgagggaaatggctcaagaggcaacgctttggcgtcaagcgaattcagcaatccccgccctactcttccgagagaatcatggtagccaaaatgtgctgcgagaattaggcctttgattttgtaatgctttccagtccctgtcccctgctgctctttctttaaatgtaaataacctttatttctcttaatggaaaaaattcgcctctggcgtattcccgaaaaaaaaaacatcatgttctgaagtttgagtttcccataacagatcggctgcaagtatatcaatagaaacttgaaaaaaagatgaaatcagctttagtaaagaagagggatcaattgcaagtgaggaagataaatcggctccaagtgaaagtacacaatctggatgggaatctaaaaggagggatgttgtaatccatccaccctgcagccttctccagttgaaccacgaaaatcagcaagaatgtaggtatatgctacaggatgctggtgctatgtcaagcaacaacaacgaccatggttgaaaatgagatttgcccatgacagttacttctgatttttttttctcaaagcaaaatagatttattcaattctaattggcatcccatcatagtgaaagttatttagcacattgcatgtagaactaaaatttacagcctaacttgaatcttcctttcattcaaatttcctaattggttaaataaagaacgacaaatatcataaaaaaatactaaatttatgatctaatgtgtatctaccactgcttcaacgtcctaacgtatcaatacagaatgttaaatatcatatgaacatcttacacctcttggccgaaaatggtgtacctgatccttgtttttgctctggacacggagcgtgatcttctcaaaattctgacacaaaggaaaagttattgttgcatctatcgatcagcgcacacattgatcagattgcaagaaacagcgtagcatcataacatcgatgcgtcttacttttccttccaggcgcagcgcattgaaaaagctctgttcctcttggcgtgtccatgccgcccattgccgagtcggcttctcgcaagagcaaggcctcacttggggcatagagctcagctgaacccccaatttttcttgatcctggaaacaaattgcttcgattagtactgcatcacgcatgaaatcgacaggaaactggatggattaattggattgaaacaaacaacaatcgaattctgaatggatgttcaatccaagctgagcgagggggaggaagagctactagagaaaaagaagaatgaaataccttcgattcgaaccgcgatgcgatggaggccggcggcgtcgcctctggatccaaacctgctcgaggaggctgcgattgcgatggagacgaagctagggcatgctcgccgccggagctagtgagatggagagggtggcggtgagcggcggaggggaatttgggaccaaagggcggtgaacgagccgagctcgagcgagccaacctgaataggctcaaagccgagtcggggctctggagcctatcgccctatcctagtattgaactcttgagggttgttaggctcgagctcggctcgagcaatgctatgtgaggcttggagctcggctcgtctgatactctaccatggcattaatggaaatacaagaatattgtttggacaacgtgtagaataaactttatctaaaaaaacatgtatcgtagagtacattatatagtccgggaaaaagagtaaattatagtatcaatattattctttatactaatatatcttattagtttattgtttataggttcagacgctcaattgaagatttgttgctccttcgcaggttccattttataccctatactttcacgaaagttaaaaaatcacctctaaacccatcaatttactgtttgttgtagaaaacacagtaagattagacgaaatactctatccagctgtgaaatatctccatattgtcccatatgtcgagttgaaatctttgtgcagtgccacctggcatttttgcaccgttggccgaatggccgttgcctattgtacccggccaaattgtcagcttgaactatcaaaacaatctaataataaagcatataagatatcaaagcaagctgagaccggttaagggtcaaagtgccagcatcagaaataagggaagcttgctactcaagatagcatataatcatcttctattacagcactagaacatgctcgataatatgagaattaatcccagaacatgtattgtccatcagaccataactcactttcaaatatcaataatctgttacatatcataagacgacaattgtatcaaaagggataatactcgacaaggcttttacacttccataaaaattttcccgatctaagctcccattccacttgagctcccaactttcaacggtactgcaaatgaataagatgcactttgagaggtccagggattaaaataacagcaaaaagctagataacacaaacatctgcacaaaaaaataactaaataaccgcttattcattcaagtattccagaacaataagataaaacaatgtagaaaattctaacatcacaattctggcataaaatcgggtgcattacatctgcacgataaaataagtaaataaccacattcattcaagtattccataacaataagatgagacgatgtggaaaattctaacatctccacaattctagcatgaaatcgggtgcattaatattttaagcaagaggtagcctttgaattgtggttagcaacttttttttaacaaaaggaaactaccctgctttaattggaagcaacatatcaaaaaggaaaaacataaaagaagggaacccatatgaaagatgatagttgtagtctattgattagcaatagatcctcctattattcgttgaactacagagagatgtttgcaatacgtttgaagtgttgacatttagaaggcagctacaagtgatagctaatgagctcacatggggcacatggcacatactcatactatgttggataagtggtgaagataacaaataagacaggttttcaaaattaactaatattgttatagtattggcatctgcaaaagataatctcagaaacaaaagcagtgtgtgcatcaattccaattctaactggccatcttatgatctgtaattattcatatcagctcgaccagaacagaactgacaaaatgagaatgggaacatgaggcgacaacggataacacaatacacaagctgtcaagcaggaaataaaacgtggaagaggaacaacgcggcacagtttgtgacattatcgctacgtcgttaggaactaccacaacaccgcacacgggatgcaacactattgcaccaaacaatttcaccatcaaaaagtaaaactgctaacttgagcctgcatattacaggaagcaactagcaacctaaaaaaaatatgaagagtataccttgatgaagccaatgtccttggcgttgctgcggaagcactgcctgcagcacatgagcccgtacttccggatcaagccatgcgggttgccgcaaacacggctgcaacaacaaatccacaccacaaatccgtaagcactcgtcaagcaatccaagaaaaaggggcgcacgaacctttctaccggaagcaagagataaactactacagtataaaatctagcaacatgcgaattcacgccacaaaatctgacaaatctgacccgatgctacgcacacagatagaagaaatactcctatggttcgtcaccgaactgaatgaaaacacggcgcgggggatcgcgagtagagtagagaggattaccaaaccctggatccggggccgtagttcttggggtgcgagttccacacgttggagtgtcccatggcggcggcggcggaggtcgtgagttgtaaaccctagaatgaacgaaatgagcgcgttggcgtggtggtagccgggcttcctctataagcatcggcttcttcgcttgttgggctttgacaagtcgtcgcatgagtgggctttcaggtgaacgtatcatgggccggggcccatgctagactagatgcaagtatggatatatagagattaaaaatccgtgtgttcaaaatggccccatggtctagcggttaggacattggactctgaatccagtaacccgagttcaaatctcggtgggacccccttttttctttaattctcttttagtgctaaaatatccgttcgcgagtaacttattgttttctactgtagtaatatgaaactaaattattgtgtgtttttttaacacagacaacaatcttattcttccaagcagcagagaacagaaaacccagaaaatagtcaggaagaatgttcttgtaacaggcggcagtgactggatcagcaacatataatttcatttcgcagatcgattcattcatctctctgatcctttggcttacactataaaatttgtgcttcgattcacactccagagtccagaatgacaaaatggttgtctacgaaaatttctggccgcttgcatttcaagcaccgcgcacccttgtgctccacttattctcaaaatctcagttacagattacacaacactgaaatgaaaaggaaaaagagaaacaagtctaactcctatatgcacagttttttcacctagaggcatcaggagatgcgcatcagaggatgaattatacacactgagatgaaatctcagtagcatgtattgctaatctgtggtgaattctacacaactgcatccttttccaactctaccgggtcagggagaatctcccttgaagccctcttgaaggagaatgaatcctcctcctcgtcctcatcctcgtcacttccttgtgacttcactgactgcttcctggctgactgccccaatgttggcctgagctccgagctcctgcgcgagtccccatgaaaagcaaaatgccaagagcttcgagatgaagtactcgtgagtgatgaattcgactgtaattcctccctcaccacccgcagcgggttctccaatgctttcaggatgtaccgagccagtggacgcctggagggctttgggttcaggcatgtcttcgcaacaatggagactgcccatacctcttctaggtggtcttcatctactacaagtgaagggtctacaatgtttgaaagaccctccttgtcatgggcgtcaataaaatccagtgttcttgccaaccactcctctgaaccagtgtcatttgagccgctcacaccaaaattcccggtgattagctccagtagcacctttccaaagcagtatacatcatacgagcagctagctggtggacctgttaggtgagagatacatacagtaatgttaggttatctttattttgcgcattagaattcctacacaaatagctgtatagtataatggtagagattataaaatatccataaaaaagttatgcagaagctttacacacctgatgcgttcttgtcaagagacctgccacaagaaagagacgaatatcagtgtttaagcaaggccccgatgttctttacagatttaaacaaagactaaagtttcatagcaaacgtgatgttgccatgttaacaaaataacaagtgggttgccatattttatgatctgcaggtggtagggtttcttcttttatttgtgtgggtctggccattaatttacaagactaactcttgatgagaacttcctttttagaagtcatttgacaagaattcatgtaaggagaaacacttacaaatgaatatgtgtccccttatacatactcaaacccaaaaaaaaaacactgccgccatattttgttaacaaaatccagtacattaccttcagttcaataactaaacttaggttaaagtgttaacttcataaagaagttattgcttttgtcttagtactttttagtgctaaaggcacccttaagttagcaccgttcaggtgatcataaaatcaagtttcttttaaaaggaatatgccatgatggactcaattttcagagcaattggtaagatcataagaacagttgtacccatgctaaactcatgcataaaaatgaggagacgataaaatataaaagtcttacttcgatgatctcaacatcctggagaagaaactcctgcttccctcactttgttgagtgcatacatcactcaaacttccaagacacacttcaaatttgtcatcaagaagcacactgcttgcctggatatctctacagttataatgaaaagataaggggaaaaaagattggcttgaaagtaattaaaacatccaagaacttgaacagcatgcatcaaataagaactgcagagtaaaataaaatgaaatagaaagatgaagcagctaagtcatgcagctggaataaaagatgactagcaccaaatacatcgatatttagtgcattgagttacctacaatgattgatgacactaaacctcaaaagataaagtttccataaaataactgcagcaattttttttcatgatagagacatgagtttctcacatagttagacagtgtataatcatataatgaattatacatactgtacagtacttatacttgcatgaaactttcctgatttcctacgatacattgcacatgagaagttgtgaacaagccatatgcacatgaataacaagaagcaacattctaaaagttcagaaaggcaagcagttcgtctgggggaaaatcattaaaaatcaattaagtacagtcagatagtattggtagtgctgatatggatccaatgcaacttggtgaaatagtccgtataatattatattttaaatgtgggatttcatgtcctcacaagtaaacagtttgtcagggaagcttcgcacatattgttttcccctttcagctatacttcttagaaaagaaatagtgggccaactgatgcaatagggccacaagaggctaagtagaagactatcaaatgtgtaactagaaacagttttaaattaatatattaaattgtcctgtttctttcactcacgcacttgccataatcagtgcagcttcttcattaaattggcaattcatgtgagctaaataacatgtggaacttccgcgctcttttttatgatggcgttaatgttcaaacttttcttagcacagttatcatatgctttttgcaattaaaatattttcactaactataaaccaatcagctgcacattatattagcaaattagctaacaggccaataatatcactaggcatacctgtgaaccaatggtggactacactcatcgtgcaggaagcacaatgcctcagcaacaccaatggcaatcttcagccttgttatccaatccaacgagcgcagcccctcctcagcatccactgacttcctgtgcaatgcggaagtcaagtctccctttgccatgtacttgtagaccagcaattcctcctcatctgtggccaaatgccccagcaatggaacaatcctcccatgggaattctttgcaaggaagcccaattcccccaagttcttattactgctcttcagatcaacctttttgacaacaacattgaagccactctccagttcaccaaggtaaatggccccagagtgcccatgcttgacaagattgtcatccccaaaacccccagtaacattatgcaactgctcataggtgaactcatctacaatggtaggcagacctttcacagcaccatttgctgccggtgatgctgccatggatgacagcatcacaggattaacgctgctactcctgcgccccgaacgaatcccttcctcattctgctccaaccctcttcctctcggtcgccgtcccccactcttcatcaagcagaacactaatgctacaaggaaaagaaccaccaaaaatgctgcggctgccaggactccggcaagtacatacttccacttcacccctttcttgcttggtgatggcaatgcatttggtggctctggcaatgaaacaccaatcctcttgtagaatgcttcacaatccccctggcttcgctggcttgatccggacaagcaattcatgtttatgtccactgctccatcggagctgttcccaaatccagttccaatcacctcagtgaagtaatttctcgacaaatcaacctgacgaaatctcttcctgaggggcccaagcacatctccaatggcaccgtacaacgaattcccggaagcgttgaaaactccggttccatcaccggcagagatagacacgtttggtagctccccggtgagattgttgtcagaaagatcgagaaatttgaggcccttgatgaggaacaatgtcgccggaatcgagccggagatgctattaccggcgaggtcaagggtcgtcaggttcccggacatgccaagatcggctggaagcgtgctattgacggaggtggagcggaggtccaagacttccagcgacgccgggaggccggtgccaaaccacgccgggatccgaccagggagcgggaaccccgaggcgttgaaaacctcgagcgccgtgagctcccgcagcgggtcgacggtgaacccctggctccgtgcacccgcgcgggtgcggcggagcccggtgagacggagctccgcgacgcgcccggcgcggcacacgacgccagtccagctgcagggatagcgcttcaccggccagtacttccgccgcaccccgatcgacccgcgcaggccgtggagcgcgagcacgttctgcctcgcgagcagcagccgtcgtcgtttctccccccgcgcggggtgggacgcgacgagcaggagaaccgcgacggcgacgaggcagcgcgggagcatggggacggacgaggaaacagcaccgcgcggcagggtagaggagaggagtggcgtggcggtggcggtgacggccacctcatggcgcgggcgcggcggccatggcgagagcgggagcgagcgaagtggaggtggaggtggtggcgtggtgcgcgcaaggtgttcgcctttttgggcggcctcctgcctgcctatttcggcttccggcgagttgaccacgcggagcccgcggggggacgcgggtggagaccaccatccccccactcctcctcactgccaagtggaccccactgcgaggccctcccacttcactaccaagtgggccccactgggaggttctaaacgacagatggtggagtctgaccggactggattcccaccccccgcgtgtgccgctgcgtcactggcacgtgggccatggggtctgtggggcccacgtttaggtcgccttgtctgtgggacccactctttactagtgcgcgatacggaatgttctctcgcatcccacttcgcctttttttaggctcgtgtcgttttcggaaaggaaagctcacgaaggtggcgtctcgatcagttttacacacacgataagaggaagcgtgccgctcgtcgtgtcatcgtgttcgctcgaggttattttcttcgaaatgttataaacatttacacttatgtaatttgctccacttatttcgtatggttttatagatagctgtcattttacttgacactttatatatcttctttaaagagtaatttgctccacctgttctaagaaaatcgttcaaaatgtctagcacacgagtgtatatgttactcttactcagtctacgacggcgactcgagagagcaacatgataagttcacaacctggcaactgcacgtggaaaagtagcaatggaagaaacgattacttattttcgttaccggctgaagctagctatatctagcaagaattccaaactcaccactcgagcgacttgtggtaaattccgtttgttgtgtgtgcgcatatagtatgtccgagcatatagctgtcagtcgacgaatgattttgatgcgccgtgtcgccgaatgatccaagttgtgaaggccgctgcccggtccaagtcttcacctgggtcgtcgagattgtttgtgtacatggacgcttgcatgattggccactccaaatgccgacaggggtgagagtgagacgcgcacgctgacacaacaccaaaggcatcaactctaatcaactcttcaccagttacaattctagttatatttcattaaacacctacttttgtacggaatactcccaacacaacagtgtctggaaaatactagtgcagctagtttacgactaaacatgggtgcacgaacctaaacatgtattccttttaaccccaaaataatcaaattattcagattttatatactactagtaaatatactctc

SEQ ID NO: 22764 - DNA, 7779 bp, Oryza sativa
  unsure (1)..(7779): unsure at all n locations
nnnnnnnnnnnnnnnnnnnnnnnnnnnnnnnnnnnnnnnnnnnnnnnnnnnnnnnnnnnnnncagctagtttacgactaaacatgggtgcacgaacctaaacatgtattccttttaacccaaaataaatcaaattattcagatttataatactactagtaaaatatactctctccgtttcgaaatgtttgacgccgttgactttttagcatatgtttgaccgctcgtcttattcaaaaaatttaagtaattattaattcttttcctatcatttgattcattgttaaatatatttttatgtaggcatataattttacatatttcataaaaatttttgaataagacgaacggtcaaacatgtgctaaaaagtcaacggtgtcaaacattttgaaatggagggagtatcttattttatatcagtttatttatttcaggacgaggagtagcagtactatcgttctaaaataagtgtagttttgtattgtttatgttcaatgtttgaccgttcgtcttattagaaaatttttttatgattagtatttttgttgttattagatgataaaatatgaataatatttcatgtgactaatttttttatttttttattaatttattaaataagagggacggtctacctatatatatcatcgataaaagaagcttcgtatgtcacgtcggcagcagtgcccctctcggccagcagccgaccagtactactagacgtgagcgtcagcaagctagctacagctaggccagtgaccggagtggtcgagtcaagcttgcaatctgcgactcctaccttgtagttttacctggaattccatcctgcgcgtcacggtcgcaatactgctcgttcatattatgcgtgtttgtgtgtgtttttgtattcccttctcgtgatcggataattaagagctttaagacgtgacacggcaggctaaaaaggacgttccggaccggtcaaaaactatttttcgttcgtggggatggcattggctggcccatggaccagtctaaacagtgtggtacagttacacacatgggcgtgttgcgttaggcttgtgtacgcgttcgtgcggccaagcgatacgtgtgggagtggcaacggtttgatgtcgatattgttcgtacactcgtactaccgaacgcagcagtacggtgcaaagttgttgtttgaggactagtacgaccgcgaggacagggatcatctgcagataatgagaatcccataacgaccgcgaaacattgggtgctccaacacatggtttctgtctgagcatggttatctgatactccctatgtattttaatatataacgccgttgatttttcgaccaacgtttaaccacttgttttattcaaatttttcgtataaatatgaacgtatttatatcatgcttaaagaacatttaatgatgaatcgagtcacaataaaataaatgatagttgtataaattttttgattaagacgaatggtcaaacgttagataaaaagtcaacgacgtcatacattaaaatatggaggtagtactaggctccagtctggtgtttggatccagagacttaactttagtctctgtatttagacactaatttagagtattaaatatagactacttacaaaactaattacataaatgaaaactaatttgcgagacaaattttttaagcctagttaatctataattagagaatgtttactgtagcatcacataagttaatcgtgtattaattaggctaaatagattcgtctcgcgaattagtctaagattatgaataggttttattaatagtctacgtttaatgtttataattagtgtctaaatatccgatgtgatagggatttaaaaattttattcccatataaatagggtctcaatccatttataaatagtctacgaacttgaactcctaaaatatgaccataaaacttttgaaaattgcataccctctctatggacaacagcacaaagtaaatgttgagggatggcgagacggtgttagggtgggatagatccactcttctccaatgcggtttcttcatgatcgtggtcaaaaacaagtggatgtatgtttcaatagtacaattatgataagggatacgagggattgttgttgtataaggaccagttaaacaagattattgcaatattattggtggaaaaaaaataaaacggattcgcttaatatggtgtttccgttatatccggaagactgttgcaactggacgcacgtggtggagacgcctggcgcgggctgcgcggcgcccgatttttctcgggcccatcgggcatttgacgcctggcattttcgtgttaattgttattagtcgtagaacaaccaagcaagcataaaacgaaaaggaaaaatctgtgccaagcccacctgacttttagtttagagtggcctatagttgagcccatctaacttttctgggcctgatgccctgaccaatttctttgtcccctccgcaatgtccaaatctcatacagagcccatcatgtacgaaaccgaagcactcgctcgttatccatgtatttccatttttttttaataatggagtaatactacaagggaaaggaactagctatgtctttgtcgacaaatccttgggtcaaaatcacccagattttttcctaccgttagattaagatccaaaggacacaaaaaatgctacatatttttttctctgactagtcagatcacaaaactacatgggctcgaattctagcccatagaacaatacaaaaaattatacaggccataactgcaaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatctatagtcagttacagttacaaataacaaaagttacatatataactacagtacatctaaactgtaactgggctgtaaatggaatcattcttaaatttcttaaaaaattcagtacttatactgcgacattaaaacatttccccaattataacaaactctaaattatgttacaaatatataaagagttatctatctatagtcagttacagtgagaaataacaaaagttacagatgtaactactgtacatctaactataactgggttgtaaatggaatcattcttaaatttctttaaaaattcagtattcatgcagcaacattaaaacactttcccctagtataacaagctctaaattatgttacaaatatataaagaactatttatctacggtcagttacagtgagaaataacaaaagttacagatgtaactacagtacatttgaacagtaactgggttataactggaatcatcctttgatttttttttaaaaaaaattcagtactcatgcactaactttttttttgcctatgacaaaatgttctaaattatattacaaataacctaatcatgtagggtcacgtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatctagcaaaaatttatatacaacaaattagagatagtagcatgataaatttttaaagaactatatatctatatccagttacagtgagaaataacagaaattacatatgtaactacagtacatattgactgtaactgggctttaactacaatcatgcttgaatttcttcaaaaaattcagtactcatgcaacagcattaacatttttttactattatgacttgttctaaattgtactacaaatgattgaaacatgcaacgcctgatagattagaagctcaagcaaaagtgaatacagagtcaaatagatgtcaaagtgacaaaattttctcagaaaaattaataagcaagaagacacttgaaggtgagaacaatggacagatagcattatgcaccaaatttgatcttgtcagtcataaaatctagcacaattttgtatacatgaaagcatgatttttttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctatgacagctttcatgcttgaatttcttcaaaaaaattcagtactcatgcagcagcattaaatattttcccctattataacaagttgtaaattatgttacaaatgatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagataatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaaaaataaagaatttcttcagaaaaggagtcactttgtcacaatggactgaagattttcctcaagtgaaaatcatcttcagacagtggtgtttaacaaagcacaacaattagattagagcctaggataaaaaaaaacagagcattgtggtccaaacagtcatatctctagttgtgtacaaatttgcccatatattaaattttgtacataatttgcacatatctcaaacttctgtgcacatatattaaaatcactcgacaacaagatgtgacaagttagctgatgcagaagggaatggaccagaagggaatggaccagacagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaactgtgcaatagcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaagcaaatagtacagtagaatacaatctgaagaaagcagaacgcatgtaggggtttgggtttaatttaaccaagcaactcagcatactgggaaatcaaaccgtacatctctgaaacgaaatgattcatatgctgcagaaggcaacacaaaacatacttggggttcagttagcatgcatatgtaaaacgaaattcttcagatgcataagaattcagatatatgcagggagttgacagataaatcatctctgaaacgaaatgctttacatgcagaaaaattcagactcatgcaaggagttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaacccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatacgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccctagcgagcgcgcgcgctctctctctcccgccggggagctgctcgtgctctctctcgccggcgagctctctctctcgacggagaaaacgagaagagaaaagaaagaggagaaagagatgtagagaaagagcgagaataaagaaagagagcgaggaaacaaccaacggttacggacataatagcgcggaatccaaaatttaacatggattggcccacattgactcccaggccatctgctcacaggccacacggtctcatccacacagggaaatgcacgaatcatggcgcaaatcctacggatagaaaaacgacaaatattgggggtgaaaatctgttgacaaagatctagcaaaatcgcaagggaaaagtagatacgtacttttttgtagtactagtaacacaaagacaagcaatacaagacgtataatcttagaacgcgatcacgtggatctgggatacttgctccctggggctatacatgaatgcatacaactatacaatagcagtactcggctctgtcgatctctggctctctctgcgttccaagggaaacgacgccttcgcaggtacggcaaaaatcacgacc

SEQ ID NO: 22765 - DNA, 6436 bp, Oryza sativa
tgcacgacgcgatgatcctgtgcgatcctactggtgtacagccggcacaccgtttattgcctcccacccgtgccgccccgcgcgtcacgtactacacagttcgttcggtcgttcgcctcgccctcgcttcgaggctacgcctcctctcgctcgcctcgaaccgcactcaatatccgccgacgcccacggccacggcggcgaggacacaaacccgtgcgccgcgagttaaatgccctcctccacatcgcgttcggcctctgcgacgcgtacgcagcgcgtagcggcgtagcacgcttgcgccgtgcgggcggaggaagcggatggcgcgacgtagtacgtgtggtgagcttggcggtgaccgcgacctgtggctggggattggattgggccaagacgttggaagcttggaattttggagaggatcccaactgctcgtggtcgtggggcgccgtcgccgtcgcggtcgcgggctggtacaactagaacaggtaacggaacgacccggtcgattagttgccgtgccacgaggcggatcgagtcggtttaatttgtgccggtgggtgatcgacccggtgcgccaacctcacgagatgagatcgcccgccgtgctgcctgcctgcacgtagtacggcagcaaaaataatgggtttgtgatgctgccagtggcagcaatccagacgcgatcttcgccagacggtggacgcggcatctcttctcgctagtacttgtagcatgatcccctctctccaagtgctccattgtttacgcgtccaggaagatcttgtcctgctcctgttccctgcgccgccacgagctcattcgtcaccggcacctgcagcccatctcccgtagtcacatggtcggggactcgggatgaatcgatttgtaggcttggcacggccatttcttgggatcatgtagcctgcagacactaatggagtgaactcaattctaccctccgtgcactatgtctgtgtttcagcaaaagagcaaaacaattgtgagaacccagctggccagttcgtacttcgtaccggcataccgctactattactgccaccgacatgggcacagcacctcgtcacacacggggcattgcgcggtgtgtggtactagtactactaatactgtgctgccatctcatcgcaggaggaatccatcatgctatgggcctatttagaagtcaccctaaaacacatgcataaaatattaaatataaaattaaaaaatagctaattacacatattgtgaataatttgtgagatgatttttttacacctaattactacttgatttgacaaatgtggtgatacagtaaatatgtgctaataataaattaattagacttaataaattcgtctcacagtttattaacgtatatgataccctatataataaccgatgtgacaccctgaacaccctctgttagcagtggctgccaccgtcgcagaaactgcaggaacagatgcaatcgacaatcgtcgacaagaaacggaggcatccgtaccttacaccagcagctaatattaatcccatcggggcgggaaaaaataaagaaatgcagcagaaagggaaggatatgacactgctttgctcgctagattccgctgagccatgattcgtggttgattagcccaatgatgaacttactactctttgcctgcgtggcgatgattcggcgagtaaaataaacggggatccgtggcgagtggcggcaaacggccaaagtgtgtctctctctccaaccaccgcgtcgtcggcaactttgccgccgtggcgtggcctccccgtgattgaggtatgcgctagctggggcctccgccgcttcgtctccgtgcgcgcgcgcatgaacgcgacacgagccgtgcttgtttgcggcaattaacgggggtatccgtttccggtattctaatcggagcgagtgagtgcacgtatcttgaagggtgtgcagccgtgcaccgtctcggtaggctttggccatggcagggtttagagcaggtaaaaaagctgactagacgaactttaaaattatgccacatcatcatatttctatgtggagaggagagaattgatgagagaggagaacgaacgacaaatctatcacccggcgatagctctctttcccatgcgctactgctagattgcagcccaactcagcaataaaaaaacacgatttgtggacccccacaccgtagccgatccccttccccaccccaccgagcaaaatgcccttccctctgccccaatgcccagccgtgctcgctcgatctccgcccctcctgcgtgatgtagatgtgcccacgcgccatctcttctcccatgcgcgccatctcttcccttcccgcgcgcgaagatctcttcccctcccgacacaaatccaccccaaaaaaatcacatcttactattttgccggcctcaaaaatccggtaagattaacacaaatccgccccaaaaaatcacatctcactattttgccggcctcaaaaatccggtaagattgacacaaatccacccctattatccgctttccctcttcccctcgctaatctctcatgcccgctaatagattattatcgattaatctatggtatttaagttttatttttgggaatatttgagttaatgtcatgtagtaatagtgccttgcaatttttgtactacagatattttggttgatatggtctctaaatatgctctggcacaaatggctacaaggatgcaattcactcttgatcatatacattgatatgtactggttataattaactatttgattatatggtgtagtcagccaacagacaatctattatactagtagtcggcttaagcaatggactattagtcagcaactggctatactattagccttgctcttaaacggaggagtgagtcagtgaggagtaagccaagagctccaactccaaaatttagattcaagagttgggtcctgagtgtagttgtggagttgcctaaacccagctccacatctatagtttattttgtgagagagaactccaccaaaaataggagcggagctgcgccaaacaagccaaacttacattttactccactcctgtacattttaaatcgatatgttcacgaattgttcacggagtatcaagtaccacctcacagttttaggtgtggtgtgtccgtcttctatggaataattaactacttgctactcttacaagttgtgataaaggatttaccaccggactaacatattatagacacgtgaggactcacatgtcatacacagcgagtggcaagttcttaattgccacatcttaaaagtgacaaatagttaaatgtcacgtgttttactctatttgttttatattataagtcatttttttcttctagttaaatttttttaagttcgtagaaaaatatactataattttaatacaaaagaaacatattattaaaatatatttaatactaaatttaatgaaactaatttggtgttgtagatattactaattttatctataaacttgatagtatgacctagataaagtcaaaacctataatatgaaatggacggaacagacggagggagtatgcaattgtagaaaaaaacaaacattaatacacgaaaatgttgtatcctcttcgtaccagtttatttatcattctagcattcattattttttagaaaaaatatcgttctcacatttcaaagcatttttaatctattcatagataatagatatagccatactagtactgctcatgaaaaaattgatgcttgcatcagaaagatggttgggacgtaactaatgagggtagcagtgtagtttgttgcaccttctaatttagtgtgagattttctaaaaagaagaagtaaatctaacaaatcaaaatgaaagtagtttttaaaatgaaagtagtttttttttatctcttcaaaaaaaatgaaagtagttttttaattgttatcccatgaaaagcagatcctctaacttattatcctctgactttaagtggctgacatgtgagctccacagcttatggacccacatgtacccatgtcgcctattccatggagatggttcatatatatccgctcttctattactatactctttttcggttagtattccttttccgatctttccacttatttctttttgactgagaaaactatcagggctttgcctagtagtgtaatttcattatagagagaaaatacgtacaaggttacaagaaaaacactaaaagattacaaagtttgcaaccagtccaaaactatttgctttaaaggttccttcgttctgcaaacaaagtaatcatccaaactaaaagtatttagaaaagaggcctggttacttcacaaatggaaaatccggttgacaatacgcaggtgtttaaaaatactcaaaaggaatggttgcactccatgatccaattggtgttctacgtgctgacatgcgtgccaaattactttgaaaagtatgatccaagccgtgcgtgcacatatatatgaattgttttggctccatggccatttgacttttgaattttcatttgaatgcctccggtatctgaggcttaagcataactaccagaagttttcgttgttggggcttttattttgttcacacacacgtttcaaaaacttcaccgaggtatacattgctttcatttggttgttgttggctccacgtgcattcaacttctgaacttcgtgtcaaattattgtttgcctgtgttgatgccttgaagacatgaaagcacaaacacaacaaacgagtcagttttgtagttgggtgtttttaattatttcacgtacatttcaaaatttttttagttcaagttcagaaggcgggttggcagtggccagtggcactgcatctccagaaagtgaacagttctatcggtccaccagaaagtcgtgcccatgttaggtgcggcacggaggatgccactaatgcaagaaaatgatatttgtaaaaaagaaaaaataattgtgcaagcaatttaatgattttgttgacgtgttcgtttcaaaattcaagatgaatagtgttcgtgatccggaccaaatctcaatgattgtttggtgcatccagaagcaggttagatttagcacggaaatacaagatacaaaatcaaacattcgaggttgtagctagcagtacactggacggtgctattcgatcgatcttcaaatagggtacccaatcatcaaagtatcaagtgttctcttattgggtttgtttttaaacagcgaaacttccagataatttacccacaaaattagtattttccaacggtggcccacaaaattagtcaaactcaaagtataagcggtgttttaaaactaatccaatagattcgtaatttaaaatactttcccccacaaagttgattttatacctattatgaatatatttatgagaaattgacattaaaatttaatcttggatttgtccccaaaaaagatgctcctcaggcatcagcatgcgtatgagtgcaagattgcgtccacgggagcaacttccagatcccagatgatggctattttgatggaggaattaatttagcatgcagttatgaacgtgaccaacgtacgtcaacattaaacttaaatacgtactcctccgttgattacacgttactgctgctttcacaaccggttaacgtagggcttattaaggaggcagggcaatcaaaaggtactaattaaacatcatgtcattgttgtttgccaccagacagaaatgttttttcgtctaaaaaagaatcatttttcttcgcacaaataaacagtaaccattgcatcgaagtgtttccatactcatctatccgtacaaagaacacatcaaaaatgcatatgccatgattaaggatgcttctttttttattgtaaaacaatatattataaagctgttcagatgaaatgggtgcggctatggttgctgcagcctgccattgcattgagatgtttatgacactgttgatgttggctgcggcacaacggtacgctgattttctataccactcctaaatccgatccttgcattttgggagtaatccacggatttgggatttttcaccgatcagtgtgtagaatccaatgtcaatgtcaggtgagggggcagcaggcagaggatggcgccatggcaaaggcatggaggagtttatcaccatggtccagaggcgccatggatgttggatgatggttggtgcagctgtgtgctgtgtgggatgggagggaggtagtgtacggcgtcgtgtaccggagggagggaagggaaacggaccgttggtgagggtgggcccggccctgcgagtgggccccacacaccccttttctgttccgtgtcgtcttcttcccccgcgacagctgccgccaattaattattctaccaccccattaaaccacctccacccttcttcttgttcttccttccacttcccccactcg

SEQ ID NO: 22766 - DNA, 15109 bp, Oryza sativa
cttttttgtttggtgggagctctcgagcgaaggttcctggcaatgccgagcatccgagctccggcttccaagcagacggccacgctacaggtagattatagatccttctgcgatgaaacggatggaatggagtaatttctcgcgattcttgattttttgttgggatgatgctgcttgctctgttgcttcgatgtgtaatcatgtgtctctctgcaggtggctgtgaagtgcaggccactgacagacagcgagcagcggcgttcgcggcatatcatacaagtcattgatgataaggtgcaggctctagtttagtagtaaaatgcgtaatttgttgtgcagttgttcagttggaattctgccagattgtgattgtaatgtgttgcctgtatgttttttgccccccagaatgtcgttgtgctggaccctgatctgtccaaggactaccttgaactcatccaaaacaggaccaaggagagaagatacagcttcgatcatgtgtatgcgcccgggtgctccaatgcggtatgcaggctcagatagattgtgatgctctaaactggaactgctttgtctgttaccaaatgggctcatatgctgattacagcaagtgcttggaactgcaccacagtttggaaattcctgaattgttcataactagcatgttaggaaatgatgcccctaaaggccaaaccccaacctacttctttggatcattaactgctaaatttaggaggttctcgtgctttgtacagttgaaacaatactgttggtaccaacaaaaggccaacacgaagtatttgtactattgttcagtctggagcaatccagtatgtactgttactagtgttaggtagtctacctaacaaatacatacgtctggttaagggaaaaggactgtagtttagttgttgtattaaactctacaacctagatcttcttaggaaaacctgcactgtaagcatgctttgcacgcttatacattaacttcattgctccaacctttaatacttgcaactctgggtccctgtcaaaaccagtcttcctgacacagttacagtattcgacaccacggccatcttagatatacacgacctcttgtgcctattgtattaaggtctgaaaattatgtaaggtagtgagttaccgcacatgtcttgtgtttatttggtggaccatacaaccatgagagcgctgagcgcaggagcgccaaattgcttgtgtactaatttattagcctgtttaaagcaaaatccatctgcaaattttgtagtcagcaagatcctggccggaaacaagaaaactgactatcaaatggtagcaacttattctaccatatagcctatcttattattgtagtccaacaggtctacaaaaataattatctttttcatagaaatacatccctattttttaaaaaaaaaacaagaaaaaaaattcaatggcgctaaaatgctttatgttctatatctgacatctgtcagtcacattcatatagacaagatgtacaaaacataaataattgtgtgatcattggaccatgttgggctgattaatgaagacatgtaaatgaacatatgctctgtaaataaattttaattatcttatacataattgggctaaccagtttgcaattatatgctaactggtttgcagttatgtacaaatgttttcttgaactgcagttgcctaaaactgtaagtcttgatagattttgtttttgatcttgggagcttttcagtatctatatttccattactgaaaaaatgtatgagaattacaagatgagaatctgttgtgtgcgcacacgtatgcaccagcttgcttgcttgttaactgctgggggcaaatgccatgttctcttgtactccactatcacattttaagatcgtgctttgataatgcaattacattacttgtgcaggatgtatataagaatatatcttctacaattgctggtgtagttcaaggccttaatgcgacagtctttgcttatggttctactggaaggtacatgctcactggatagttttgttgtttgcaagcatactgcctgctgcacatattgctatcatcacacatactgccgtaaatttctgaaccctgaattatctcatttgctgctattgttagatatggtttacatttgaaaaacttgctacactcagttggtatgatatgaaagtgtttcttcaaatcaaccacattatgtttgcctgatttcctcttatgtttttttcctttgagatgcctaacttaaaactattgtgaatttgtgatatgtgatatatactatatctgctgagttcacctcatgccaattgtaaacaaaatcatgattatgtttagtccattgccattcttgttttgtgaaacttaaataaatgctaaaacaaactgagaccatcctaccttttcagtaaacttgaactttggtaagaaaggcttctttagtttttttttaatcatgacataatatgaaaaatatgacttagccactttacggagcttccttggtgaagctattatactatttgggcaagttcatttttcctttttatgggaatccacgctcatcattgtgtccattaataatgaagttttacaaatacttcaatactgatctagaagctgaaatggctcttattagtattacgcttcatatgcataatgtgaaatattctgttatttgtgattgtgcagtgggaaaacttatacaatggttggaacccatagtgatcctggtcttatggttctgagctttcgcacaatctttgatctggtaaagaaggatgacagtaaagatacgtttgaggtctcatgttcatatcttgaagtgtacaatgaggtaatgtgcaatatatagtttcttaaaaaaggtaactattagtccttaaattctctatactacatataaactttcgtgaaaaaactctgtgctttctgaattccaggttatctatgatttgcttgaaaaatcgtcaggtcacctggagcttcgtgaagatcctgtgcatggtataatggttgctggtttaagaagcattaaggtttctagcttcctctaatctgtttaatttttgtgataattagaaaacaaatgccttgtagtaatagtgtcaattctggcattttttgttttgttttcttcatatttttttggccatcctaatgcttgtaacctcttttgtgcatataatatcctctcgtcattgagccaattaaggaagagatgatttttaagttgcactatttaatttatctgcatggttttttttttgtcctttctggaagaaatacttgtagataccaaccctttcagacttcttcagctatttattcatcttttttcttttaatgattagttcatacaaccaatttctgccctttgtaacaacagcaagtggtctactgtgtttgcatgccattcctcatcatattcgtaaaaataggcctagtcaacattccattcacctctacatataagaatattttgatgatcaatcttttatttgcttaggttcactcagcagataagattcttgaactcttgaacataggcaacagtcggcgcaagacagagagcacagaagcaaactcaacttcttcacggtaattacatattgtgaatttccttctttcctttctgtaagtagatgctgttatggccattcagcttttgaagaatttgttgatatcttgcttagcaaaacaatgcatttctatctgtttaatgaactgctatttaaggaggatacttaatatcttaatctgatgtatcactgagattttgtttctacgaagacagctgctgtaggacgtagtgctggacatctttactacattctattaataagatttatcctttttttttaaatccaaggtcacatgctgtcctggagataactgtgaagcgaaaacaaaaaggacaatatggtagtcaggttcttcgtggaaagcttgcgttggttgaccttgcgggcaggtaatacactaatacctactcctttttggattgtttttctcatttcaccctgctaagaaagtaagctataaagcaacgcttatattataacagtgagagggcctctgaaacaaacaactttgggcaaaagcttagagatggagccaacattaaccgttcacttctagcgctagcgaactgcatcaatgcccttggcaagcaaaacaagaaaggtcttgcatatgttccatatcgaaacaggtatttccattttcaggtgtatcattctggaatccatcgttttaaaaatcttagttatatgacaatggtactctgcagcaaattaacacgaatcctgaaggatgggctctctggtaactctcgtactgttatggttgctacgatatcaccagctgatgatcagtatcatcacaccaccaatacactcaagtatgctgatcgtgcaaaggagataaaaacacatgtccatgtaaggggccatttcttttagtctgcataacaaattacaagatgctgtgtctatgtagtcatcactattctcacccatgcaaaatatttaattggttctgaatcataaatgtgaaaaaaccagttcttatgttgtttgttgtcctgtacagaaaaacattggacatcttgacacccatgttgaagactacaaaaggatgattgacaatctccaggtttgccttactgaaaaaacacaaatgaactttctacaattctatcagcactccatcacattaaaatatgttccattatgactttgtaggttgaggtttctcagttgaagaaggaattagctgagaaggagcatcagttaagtgtaaaacctactgaaaaagctgcagacaatgagctatcttggctaaatatcttgagccaggaaactggcgagaatgttcaagaacgcattaatctgcagaaagcactgtttgaacttgaagaaaccaataagcgcaatcgaatggagctccagcatcttgatgatgcaattgcaagacaacaggttgattactcacctattcagtttgttgacaactcaaaaaactactcttttacacactggcagcttacaagcctcttccaatcagaactctagttaatacctgtagtgcaacatcaataagggaaatactggttgtcatctttgagatagcataactaagaattgtattgtggcatcgcagactgttgcagctctctaaaccacatatgttgttacaatagtatctcagaaattttctttgcagtgtacagaactctgatgaatttgtgttcaggtgaaagataaggattcggctgttctgcaagcattaacatcacggagacaagttattcttgacaacatacgcgacaatgatgaagctggtgctggctacagaaaggtatttgtaatataaattcggattgtcctttgtttttggtttcctcaaaacaaacttatatggcaaacactatgtaggatattgaactgaatgagagtcgcaaacgtcaactccaagatatgatcgaggaagccaccagtaacaatggcaacagaacctacctccacattctcagtcagtacagacttcttgtgagtaaccaccacattttagtatgttttcctcataatagttgatactccacaatctgcttatggataatgtgtgttttaggggatgactaatgccgagcttcaaattgagatggctatgagggatcaagtaatatataaccagagggaatctctaaggagtctgtggaacattatttatggaacagggctaaaccagaaacagatttctaaactagctgcgaagcaaggcttaactatagaaggctgtcctttgcctgtgtcaagtcctgatgttactaccccaccttccttttcaccccatggaaggctatcaccattcatgtcatttcctagcccgcaatcacagccttattccccgtctgcttgctttgtccaacatggtttcagcaccatgtcttatctcagaaatcaacatgagacgcctacagtatgtaggcaggagcacctcagttcttactacatgatgtctgagtgctcgccttttgatggtgatggaaaacagaagacaaatggaaggtcaatgccatacttttctaccccgggaaaaccaaaagaaatgtataacttttctcctggaactgaaagcgagagaactccctgcagtaaggaataccccacctcatattctcgcaatggagattcgcttgtacaaataaaggtaaacagtcttcccttatacacaaaaacaatgattggaaatctgtaatgcacgtggtcccaagtagacatggtttttcatgtagtaagagaacctaaaatgaaaaaggaagtaacatcaacttaaataagcatagcattccaaatgtgttactagcgcaccaattaaggtaaaaagaacaatgttatctcaaacaacagaatatttcagaagtgaaattgcaacttgtcttaatctgcaggattcctggtatacagaagaaaggcagtgaggaaggaaggacatcatcagcactcttccattgcacattatcaggccggacgtttgccactggagcccgttcctacatcttctgccaacaggcccaacaccaatgttaccctgagttcatgaaaatgcttcagtttagatgttaggatatcagccaaagctgcggccatgaggccacggccattttgatcttgatgcctctatgatgaaccccaagatggctcactccaccctgtacagtagctgttagtctccagtctttcttgagtttcttctcctttgtacagtagcttttctgtaggatgaatccgatttttcagaatgctgtaagcatgtaaatctgctgtgattgtacccctttgcacccatcaaatcaacagaattattccaagatcggtctcaaaacactgatgaaccaaaatgagtactacttcagcagatatcagcatcactcaccactgttcacatcaactttgtgctctcttctggaatgcaaggcatgtgcatgttaattgttcttgccacactgataaatggattgatcaacaggacacatggccgatgggcacaggcatgtgttgtgcatgggctgctagttgttgcaggtaggatctccatctcctccggatcattcaataacctcctgggcgtcactcacctcacctactctggagaccaccattcatgtcagctcaggtaagctggtaaggtaacccacaagcaatggtcccggccattgccatgctcaattcattcatgctctctcagtctggttgatgaatgctacgctgcagctgtagctgcagcacggcgagcacattgcaactgcaccaaatgccatatccacaatgacagccagctggggcttgttcagtctggctaccttcttaactgaatgactgacaggttaaggccctgttaacttcgtgtgcaccactgcacaattgctaagaacttggggccgttttggatccctctaccctgtcaattcttcggtttactgttaacacggagccaagttttttttttttttaaaaaaaagaaagcaagcttttattgaaatcaagataaccatcttgatatcactcccggcctgtagtctaatatggagccaaattgtgatactgcgatgaagaatgttattgatactatcaaatttactatgggcattatcaataagtaggcttcaattaggatagtacatgaatacatgattagaagcttgatagcactgtccgcatgcgtcacgttcattttagcagtttaattagctgttagtcgtcttggcctgtcctagtgagccactatcgttgagacagtgagataagtgtgatgcatgcgacagggtttcttctgggagcccagccacctgcattctgcagattgcagaattcagacacctaccgtacgtaacagcgcggcttccttggaaccacgtctttgtcacaattgccaaggcttcattgcatatgcatcgtgctactaaaaatttatagtaatttacttaatcaatttgtcccatgaaaatgtgatggaaattactgtaattagccacagataaaccatgtcttttatctgattaattagaatgcttggccattaatttctctatgagtgtgaatgcgtactaggggttggcaagggggacaaattgcacccaactcggagcttgcaagtggcgaccctcactcacaccaaagcacaatttttactttattttgctaggccaacaatacgccatcacttttgtttacttccacctaggctctaaacaacacaatcacaagcacaccctaatcaaggacataattgatcattactacgttgaaaactttggctcaagcattagtaccatttatcaaccccaaccttcagttcattcaatgggtttcaaacacaagttcagtgggggtaagcactagtaccacatgattaacacttggagattgagataattaacaagggaccatatgaggaggaggagaagatcagaagaatccatggaggtttttgatggaggtgaccactcaccacctagaggctgcatgctttggggccatttttcacccatggtcgcctactacagtagcagggagaatctctgaatctcctctcttgtttcttttcaccgatctcaaggcactccttcacatggctgtgtggggtaaagggccttggctggacctttcttttactaaagcagaggcccataaaaacgcacaaacattttgattttgagttcatttgattatctgaaggtgattaaagatatcaatatatcattccggagtttagacttcagaactcaacacatgcagcttaaagatagggattgggattcggtgacattccctcgtgacattctcggtgacattgagtgactgacatatggcacttatatgtcagtgacttaattgtaccgacccatatgtcagtgacacaatgtcaccgagaatgtcatgggggaatgtcactgaatctgcgttcgatagaggcaagttcatgtccacacttcaaagatctaattgttttagataatagaaatgtcttacatcctgaactataccataaaacactttcttatccaaataaaaaggataactttaaaagaaaaccagctgataggctaaaagaccacattgattacatcaccatagtgaaatactcttaaactttatagatctaataacagtgggaatactgtaatagaacatcgtcatcattggggttaagttattaatccccggtgattaaggggtgtacacttttgatcagcaaacgagctctgcaggtcctagcctttcctaatttcttttcttttgagctgtgaagctcagcctttgtggttacttggtcaatttctttatgcagtgcccagttgcccacgtatcaactgtttagcatctatgcttagagcaagtctaacagtatagcccactactagctccaattcatatatagccgatataatagctaattcatacaatagttgcttactatactattaatatatggttccacctgtcatacatacagtgtgtcttggagtccatgctgcagctggctacagatctgtagcccgctactcttctctctcatcgtttatcttattaaaatatatttatagctggctaatagcctgctattgtacctgctcttacagttcattagccattgattaaaatgagagacagaaaaggttattctacagaagtggtggttgttggtcttggtgttctctgtgttgcagttgcagaaacttggtagactgacgactgaaatacgcgcatccctcgtcatcagattaagctatgcatcactccaattcttaggctacctttgggaagaaattttaaatggattcaattatatagaaaaagaaactctgtatggtcatttggatttaaaaacatagcatttggatttaaaaacatagctattcaaaaatcctataaaattccttcagattggctcgcaatatagggatttgaaggttttaaaggagttttaaaatgaagtccaaccttttaaaaaaatctcttatgtctattctctcatctaattcttacctttttttttcattccatccaaacaatcatttctatagtttttcacattttgttttttttataaaaaatcctatgttcaaaaggagccattagcatcctcttgttaactctggatcagtggatgttaccacagtaaatatgtgcagtaataaaaagggagtgctttttttttttaccgcgggtcttggtctcctctccgcctagtcatcgccaatggcgaaactctaaggccatgtttggataatgggtttgggatatgatttcccacccctcaaaaggtaagtttcaattttagccatccattcttctcatttcatttcatcctatccatccattcatttccatttcccaatcccatctctcttaacccattatccaaacacaccccgaggaatagaacagcgaagtaagctggcaatcttggaattacgcgaggaaatggagagatggtttctgccgctgcgattgcgatgctgcgagggaatgggcaagctcgagaatttgactgtcctctcctctcctctcatctagtgccaggcaggaatgggccccacggtgtcagagaaagaacgaaagccagcagtagaaaagcaatgatacgctcgctgcctgccctctgcctacctgctcgagtaaagcagtagtagcactggagtacttctgaaaaaaaatctgcaaaagaaaaactggacaaagagcaacgagtaaattactctcatgggccctcactttgatcaagttctgaaattgcaatcaaaatcagtaacaaaaactgtaattgcggttggtaaagatggattcttttagataagaaaaaaaagatggactttttagttttcagggtgcagtggtcaagctctccggccagttcttgcaaacgccgatatgtacaccaaggcctgcaaaattaactgcggctctgaaaaaaattgatgaattgcggacagcagctcacggtactattgcgattttactccttttcctcctgcaggtcaacattgttggtgaagttataaagctgctggaaatgcagccttataataatacaatactccgcctgaacaaaacaaatacaaacatactccatatttccaatcaagattatcgttgcggattataaatttgctctgaatgcagccgcttaaatgtaaattgtcagttggtcaatgcacagctgcaagcctgcaacctatagtagtacatgtatttctttcgtcttaaaaaataaaaatgtagtattgaattgagcatactggtatgtccagaactccagatcatagtactagtgttttgatactagatttctatattttatgatagggtgagtactaattagtactttctttgttctaaaatatatatctaatacgaagtataataaatctggacaacctcctatctatattcgttggagtattatgttacaacatatttagttctaagttaacatattttaggacagatggagtaatagcccgtaacaatcctccgaaatccccgtagctggagaagtacacactacaagcagatacacagcatgtactcgcagtaggaaacagcagtatctgaatcacacactgttgtgccatcctgaagggtcaaaattattggtgaagcctgtaaattcgccggccgtggccgcgactttttctgcggcgagtgatgaatgcggcccagccggcagcttgcgaagaagcagcagcagcggctgtactgtactctactacagtactccgtagccgaccgatctcgccggcgccggcgaccggcgagatattgttttgtggattggacggtggccatcaatgatcaatctctcgcacgtttttgtcctctaatcagttattactgctgctcttcttcagcttgggagtgttgctgctggtgttgttgttgccgtgcacggagagtgatctgcttgtgctgtttccgcgttggaatttagcgtgattattgcggcgtaatgatggttatgtccgggcttgaagcccaatgagctgctctgcgtcagtgccattatcacgcactgtttgtttgctgcatctgatttggcaaaaatagaaatcagaaaaaaagaagttggattatactccctccgtctcaaaacagttatcgttttagagttcaaaatttgttaccaaaaacttactatcactttagagtaacttttgtcacatcaattacatccaattcaaaatttaattcattctgccctcagctatcctctcattccaaaccccatatcatttaataggaggcactatagacgtttttattaaaccatagtttttgctaaacaatttagaactataactattgcggaacggtcgaacggagggagtactgtactaggtagcattttagacgaaaaccgatcgaaaacaacaaaaatttagaattttgagtcgggacagaagcagattcagtgggacattttgactgtttttttacaaattaaatttgaaacaacaaattcgactgaaatttcatggaattggcattcgccggaggttaggatccggccctcaattgtaccgtgctatgctgctgctgggtgatgatttttggttgctgcagtttttgtgcaggcgtcgctgtcgatctgcttgccctactacgaaagtggaagcctgatgccgcattctgcaaagcagctcggctgccggtgtctcgccgttgctctgaagctttgctttttttttttcctcctctttttctttgaagtttttgctggctcgcgccacttccatgctgccatcgcattgcattcgtcaccccgtctttttcatcggtatccgtttggtgcgcgcatgcgcggtgtatctgaatcctgattttgcgtgtaatttccagagtgagtacattcattaaaattacatgtattatggtcaaagttagagaaatcatatgtattatgatatatgacacataattcaggtatgatggttttataaagttttacataatactacccttatgtattttgagatcgaatttacttaaaattctaaaacatagaatttatatgtaatttttaattattaagttgttgattaagattgacagtttaattctttattacttttaatttttaatatatatgctagaatttatcaagatttgaataaaagtgaggttttatgaaacattgagaccatgtaacttgaggttatattgccatacatcataataccagtggtttgttttatacctttaactatgaaataactggttttctaaagttttctccttcaggtatggatatttcattttatattagctagcagtaaatcagtaatttactttgggatttattttgaagtaaaggattgagaggtgatatttagtttttttttatcaaattattatatctcttggcagctatatatgtatcgtaggacatgcttcggatagtaagaatccacaataaacaatttgcaggaattgtagaatttgtgcacctaagcatttaaaactaggtgcattctattttggaagattgttagagcggccaattttttttagaaaaaaatatttatcaagaaactacgagcgtgctcggttatctgttgcagccactagctatggcagctgctgcagcccttccctttgctacggctgtgctgcacaattatagccagcacaaccgatcaccgcctatttcaccaaatgcttcaaaaatcagggtcattagaatgaacttcaagtagttttgtttccttatcatatatagaacacataccattttttatgtatacaaaattttctaccattaatttatactcgctccatcgaacaacagataaataaacccaaactgagttagctaaatgacgatacataaaacgagataagtcactagtacatgattaattgagtcttagtaattaaaaatagttcatttaattttctaaataaactttcatataaaagttattttttaaaaaatataccatttaacaatttaaaaaacatgatcacggtaatagagtatttgtagaagccaaacaacatctgaaactcagcctaaatatgaggttaattcaataaaaaaacatactaaatttatgataaagaaaacaaaacaaagaataatcatgggtcaaagttgtcaaactgccatatggccatatctatccatccaagacccaagataacattataaaaccaacccaatcccccaaaaagaagaaccacaccccacacatcaccccaccccaaaagaaaacaagaaaaatatcacatcttttttatgaccccaatatcacacacaatcccccttgtggccttgtgtgtagtgttctcaaaaccatagcaaacttgcaaaatacccccacctttccccttccctcctcccctcactccctctcactctcttgtctccactctcctctcctctcctcgccgcgagcgtgagctctcccctctcctctcttccaatccaagaagccaagaaaccccaatgcatctccgccttctcctcctcctcgtcggcgtcgccgccgcggcggcggacgccgacgccgacgccgacgcgctgctggcggcgaaggccgccatgtcggacccgaccggcgcgctggcgtcgtggggcggcaacgggaccaggacgaacaccaccgccgccgccgcggcacactgcgcgtgggcgggcgtgacgtgcagctcccgcggcgcggtggttggcctcgacgtgtccgggctcaacctctccggcgcgctgccggcggagctgaccgggctccgcgggctcatgcggctgtccgtcggcgccaatgccttctccggccccatcccggcgtcgttggggcggctccagttcctcacctacctcaacctctccaacaacgcgttcaatggctccttcccggcggcgctcgcgcgcctccgggggctccgggtgctcgacctctacaacaacaacctcaccagcccgctccccatggaggtggtgcagatgccgctgctccgccacctgcacctcggcggcaacttcttctccggtgagatcccgccggagtacgggcggtggggccggatgcagtatc

SEQ ID NO: 22767 - DNA, 10445 bp, Oryza sativa
ctctccgagctcaagaacctgacgctgctcaacctgttccggaacaagctgcgtggtgacatccctgatttcgtcggcgacctgcccagcctcgaggtgctgcagctctgggagaacaacttcaccggcggcgtgccgcgccgcctcggccgcaatggccgcctccagctgctcgacctctcgtcgaacaggctcaccggcacgctgccgccggagctctgcgccggtggcaagatgcacacgctcatcgcgcttggcaacttcttgttcggcgccatcccggactcccttggtgaatgcaagtccttgagccgtgttcgtcttggggagaactacttgaacggctcaattccgaagggtctctttgagctgccgaagctgacgcaggttgagctgcaagataacctcctcacaggcaatttcccggccgtgtccggcgctgcggcgcctaatcttggggagatcagcctgtccaacaaccagctcactggtgcgctgccggcatcaattggaaacttttctggtgttcagaagctgcttcttgatcggaattcattctctggtgtcgttccacctgagattgggcgactgcagaaactctccaaggctgaccttagcagcaatgcgcttgagggaggtgtaccaccggagattgggaaatgccggttgctcacttacttggacttgagccggaacaacatctctgggaagatacctccggccatctctggaatgaggatactcaactatctcaacctgtcccggaaccatcttgatggagagatacctccatccattgcaacaatgcagagcttgaccgcggttgacttctcatataacaacttgtctgggcttgtgccaggaactggtcaattcagctacttcaatgccacatcttttgttggtaacccaggcttgtgtggaccgtacctcggaccatgccgccctggtgttgctggcaccgaccatggtggtcatggtcatggcgggctatccaatggtgtcaaactgctcattgtcctaggcttgttggcctgctccattgcatttgctgtcggggcgattctgaaggctcggtcgttgaagaaagccagtgaggcacgtgtgtggaaactcacagcattccagcgcctcgacttcacctgtgatgatgtgcttgactgcttgaaggaagaaaacgttatcggcaaaggtggtgctggaattgtgtacaagggggctatgcctaacggagatcatgttgctgtgaagcgtctcccagctatgggccgtggctcttcacatgatcatggtttttcagcagagatacagacacttgggagaattcggcaccgccatattgtgcgtttgctaggcttctgctcaaacaatgagactaatttgctggtttatgaatacatgcccaatggaagcctgggggagctgctccatggcaagaaaggcgggcaccttcactgggacacccggtacaagatcgccattgaagctgcaaaggggctctgctaccttcaccatgattgttcccctttgatacttcaccgtgatgtcaagtcaaacaatatccttcttgactcagactttgaagcacatgtggctgactttggccttgcaaagttcttgcaggacaccggtgcatctgagtgcatgtctgccattgctggctcttatggatacattgctccaggtaaaacatcatatctcatggtatttcagttcgttctgcagtgtattgatagtattgtatttagttgcaaagtaatatttcctctggtaaaagaaatgtaagagtaattcttgaattgctgtttttagttcctcgtgctccttcatgaattgtgttgcttaataatctgacatgtctttgttcacttcaaatggactgaaccttgttggattgtatttttgtggatgtccagaatatgcatacaccctcaaggtcgatgagaagagtgatgtctacagctttggtgttgtgcttcttgagctggttactggacggaagcctgttggggagtttggagatggcgttgacatcgtccaatgggtgaggatgatgaccgactcaaacaaggaacaagtgatgaaggtcctggacccaaggctctcaacagttccacttcatgaggtcatgcacgtcttctatgtcgctttgctctgcattgaggagcagagcgtgcagcgtccaacaatgcgggaggttgtacagatcctcagcgagcttccaaagctagctcccaggcaaggagaagtgctttcacacgctgtcgatggttttgcatccaatcctccagctccagttccttctgggtctgcagaagcactaactggtgatgcgaaagatcaacagcagcagcaaacaaattcagagtcaactacacctcctgatctcatcagcatatgagtaaccaagtctaaaattgctgtcaaccttttgttgcaaagttcgcaagcttcagtatcggaaacttatctaggtatggatttaggtcttggtaagtttttaggtgttctgtgctgtacatattccagtttggtgggttgtcctgttaccagtttgtttcctttggtgctgcaatgtaggattccgtagcgagtttcggtactttagagccttttatcatccatcttcaatgtaggcaatggctttctatccaatttagaatcaaaatctaagctttactgtggaaccaagtttcctttaaagcacttcctgagttcctggtcctgtgtaaacagttcaagttgggtcctttaaattgagaaacccatactagaatgccatcatggaaaagcacccttgcatggtgaacagatatgcactaaatcaagcaaagtcaaagtattctgctctttttattcttttggagctgaatgaaatcaaagaatcagagtgcttcttcctttgttctcttttgtgatgtgtatagaaagctggcacaagaatggttaacaaatgattacccttttgtggctgctttgcataacatgaagtgcactattgcaacatcagattatgtgggatcagcatatatgggggagagaagaactgtgctaaaaatccacgctttctaatgtccaaaaatttttgttagcctgtttggaacaaatatttactataatctttttgcatattgaaatctggagtagtgaaataaattctgttaggaaaatcgctcaaattccatttaaaaaaaatgcaaaatgaaatctggagattgacattcagagatcaagactctcccgagcatgactgccaagtgctggagatagtgctgcgtgaggtccatcacatgatgatgcctctctgctcccctactacaatcattcagcaccagtgcctaacctttttgaagtttctctcctgttcttgaatctagagacatttttgttgttaatccagagatataatatacctatcgaacaccacgaggtacttatattcgaatattggttcttctaaaccttttcttcttcaaatattggattgtcttgttccgaaatgaaaatcccgaaaaatcctcgcaaaagtcggtttgctcgtgaaggaatggacatggtcggctgtacctatagatttcattgtgcgattggtgataatgctaggaggcgaaaggaccatcagatcagatcagatcagatcagaaggagagtgcgacggtattgaattctgacgctgcactgctgccgtttattcggtgcagttcgatgcgtccaacagaatggtcacatcggcaacgagacgaaacagcaaatgttgcacacagtggcaacgccatgtattcacacatgcacaaatcctctagtaattactcctatcactcaagagtattaatgtattgttgctctcaactatctatttaagcaggtaaattcagtttatctgcatgtaatgtaaagtaaaagttcaggagcttacattctgtcaccagctattttgcaggaggaggtgcttctgtttctctatctgtatctgcaaaacaaaaaaaatagagattgtcagctgcgaggttaaggttgttttgcttcatcatggtaggagagaaaaacaaagaacagaaaggttccccaagaatttggtctcctttggagcaagcagcaatgctgtcattactgcaatcatgcaaagcaaacagttctccaactacagcttttggttttgtggctggctggtcgtcagagacgagcaccaatactgctaatgccagcctcagtgtctcactgatgagttactgttcaccacaccactatttaccacagtaataaacttagagtagtatgcttcccctaataaacaccccactgtgtgttgtacatttgcagagtatgttcatgcatgcaggcatgagccacaagtgtaccggtagtagaaagcatcaactcgagattcctctcatctggatccattgctggagcattttggacaagaatacaaggtcatgcaggatgcagcaaaggacttggctagctagctagcactgtagcctcatgtgcctaatgatccagccatttgtactgttttgaacaggcaaagtacacttagattctgaaactaagggaggtcactccaaatgatgctctgctaatggcactgaatccactgatcaattcccataatgtgaggcagaagcaagcctgtaattggggtggtggtccattgatgaacagagtacagagagagagagagagagagagagagagagaaagagagcttgctactgctcacatggtaggggactgggactttgagctgctgccattcttctttctctgaagaagatgtgcacttggccgaaacaagggcctacattggcactgctctagagaacagtgacagggcacgcaggagggaccatttgatgatcaatcgctcacgcatgttcttttgtttttcctttctttttttttgtttgattttcgtttcttgtctcgatcagtctctctcttctgttatgcagatgttggatcggaataataaggaacagttttgtgttcgcgtcgtgttaattgcaaggaaaatgattgctcatcatctgtggattcatggagagacaccataaaccctaggagtttcttggattcagaagtgaaaactcaaaaaggaaaaaagaaaaacgcggcaacgaaaaggacaggaaaggagaaagaaatcgaggggataatcaggagagagaaatttaccaagggaagcgcttggttttacccggattcccgagaattttcatggagagagcggcccagctccccacctccgcctccggcgccggcgccggatcgctcgccgccggcgaacctgctcgacggcagcggagagaaaaggcgagcagcagcgatcaccgttggatacaaaccgtgcggcccagatctaactgaaaaggatgtgctggctaatttactaataggaccctctattatgttgtatttccgtaaaatgcccgcttcagtttttaaaactagggtatacctcgcgcagtgataaccgcgaaattgtagggtgactgtaaccctattcaaaacggttcggtaaatcttggttggcactcgattttctcatgtcatcttgctgatctgcaacaacaggggcactgattgcttaaaatgccagcgaattttattttcccatggagaagttggtagagaagaaatgcagaggcatagttgggacacaaatgcgagttaatctaagaccggacacaagtgggacagggagaatcctatggaaatgatgatcacatcgatcagagattcagaggcgcactcacgcaccaccaaacccaacaactccctctattcacagaggacagaaaagggaaatgcagggaaaagctatagagggagagaagaatcctgcagcattttgcgtcagaaatgaagtcaactcatgctagttctccaaaaaggaaaacagtcagctcatgttttcttctcctccatcgatgtactctttgattggcccatctgatgttctgcaaaaacttcctcagaggcattctccttctgataagatactcacatgatgctcagctcaggtaacctgtctcaagcaaatcctgatactgaaattcagaaaggttatactgctctgttccgactgtttgtccaaaacctgataagagatggtctagaatttatgtgaaccttcatcaaagtttggactctgtctccatgcggtgcagaatcccttaatcaaataacttagacataggccccaattatatgaggccttgtgcaagcaacgcaggcacacaatcggcagcagtaaatgcaagtcaaactgttggaagcctggagcagagcaaaacaatgtgatctgctgaagagatcatcaaatccagattaggccacgacaccatgaaaataagcatgcaaaattgttcacaacaggatgttgtctagtataggatttttattccatgatcaggaaaaaaaggtttagtgcaactaaagggtaattagcatttcacggtcgttttacagaagtgattttacatgtatatgagcccggcgaaaattttacatgtatatgagcactatatataggacactctttacatgtatgcataactttgtcccttcatacacctcacttgttcatgaaatcgatgcccttctgaatgctctccatcagctctttctttgccatctccaagccagctctgtcgtgtcaaataagttaaaacacacattaagcacaccaattatttttggatggtatttgcaggcaactgcatttgaaagagaatatttagatacaactaatgtacctctcaaaatcattcaacggccccagagggagaaccttttcggcttcagcacgacctaacctcacttttgttgcaaagaacggcaactcggtcacctagttgaaagaaaatgagaataatcataagatggtgttatcggttgataggaaggatgaatgtttggatggtgtaagcataccgcagatgcaacatatgaacattccacaacgccagcatcaccacgcattgctcgcaagcatgcatcaccaaattttgctgcagcaaaagcctgagatggttttctgtcagtatgcatttataactcggatactattcacaaagaataagcagccatataacctaccattgacaaagttgcagagcctgctcctgcctttgcctgaatcacaaacaaaaggaacattatatgtatgaccaaataattagaaacaccaaaactgaaaaaaagaatccccatagtttcagacatgtaatgacgtgtaactaaagtaatatgcaaataccgctatctactgttatcaacagctttcttcagtctccgttaagggcatccgttacatttgtagtgtaggagctgaaattttcttcctaaaaactcaaaaacgtttgctcatcaacacctagtaacttggcctactaaggctatggggaacgaaattatagttgaggcaatatttgacattaaataaatcacaaattcatagttatatttttttttctttctggaacctagacagagctagaaggtttgttaattgaaatcagacattttgaatcaacaggactagaacttggcatatagacattgcttctgaatataaataagaaatttgggctagattagacaactccacacaaataactacattatggtagctttatgcagatttttgtgtaaataagatgtgcacatatgcatgtactgtttgtagaaaatcaaacaaagagaatagttggggcaaaattaatcacgtgcatcaaggctaatttcagcacttcgaatatgcatgcattgtacctcaacaacttctgtgccaccattctgtatgcgtttagtcaaatagctgatttcatctggggtaaatgagcatggggggtggacctgcagagagacaggtcttggattagcaagttattatatttgcagaagttgaaatgcggataattagtgtttacatgcgctaatattgatggaataatacctgggagaggaggggtaatatagtcactccagcatgcccaccaacaactggaacattgacatcttttgggtcaattccaagtacttcagcctataagcagtagaaaaagaaaaattttatggtcaaagagcagtacacagtatttacatgtatcttaatgttatctaagagatgatatgaaaacaatttgttagaatgcataccacaaaggtgtttgcccttgctacatccagtgttgtaactccaaggagacgtttgggatcataagttccagctttcttgaaaacctctgctgcaatggggacggttgagttcactgggttgctgatcaagttcacaattgcatttggacagcacttggcaacgccttcacaaagtgagcgaacaatcccagcgtttttgttgaacaaatcatcccttgtcattcctggtttccttgggagaccagcagggataatgacaagatccattcctgtaagtgctgcctcaagctggttgggcccaaggaaaccacggacctacaagggaatttgggtacagttatttgttacatcagtatctatgcacagataaataactaatcagtaatccattcgataaataactaatcagtaatccattcgaactatctgaaaatagtggagtgcaattgtaagttgcaagtaaaaaattatcatttttttcacttctatcctttttagcttgcaggcaaatcttttctctttttttcctttttttataaatgaattaaaaatttcaataacaagaggtttacctacagtaccatttactgttgataatgattaaactgaaaaggaactaacataaggtggctttctttttcaacacaagataagatgttatcatagttttctatatatattttttggacttcactggaacaatagaaaaagcgagatctcattgttggcaagtcgtttggttaactacaaggcttgtttggcaacttgagggaaggggattgggagtttacacgagggaattgatggtgagattaagatgtgaatttgatttttcatcccagtctcttgtttggtagaggtggtggaaattgatagggagtttagttggagattagatcattaatgaaaacggatggctgagatttgtttaggcgaagtaaaggaggaattccctcccaattacctgcccctaaccaggtattgaaaaggagggagttcattcctcaattccccatcctcatcccaccaaaattcccatgtcccccaaccaaacaaaacagttaatagcctcatccctttaaactcccaatccctcctagaaactccctccaaccaaacagactgcaagggaaaagaaactgaaaagtgatttcaggcatcaatcatcactgccgatgtgcagaccaggtgctagtacaatactaccacaataagctagcagtcgaacgggatggaatgagtaggttaccacggcggtggtgtccatgtggctgacatcggcggtgacaccgggcgtgttgacgacatcatagaggtggagcacagagacgagcgggttcaacttcatgagcagcgacagcggctgcccgatccctcccgccgcgcccagcacggccaccttgaaccccggcgcgccgcccttggccctgcatggcgccggcctcaccccctcctccatctgcacacacacacgcacagattggtcatcccctcacatcacgcaacgagagagcgagagatgaactgtttcgcggcgcacctgggggcgcggcgacgggctgaggtgggcggcgacgcgggcgatgcggtgggaggcggagtcgggctgcatggctggctggctggttggttgcggcggcggcggcggaggaggagagcagttggcgcgcgaggggggaggggggttttgatgggggagggggaaggcgttgcgttatcccgcgggggtgtggctcgaaggggtcgcggggatcgggaggcgggaaggcgagctcagcctcggcggctagctagctctcctcccatctccccgggaagctcatctcatctcgttgcgttctccgccactgcttctctctctctctctctctctcgtcgacgtccacgtcgccgtcgccgtcgttcctccggctgcggactgcggtgcgtcgccaccgtgttcggtttagcccattgggccgaaaagacgaagttgggccggaacgggattgtggcccacgtgcaggccatatttattgggccagaacgggattgtggatttctaactgaggtccaacttgtcaacgaatccgattttcgtctctcaacgtggcactgacgtgacgcttatgtggcaattcaattcgaaaaaataataaaaccagtgggacccacatgtcagtctcacatagaaaataataaaaaatgtgggacccacgtgggccccgcatgtcagtccaactcaccctcttctttttcctcctctctctccccatctcccctctcttcatctctcctct

SEQ ID NO: 22768 - DNA, 1676 bp, Oryza sativa
taatctgcactggttttgatagttgagggactcgttgtgtctagttatccgggttaagggatgaaaattggattcgttgacaagttaagggacctcaaatgaacatattcctttagcgggcgatgaaccgaacggatgccgttccccttcctgcgggagactgagctgtctgaggttgaaaaacgaacatttccactgtctctataaggatgaagctatgaacacaaatacctatcttaaacaatgaaacttaaaaaataacctgtcttggattgaacaatgatgctatgaacacaacatagaaaacaacctatcttgaactgaacgatgtagctatgagcacaaaatagaagaaaaaaaaagagagagaaattgctttcgttgagagtcgaactcaagacctcccgcttactaaacgggtgctctaccaaactgagctacgaaagctctttgttgcttgtctttcgtagctcaaaatctctgagtttctttcgagtttatttacttctcttgattgtatagacgtcaattgcttaatgtgtgctacgcacaagcatcttggttgctcatttgcttcagagctcaattgcttcatgcttgtcaacaacaggttgaagcttgaggcatgaagcagttgagttctatcccatttccataagagaatgatagagaagatgcttatgaaatgggaaatgatagagcagtatccatgttggaatgaatttacgcagagaagaataaatacagaagcatcggtcctgcattgtctagatgcaagcaatttactaacaaaggtgcattctgaaccacaatattttgttcaaaatgccatactgagtcgacaacagtacaatgatatcgaaaaaaacatggtaatgcacctttaccctggcacaaaataacaaatgatggaccaaggtacaaaagcatggtaccaggtatttaggttatgatacaaagtttgcttatttatcagctagttgagtaaaacagggaaatgctgaatccttatcatgagtaacaaaaatcaacggtaaagactctcggactccaagtttgcagcaatctcagtctcccaacgatcgccgttctcaagcaatttttccttgtcgtatagcagttcctgtcattgcagaaaaaagatgcatgtatgatatcccagcaatatgtcaaaaagaatctgcagcagaatcaagtgttttacctcatgggtttcagtagcaaactcaaagttaggaccctcaacgatggcatcaacaggacaagcttcttggcagaagccacaatagatgcatttggtcatatcaatatcatatctgcaaaaaggagttcatcacaacagagcttaacagcagatgaagaggcagtaaatcatttttcaataattcacacggatcaaagaaagccagccacgggattaccttgtagttctacgactaccgtcttcacgttcttctgcctcaattgtgattgcctgagctgggcatatctggtcatttgtaatgccaagtgagcaaaagagattggtttacagaacgcataaaacgcaacaataactacccttaatcagcatgagaatcatcaagccttcaagttaaacatgcattgctttacataagtaaagctgattaccttaagctttacaagttgactcctctaacattccaaacaaacca

SEQ ID NO: 22769 - DNA, 11450 bp, Oryza sativa
  unsure (1)..(11450): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaccaatggatgatcctgcgtgcttgcagctgcatcaatcctctgtttctgaagctaaagccgtctccggcgccgatcgagatctatcgatgaatgatggatgaagatgaatggccccttcctctgccactttttgaatgcatatatgtgcacgtgttaaataacggttggatcactatcagtgtgtcttgattaattaatcaaccatgcatgacccatgaagagccatgctctgttttttacgtcctctgtttcgagcgatctgttgaagagagagcactgctctgtttttacatgttctgttttcctgtgaagtgttcaacttgagtactctgcatttacatgatctgtttctatgtctataaacatttgcacatgttatttgcatacaaccttaataatcgtagagaaatttgaaacagtctaattagattggtgattacgatatgcccttggaggagaagaataacaaaatttagtactgcaaaatatagacaagatatgttatttgtatttttcttagtgtgtagctgcatgtttatgtactaacttatattatcacaaattaaaatactttactaattgttttgatatttttatttaactatttacaccacatacatagactaggtgtaattttatcggtgttaataaagtaatcacaaaaaggatatcgagatacggagtagcactatattttctaatgtaaaacttagtacatttatactagataaaaattaatgtcaacttttagtactactttatcaaggacagtaaaatttataaaaaaataaatatttccttgcacctgtttttcctgggaattaactgttgaaaaacaatcagttgtctgttagtacgatacaggcagcggcacacagcaaaagattagctagcttctcctgtgtccaccaggttattatcccacacaacaaaaaagaaaagcagatatactcatcaaagtaccctttccttagaccatagtggcctaattccctgacttttacgcaaacgacctgagatgattgccatccagctcttctccttcaagccctatcaacaattaagctctggatcgagcagcaccgacgaagtagccgccgatcatcgagtcaaatgctcacatctcataaccttcaatccacgtggaagaatcaatccattaaacttatatcctcatgcacatcacgcacaccacaagaggacatgaagcttcacctgaaaatctctctattaattcatcacaaaaccatcaacctagcacacagcaacttgctttacattgctgcaaacatgggcctcgtgcacgcactcctcccttcgcagcagcagcagcattgctgctcctcgccgcgccgccgccggcgacggcagacgacccgggcctcgccgtctactggggccccaacaaggaggagggctcactgagagaggcctgcgacaccggccgctacaccaccgtcatcatcaccttctacaacgccttcggccacggccgctactccctcgacatctccggccacccgctcgccgccgtcggcgccgacatcaagcactgccagtccaggggcatcaccgtgctcctctcaatcggcggccagggcggcgcctactccctccccaccaacgcctccgccgccgacgtcgccgacaacctctggaacgcctacctcggcggccaccgcgccggggtggcgcgccccttcggcgacgacgcggcggtggacggcatcgacttcttcatcgaccagggcggcgccgaccactacgacgacctcgcccggcggctcgacggctacaacaagtactaccggggcagggtcggcgtgctcttgacggcgacgacgaggtgctcgtacccggaccaccggctggagaaggcgctggcgacgggggtgttcgcgcgcatccatgtgaggatgttcggtgacgagcagtgcaccatgtcgccgaggtactcgtgggagaagtgggcggcggcgttccccggcagcaaggtgtacatcgggctggtggcgtcgccggagcaggacagcgcgtggatgtttcagaaggatctctactacgagatgctgcagttcgtcaggtcgctgcccaactatggtggcttggccatctatgacaggtacttcgacaagaaggccaactacactggtgagggttaattagctagtgatcatcgtctttgctgtctgaagtgaagactagatttttaccattatgtaaaagatctgaataaagacacctcttttttctgtaacattgtgattttgatgtacttcaataatggacgaataaaatgaggtctcaaaagctatgttggcatccctccaaaaaaaaaaaggaaagaaggttatgtatggatcagatctcaaataatgcttaataaattaatcatcactggctgtaatacatcactgtgtcagtttatgtttcactgctattttaatgtgcgaaatatataaattgtagggagataaaatgccgcttttcgcatatttcgattagctgccttggaaataaactcggcgcaacgagagtttaaccgacaatcacatttctttaacctggtagcatgtgagctgcaaattaattaattactctctcgaggttaaaaataactatcattcggtaccagattaatgttaaacttattgagataatatgtatacgttaatcttaaagaaattacttcaataatacaatatatttatcgatatttttatatgtattgtaatgaaaatagtgtcaaagtattttttttacattgtctgatcctatccaaaacattttttttccaacctggagggagtattttatacccagtaaaaaaatgacacttgacagaacgtttgattattaacaaattccaaattgttttgtatgaaaacataattaaaatggtatatttggatttgtatggataagtacttccatgatctcataaaattattactcccttcgttcctgagtagttttcaccatttgctagcacagtttcaactttgaccccctaatagcttttaaaaggttagtctatcatcacaatagaaagcttaatgtgtatgtttaggatgtaaaaatttgaatgtgaacactgtccggtgataaatatttaggtaaagagggagtatatatagtttacaaatttccaacagaaaattacttgaaaataaaaaaaaaagatacaaatgttatgtatttatcaccggaggtcctattaaacgaaagagtcgccatacacaacgaagaatcacccagagtgtgtgagctgatgaggatcaacgagagcatgtgaacatgtgaagtgaagcagatcagcagagatttgtcgagatttattatgtgtagctcatcccttaaaaaaaaagtgtagctcacaagtaaaacgaggtcagaacgtctcctatataataactgtgcatcaatcgtatctgaataatatctttctgcgaataatcaaacatgtacagcgcgttgtgtacgtatttcactcatagcatccattgaattggattcgtcgttcgatcgttgaccaccgacatcagtagaatccggagggcttggtataataggggttgtaaatggcctatgtattctttctcaactcatctcaccacttaaatatggtaagaaaaaaagaaaaaaaaagaaaaaagaatatggtaaattttatccagttctattatttacggtgttttcctctcaaaaaaaatatttacgatgtttatgttattggacttgttggaatgtgataaatctgaacaacgtaagataaaccttgctccattctcgatcttgtccaaggcgtcattagttatgagagggttttttatgaaccgtttcaaacggattgagagactctataacttactttcctctgacatagatcgatatctagaccctctacctgtagtaaccgatcgaagggtacaccatttgtgaggctggtctgagctgggtgacagtagtagaacaggatttaaatcaggagcctctgccattggtttgtgaagctacatcgtttggctagagtaattaaacaatacaaaatggtagggtgtatcatatctgtcggtcaagcatgcatggcgtccaaccccaccagtcgtcggtcaaccatgtctgcttgctgcaggatttttataattatattggatatgcatgcatgcattcatctgaccttgatcccgtcgtcgtcagcttaatcatgcataaagatgaacattacatgcatgcatggtaactatataaactactataccttcacagctaatgtatctactacatctaaaaacagctagctaattaactcaccatcatggcgttcggacgccgttcactcttcttgccggtggtgggcgtcgcggccatcctgctgctcgccgccggccacgcgaccgccgtcaacaccggcgagaccgtcgtgttctggggccggaacaaggacgagggctctctccgtgaggcctgcgacaccggcctctacacctccgtcatcatctccttcctcgccgtcttcggccacggccgctactccctcgacctctccggccacgacgtctccgccgtcggcgccgacatcaagcactgccagtccaagtacatccccgtgctcctctccatcggcggccagggcggcgcctactccctccccaccaacgcctccgccgccgacgtcgccgaccacctctgggactccttcctcggcggcggccgagccggcgtgccccgccccttcggcgacgcggtggtggacggcgtcgacctcttcatcgaccagggcggcgccgagcactacgacgagcttgcccggcggctgttcagccactacaagttcgagatgctgctgacggcgacgacgaggtgctcgtacccggaccaccgcctcgacatggcgctggcgacggggctgttcacgcacatccacgtccgggtgttcggcggcggcggcgacgccggctgcacgacgcgccacagggcgtcgtgggagaggtgggcggcggcgtaccccggcagcctggtgtacctcggcgtggtggcctcgccggagcaggacgccaacgcctacctgccgcgtaaggttctcttctccnnnnnnnnnnnnnnnnnnnncgagaagcccaactatggtggattgatgatctgggataggtactacgacaagaagaccggctactccgctggaaaagttttttaattaacttccaatagactggaaattagttaaccatggtgaccaatactaatgaataaggatttgtagaaaacaaggatgtggttttgtcaatgatgtgcttctatgctcataaataaatacacggacttaataagaggatcagaagaatggattttaatctcttgagagaaattccgtttgttcttcatgtcatcgaaatagttacgttaaaaacttgactagataagaatttgatacatcaatcaataaacatataattacaagttcgacttgtaaaaaataacaaattaaactccaagtggtatcactactacccaaatcgtttttacatgcaggtaaaagcgaattttgcatgtggccaaagcaaccgcatgcaccaaaaggtatgcaaaaatcaggattttcgcatgcgggtaacgcaaactcatgcaaaaatccgtttttcgcatgcggtcacctataccggccacatgcgaaaataaattcagcgaaaatgaataaaaataaaaaaaaaaccccaaaccctagactgccgccgtcgtcgcccagatccgtgctggacccacgccgctcgcgcagtcatcatccgctgcccccatcgcccgccatcatcgccaacaacggatccatgcgagggaggcccccggtgccggcggctcagaggaggagaggagagaaagagagaggggaaaggaaatgagaggagagaaagagaagatagagaggtaaatatctgtagagggagagagagaggaggggaggtgaaaaaaattgaagtggtgagaagggaaagagagaggaggaaaataaaattgtgaataagtgggaaatattttcacatgcagaccactcaagagactcacatgtaaaaatatattttcggtcccttatgagacccgtatgcgaaaatagatttttgtatgttgaccacttaagaagctgcatgcaaaaaggaggtcgatttttgcagacatgaccagttacggtccttctgtaatctattggggttctcgtatagaaaaaaagtcatttttatagtttatgtgtatatttagttatatataatatatttgtagaagttaaatttgaacttgtatttcatgaaacgatatatcatatatcaatctatcttaaaaagaaattgatatctatttcttgggattaaaatatttttctcaaggataaatcggcaggagtaaataaaagaatccacaccgttaataaatgtgaagtagtatgatgtatactttacaaacaatccaacgggagcaatccagagcagctattggtttctgaacctgcagaggtgatcgaaatggtcggtacgtccgtacgagtcgtcggtccatgtttgcaggcgaccgtacgtacgtggataatatgcaatgcatatgcattactgatccatatcacgcggtgtcgcgatcagctaattagcttagctgctagcagatgaataaatatgtgatgagatgaacaacattgattaatattggtcaaaatattttcaactctaaaacttattagttgtactcctacgtacgtatgactgtcggaagagagtagtacgtaattaaatcattttcattattaaaaaagaaagaagatgatgaacaacttcaccggccgcgcgctgtctgtagaactcccatacatgaacagctaggcattgcaaggtatacgtacacgtaccaactgtttgctggcaacctgcattctgcacgcgatcgagcggcacacagcaatttatattgaagaacaaatcaaagagcttaattggtcaacaagatgagctgccaataagtacagctgctacgcatatactcctatgctgtgtactatatatatcatgcgtatgccttttgcattccaaatcatagccactcatcactggctcaccgcaattaaacgccatctcgatcgaaagctagactaaccaagtatatatacgatcgatggcgttccggcgccgttcatgcatcccggcggctctggccgtcttcttcctgctgctcgccggccagtcaaccgccggcgaagaccagaccgccgtaatctggggccgccacggcgacgagggcaccctccgtgaggcctgcgacaccggccactacaacaccgtcatcatctccttcctcagcgtcttcggccacggccgctactccctcgacctctccggccacgacctccgccgcgtcggcaacgacatcaagcactgccagcgcaagggcatcgtcgtgctcctctccatcggcggccagggcggcgactattccctcccctcctcccgctccgccgccgacgtcgccgacaacctctggaacgcgttcctcgccggccgccgcaagggcgtgctccggccattcggcaacgcggcggtcgacggcatcgacttcttcatcgaccggggctccggcgaccactacgacgagctggccaggaagctctacagctacagaaacaacaaggggaagggggtgatgctgacggcgacgccgcggtgcaggttcccggaccggcggctggagaaggcgctggcgacgggggtgttcgcgcgcatccacgtgaggatgttcggcgacgacgtgaactgcacggcggcgccgagggagtcgtgggagaagtgggcggcggcgtacccggcgagccaggtgtacctcgggctggtggcctcgtcggagcaggacccgggatacctgtcgcccaagccactctactacacgctggtgatgtacatcagagacaggctcaactacggtggcaagatgatctgggacaggtactacgacaagaagaccgactactccattggaaaacttatttaaaacctatatatatactcctttttccattgggagcatggagatatatatatatatatatatatataccaagtattgaatagggcttaatttctagctatatggaataatgtaatcccatgtcgcaattaaataagggtgattatctaaattgttgttgttttttgtaatcctccaaaataatatcaataaagttcactgcatgtgaaagtaaaatctttagtcatatctcctgatagctgttcaaacgcatgcttacgcaggatcgatgcaacgtcgtcatttgtgtattgaataacctttcatccttacgtagcgttctaaacagcatgttgacgtaaaattcatcgcacacataaatgtctgagagatttgctcaactctagctagtgcatgtcctatcaaccgggttcagaacgtgccagttagtttgatcctataactaatacgataaaaattaaagattatatcgtggggccgatatagtatcatacgatagaaattcgtatcaacgactataatcgattggattttaagtataaagaataaattaaaaaaaaacatcgcctaagacctaggtgtaatataattgtaaacaatctaactcttattaaaatcaatcttaatagatcaaacactgagatagtataaaaataaaaataataaaggaaagatattaaacaattatatattctgtgaatacagaccaatgcttcaagttgattggaaattatcattaacttctataggaagagatagattatcatcggctataaccagatagaatataattgttaatagccttttcttattgatcacaatcttgatagatcagacctaaccaatacaataaaattaggaattagccaattatattatctctgatagttaactgatgaaacaatttagttattgataatttagataacttatcggttggaactccgatgaaacgatgagtaatatctattgacttgagcatatctaactaccaaatacaatccaatagatcggactcaaacaaaacagtacgagattaataataaacttgatagatttaaacgagctgatagatgttaagcaaagtggttgatatattgagtctaactcattccaatacatttttcaaccaattttcgataatcgcggcattaattccttccctgacccagtcatgactaacggcaattgctaaatttcacagttaacacgcctattaaagcttattgattgctaactttattataggagagaattacatattacacatgtattatatacctaaagattagaaacacatgaatagaagtagataaagaattggaatattatggtttctcaaatcctagagaaaatatggagagaaaaagcacaacataagtttatcatgaggttggacttatgttaaaaatttcttattaaaaaaactacgaattgaggcaatccataagaagttaataagattttagaagggaggcattcttatgttccaaagggacacataggattactaactactccctccgtttcatattataagtcgtttgacttttttttatagtcaaagttccctaggtttaactaaatttatggaaaaaaatagcaacattcacgacaccaaattagtttcattagatttaaaattgaatatattttgatacaatgtttgttttgtattgaaaatattattatattttgctataaacttgatcaaactttattaagtttgactataaaaaaaagtcaaacgacttataatatgaaatggagagagtaaccttttgcgaactagactgccccgtttgcattcactctacagttttgaacgatcttttgcacagcactgtcctgtttttcttaactagttgcatgcccgtgcattgtaatggggatcaagatataaaaatatgctttaattttttatattcgaccttttgtgatgggtttttttgggctttatgtttggagcagttcatttgaaggggggagcagttttttataaggcggaaggttttaaaggataagaaggagaacgaccgtgcttttaaaatgagttaagaaatactccaactactactatggtttgcaatttcggtaatttcgaacgctaccggcaagcagcacaaagcttcccccgaattttttttgtcttttaaaatatttgtgaacttggtaaaaatttgtttagattcaataaaaatatgttaaattttcaaataatttcagccaaaacaccgaaattcaattttttaaaaaaaatttgggtggtcaccaaaattgcaaatcctggctactacggcacatcaaacacaattttgtttctaacaccagctatgcatgcatgcatacctcctaacggcacacaggaaaaactaacaatagcttttgctttatcagcatacttatcgaccaagctagttttactttggaccggggccaaccggataggatcgaccatcactagacaccgttatcatatggagtataacaggtcaatggtcgtatctcatcaactaaagattccacttgacacacctagcagtggcacacaacaaagatattcgagagtttagaatagttttccaagaggccctactgttttaggctttagccatgcatcagctgctgctgctgcattcttgtctgcctatatatacatcacaataacttacttgcttcagatcatgcaaatcacatacacataacgtgtgcgttgctgcaacatgaagatgaaggctctcctccccgtagccgccatgctgctcctcgtctccggccagctcgccgccccggtcaccgccgacggctacgtcggccagctcgccgtgttctggggccgccacaaggaggagggctcgttgcgcgaggcctgcgacaccggccgttacaacatcgtcgtcatcaccttctacaacgtcttcggctaccagcgcggcaggtacgggctcgacttctccggccacccggtcgccgccgtcggcgccgacatcaagcactgtcagtccaagggcgtncaggtccttctctccatcggcggncagggcggcgagtactcgctcccgtcctcccagtcggnctccgacgtcgccgataacctctggaaacgcctacctcgcgggncgncgcgccggcgtgccccgccctttcgcgacgccgtcgtggacggcatcgacttcttcatcgaccaggcggcgccgaccacta

SEQ ID NO: 22770 - DNA, 2657 bp, Oryza sativa
tgcatcatgatcaatctctacctgcaatatatctctcccaatatatgtaatgtaatgtaatgtaataatattcgaataaaatgaggtcacaaattatattataaatatggatcagccctcagatgattttttttttcgaacgactcgcacgagacggtgcaaagttttattgatagagtaggaataaaattacaagattacaatcctggagggtcataactaggaaaaaagaaaaaatataccacctcctatacatcgacagcgccaacacacacgaccaggagaaggctagcaccggaccggccaccgctaaacgtggccggccgacgctagaccaataaaggaacatagacgagatcgccctacagctaggggtgccaaaacgacgtcttcaagaagagaagcgacggaaaaccgccgctgccgtccgtcggggctcaaaggagccaggactaggctttcgcccggcaaccgcccttgttgagaggtgagacagcacgacaatgccattaggaaggggaattaaccatcgttgtcgacccggccaaattagccgggctaggttttcacccgccgatcaccacctacaaatccacggctgatgcaccgatgctccaccaccactcaacctctgccgacatgtgggacccctgacctcagatgattattaaattaataacttgctactgattgcgatatgtgaaagctttaaatttgagacggaatctagtaagcataaaagtgctttactatagtatacaagtgctttacgagaagaattaagcatatcaaactcttgcaactggcagactggctatagcaatgatgttcacaacctaaacacaaaagtcatattttggccggttgcttctaggacaataaaaatgaacacgctttgggtgaaaatattcttaagaccaaattataactatcgtaacgtgcacacattacgacaaaagaaaatttgtagaacaccctttttttttctgacatgtcctattgcgcaagacatcttaattaaattacttaccattcaagaaaactgaactttcatgtcgattgggctattgatcgaagagttgaaaaaacagctcataatgtcatctttacagggaaatcgaatttcaatcccatgcgcaaataacctgtagaagtcgaatttcaacgtgtatgtttcataagtgatatatcttatatctattatatactaaaagtccattaaacttcctacaaatgttcctaaactgtcatgtggcgctcctataaacgcttctagattgccacgtggcgctttaataaatcctagaaattctaagaaaaaacaaaacatctagccatcgattttcatttaatctggtggacccactattttaaaccattggatctttattaagaaaaaacccaaatcaatctataaaaaaaatcccacgttacccccgtggtgtccccgtggacctgtacgtatgtacgttatgtacgtacgtatcccgtgcaagtctttttctttttttttcttcttatattcttagattagatgaaaaactaaaaagtccatgttaaattaaagttgtaaaaatatatgctatttcaagtattattctaaatagcgcatctcatcaaaacatccactaaaaatattaataaattaaaattgtagattatattattgtatatctcttaagaacatagttaaattggacttatattttcaaaaaacaaaaagaatttaaattatgagcagcgttctaaaaatttactcactcccataaagggagtagccaatccgataagatttcactcccataaagggagtagccaatccgataagattttagaactcaaccttaaatttactataaaatatatagtatcaatcatatatcaatcacatatcaattaggaatagagccaaatatatcaatcatatatccctactaattcctatgtgtataagtttcatatacaaatcactatccaccaattatcaagtcatattaattacttatgaggcatccgtgcttaatgcacctaataattagatgacatctaatatgcagtgtgttatcgagtactgataatggacaatattaagtgagaaaccatcaacaaatgataggtaagtattgataccaccaagccacaacaaataatagttgactacaaatatattggaactattgggtaatagcgttctcacacacctacatacattcctaggatgccacgtgacgctctaataaattagggtaaatctaacaaaagttataagaaaaagtaaaacatctagccattgatttacacttaaactggtggataaattatttttaaccattagattagatctcttcaagtaatcaattacgactatgactaatagcattcttgcacttccaagatgccgcctaacgctctaataaattagagaacatataagaaaaaatatattaagaaaagcaaaatatgactgtttatttacacataaaccagtggatatattattttcaatcattatattatatctattcaagtaatccctcactatgtatatacccaagagatgtcataaaggaaaaaaagaagtgtgtatacgatcagccccatcaagtagttttctctttctttctttgcagctctgagattttccacaaattgtgcat

SEQ ID NO: 22771 - DNA, 58408 bp, Oryza sativa
  unsure (1)..(58408): unsure at all n locations
aaaaatatgtgtcaaaaaagaggaaaaaatatgtacttagtatttgcaaggaaaaacatagatatatagcatcaaaaatgttgcatgtaaccacattatatctttttaattatatcattcccatctatataattatatgctaattattaacattatagattattccatcgtatattacccatgaacatgcataggtgaatcaaatatataataaaagaaaaaacaaaacaaaaaatatattaactcatatgttaacgaacgatggtgatagacgagcttagatataaccggaacaattcgcattcgcactgtcattatagtttaagggtgtaattcagactatttccttgtaaaaaaagtcacttccacataataaggattcatgatacaaatttaatcaatactaatttagtaaagtgcccgcgcatgtgcgcggaccatcttcctagttaaattagaaaaattgatgactatttagtggacatgcaagaaaaaaggggaaggatgaaaatcaatctcctcatcgttacaatgaactggagtatttgaattacaagaaataacaagatatcactactgtagatatgcacaaaaggaaccggcacgtatagtgcttttgtcctagacgcgcgtctgcggggtgccatcggctaggaccgacacctttgtggagagataggtgccggttctaaacaaaaactagcacatatagtcttaatgccggttttttcagaagaactaatatctatatataatatattataggtctctcctctctcggtctctctccgcctcctcccctctccctctcccccacgccgcagccggccagggagcaacgacgctttcgtcgcgccgccgccgtctccttccaaaattcggtcgatcctttccttctccggccgaattgattgaggggaaacaatctttgagatatcctctaccttttctcttttggaatcatcctctacttcggtttggaaatcgatggattcgagtttgtttcggattcgttcttcccgaagtttccttcgccgtcgccggccgccgtgggcctttgccgccgcctccgagcccctttaaaaggacccccggtgtctcctctacccgccgccaccctcgccttcgcctctcgtcgtcggaaacgccctagcgtcgtgcgaccttgcgccgccgtcgccgccgtcgctccagccgtcgccgtcgctcgggaagaccgtcgtcgtggtcgccaagtcgtcgccgtcctcgtccgccgcttcgccaccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtctgctacccgttggtgtcctccgttcgtgccgtagcgccgccgttcgccggtgagcgtgcgtcgtccgagccgccgagccgccgccgccggtggtgacgtcaccgctgacgtcatcggggccgttcgtcgtagtccggtcgtggaccgatcgatctcgaccgtccgttttggatcaagtcgatctcggacgtccgttcgcgtgaaccgccgccgtgcgcccagtccaccgcgaaaccctagcccgctgacgcaataaatctctttttccttttcaaaaataattcattattgcgtcataattcaattaaaatctatataagtgttttaatccgatttaatctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttatttttgaatgtcattgggtggaattaacctattgtttgttatagcccttttgttcttgtttaccttattccttgataccttgggttattataacttgactagttgagctttatttattggttcaactagatattggaaataattgcttagccatgcttagaaacatcagctcactattgggataacttatgactcactattatttaatgatggcttaatgatagttcatgatggtcaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcactagactgagaagtggcggagataagcccacgggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataaaaggtgctttaactggtaataatttgattagctcctggtttggaatggtatattcctggtttggagatagaactgtgcagtcggggtggttgttcagaatggttgggcctatgcaacagggtatgttgtatagtgttggtttaatattgtttaattatcacttaactgttttataattctcaaatgtttgctaaatgctgcttttgcaaatgaaaccctactatgccatcctttggtatccttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttaatttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacactttgcggggggcatcccacttgaaggcgcgcggcggcggctctccttctctccgtccctctccccccactggcagcgcacagccgcccctcctcctttccgccatcgcatccagcacctccacctccaggccagtggatccactgccacgagctcgggagcagcctgatctggcctccatgagctcgggggcggccaaatccgcacctccgttgctccctcgacttccaccttgccatgggctgctggtcactgcgagcttgaggccggatctgaccaccttgagctagagggcaaccagatctacgcggttgctaggaaaccaccacgacaatggtggaggcaccgatggccagatccatgcgccacgatgatgaaggcaaccaccaccagtgtcacggctccttccccatgctctggcaagaggatattttatggatttctttgttgattttattggttttctcctaatcttgcttgttgacattggttatcccttcgatgctgcaatggatagctaatgcttggatagtagatgatcatttgcgataaactttgtgattcactctgtgattttgatgttgaaaaaaaattgtgattgattgataacaatttaaggctcgaacgcgaggtttttgtgctactcgatgcatcggttgattcgagccgatacattgagctggtttttttttattcctgaaaccttaaaggtgttcttaccgagtgtcggttagaaaatctagcacccatcagtttttcagtagtagtgtgtgcagatagcattaatcatatatgagtatatcccagggtttcatttaccgcggtaaaccgcgcggttaccgcggttaccgcgcttaccgcgggggtacggtaaggggtaaaccgcggtaaccacgtcaaattcaaataaatttgaaaaataatttgaatttttgataaattttgtacggtttgtcgcggtttgtcacggttaccgcggttaccgtgcggtaaccgtgcttaccgccggggcgcggtaaccgcggccccggcggtaaatgaaaccctggtatatcctgcggaaggaacttctaattaaaagggctgcagcagtgtagcttcaaaaagtgaatttgccatgcaaggttatcctcatcatatcgatccatagggcaaaagcaattacaccagatcaatataatggtgtcgatcatctcatcaacagtagattccgcgtgcatcacacccacttgtccgcacacaagaagagaccagctaccaagcaatttgcagcggatgctaattcagctggcaagcaatccctccatctatatattggctgcagatgatcagatgatgcgctaaattaatcaatcatatactacacaatatgatatgatgggcctcctgagcttgctgctcgtcgtcgtgtcctgcctcgccgcgccggcgacggccgactggtacggcccgctcgccgtctactggggtcgccacaaggactacgagggctccctgagagaggcctgcgacaccggccgctacaacaccgtcatcatcaccttctacagcgtcttcggctacgtcaagggcaggtacggcctcgacatctccggccacccggtcgccgccgtcggcgccgacatcaagcactgccagtccaagggcgtccaggtcctcctctccatcggcggccagggcggcgggtactcgctcccgtcatcccagtcggccgccgacgtcgccgacaacctctggaacgcctacctcggcggccgccgcgccggcgtgccacggcccttcggcgacgcggcggtggacggcatcgacttcttcatcgaccagggcggcgccgaccactacgacgagcttgcccggcagctgcacggccgcggcgtggcgctgacggcgacggtgaggtgctcgtacccggacagccggctgcagaaggcgctggcgacggggctgttcgcgcggatccatgtccggatcttcggcgacaaccagtgcaccatgttgccgttggacgcgtgggagaagtgggcggcggcgtacccgcggtgcaaggtgtggctggcgctggtggcgtcgtgggagcaggacgaggtcgggtacatgttccaaaaggacctctactacggcgtgctgcagttcatcctcaacaagcccaactatggagggatcgccatctgggacaggtactacgacaagaaggccaattacagtggtgagggctaaatcatcgatcatactgtagctagtgtgtgtgtaatcaatcacaataaataaacatcccctctatatatgtgtacgtattgtacgtgtaatataatgatcgatacaagaaaaataaaaggatatcagatcattagaacgtgtgtatataaaaggtacatttttgtaccgacccctatgatgtttttcctatccaaaacgcacatccacgggacacctcggctagaaccggcacctttgtacaaagagataggtgtcggttttgattaaaaaccggcatctatagtatcagtgtcggctttttttttaagaaccgatatctatatttttattataggtgtcggttttataaaaaactgacactattcagaaaaccggcttgagccgaacccctatctctctctttttattagcccctctctctctccattatactctcatctcccttatcctctcttctctctgcctcctctcttctctttgctcctcccctctcttagctctctctcccgttccctctctctccactgcaccacccgacggcgacctagcggcggaagggaggtggtagcggcgccctcccctacggtccatccagctgtccagctgcggcggcggcggcccagcagcgggaggggagatggtgcggtgccctaccctatgctccatccggccgtccagcagctgcggcggcaccctcacctctgctagatctggcgggaaagggaggtagcggggccctcccctacgctccatccggcgtccaactgctgcggcggcggccggcccggcagcgggaacggagatggtggcagcgtcctcccctatgctccatcaggccgtccagcagttgcggcagcaccctcatctccgccagatctggagggaagggaggcggtggggccctcccctccgctagatctggcgggaagggaggcggcggtggcctggtgatgacggcttcccacggcaacgacagcggtggtggtggggggggcagcggcaccctcctcctctccatccgacggcaacggcaataatggagaaggcgcgtggggcgaggagacagttatgtgttcttgagtaatgttcttgatgtgttcttgatgaatgtgattttgatgtgttcttgatgaatgtgatgttgatgtattcttgatgaatgatgaacgatgttcttgaagtgctcgggtccggcttgattcgagccgagccggtttttctttttgggctcgttcatccttacagatgccggttctaaatcgacaacgaaaccggcacctatttgattttcacatcagtgccgccttcgtgctgctggttaaaaaaaccggcacctttgtggggttgtcaaccggcactcatctctatttccgtggtagtgtatttacaacaccatattagtttaattaaatatcacatgtcatatgttttgctattgtgtatatactggtattttttctataaactgacaaagttagaaaatatgaaacgaacggagtagctacttattggtgagaaaaaaaactacctacactcacaatgcatcccatacttacagcaaggatggatttattgtcgtcgtcaacatcatcgttgttgtcatgctttccaatctcataaaaagttttatttaaaaagaaaaactttgttctgaaccaaggtcataaacaaaaacgtggataggctcctatcctttcaagagtgtgaacacatcttaagatacattatgcgcgaatgcgcgggttaccattctagttgatactaaggatgacactaacctattagtactgatcaatagagatagaactattatctgtctcaaatatctaaacttgtataaaaattattgtctcaattatatatgtcacttatatatgtcgattcctgtctcctcaaatacgctcttgtatatgtgcgaaacctgtggtcggagtgttacccaacgacaatgacaatcaaagaacaagttgggcagcagtagataattattgtaagattgagattggcccggtttgtataactagaaaacatgcatgctaatcaccttgtttagaaaaaaaaggacacgctaattaagctagctagttatactatacctagctttatatagcaagcaagtaagaattattagcctagctagcgtgtggttgagttgggtttgaagtaatccaccgacgaggcgcgcgggccccggcgccggcccggccggagtagtagttatacaacagatcgatatagacatatatatagatcgagagtttgtttcaaattaaactttcagtggcacttttttttttcttttgcttggtgagtttcgtacgagttgccgcgagcacacgctacgtacgctagctaagagacatgatggtgataaatatatactccctccgtttcaaaatatttgacaccgttgactctttagtacgtgtttaaccattcgtcttgttaaaaaatttaagtaattatttattcttttcatatcatttgattcattgttaaatatactttcatgtacacatatagttttacatcttttctttgagtgtcatgtcgctcagtttgtttggagatgtgtgttttttcttttaatatccccccatcccgtaatgccaaaaacattttcggtaattggcttagagaggtatctaggtccattaagaagatgattctaattggagctagtgttgtatgttggtcaatttggcgttgtcgtaatgataaagtttttaatggtaaacaattatctaacccaatgcaggttatcttcatgtcttcctactggctccacttttggtctacaatgctaccacaggagaagcaggatactgtgtgcaatggtgctacactcttgaaatcggtagccaagggtctcttattccactatgggtggcgtagttccgtaagaattgctagctaaaatattttatgtggtttaacgctagtcaataataaaggggagttggggatttatcccatcaccttatttctcattttgatttacttttatcttacatttttattactattaaacttatggttgtgtgtcttatgacagaagccggagatgtaatccatttccattatctaaaaaaatatagttttacatatttcacaaatttttttaataagatgaacggtcaaatatgtgctataaaaagttaacggtgccaaatattttgaaatggagggagtattaaagtatatatatatatatatatatgcggtttgacaatggcacgtaagatggaattaatatatgctgatgcggatgtgcatggcgtatagacgtcaattgctggcctggccgtcaacaagacaaaagtcgacgtggattggtcaaaacttcgagacctatctacttcaaccggccgtacgacgcaactagtagtattatatttcggtcatcggctccatgcttctcgatcgtgtgataatttcttttgttggagctaattaacgagcatggaattatatttccgtgctataattatatttttgtatattttttagcatgcattactctttcttacaagaattatagtagctagtcgatctgactgctaaatggtacttgtgtttatatgttcttccgtgcataatcgatgaactaaaaataacgcttacgtattccgaactcctaagcagttcatcttatataaaaaatttctatatatgattttctaatttgcaagtaaatttatattatatgtcgatatcacaaatcattcatcaaccttttagaaaagaaaaacacgactcaaccattcaattatatatcgattgaattgttatatatggaaactatatagtcagattcgtagttaagggtaatttttttaattgcaattaaaaggtatctccaggattgtgaaatgcctgaccttttttctagagtaaaaggtgcacattattggttactcgcttcacttgaaaatattagtatttttagaaacacgtcataaaacgcgcacactcacctgtttatatcacactataaacatttttcttactgatttcaatacatgaaaatcctaacattttcaaaaatattataggtgctcggaggaggaagttaagcaattttaaatttggccatcaatatgatatatagctaaaaggaaatcgttttttactttagtatctttaatttgctaagcaatatagaaatgtttatattttgagacagcagcattagtaacttaatttgcattgatgatcacgttgtcttttctttttctctaccgtaagatctggttgacccgcagcaaatggcgccattgctccctcttatttttatgccctcgctctttgtttttttttttttacagtactttatggaaggttcgcggtaagatgcatatattattggtcgcataaagaaggcgtaggcgcgcgcgtggcctttgaatcatagccacccttagcatgtgcgactcgactcatcacaacatgatatagctagttctagctgtcatccatcttagctagctaacctgcgggtagttagcagccatggcgtcgatcgacgagaggtagacgacgacgatatccatatccatatgcatgcatggacaacgcatataccatggaatagatgggttcgaccaactttaatttgatggctaccttctgtttccattaacctttcatcattccattcgtgcacgcgcccgcatgtacatgttccgctgttttccatcgatccatcaacagcatgcatatgctgcagctgcaccctgtttcagttaattccaatcaccaatgcattgcatatattaatccagatcgaggcacacaagaacagactatagctacctatatctatcttgttatttctacctagaccttaattaactcgttccgttcatccatgatccatctatatatagacgtcacccgtgcctccattcttcacaccaaaaatcatccccaatcttacatcaactacctacttcctacgtagcccagtaactatacattattaaggctaaccagtaactaactaaggcacacgtacgcaatggtggcgctcggacgccgttcatggctggtcccgctggccatggtgctcgccgtctccagctgcctcgccggcccggcgatggccgccggaaagaccgggcagatgaccgtgttctggggccgtaacaagaacgagggaaccctcaaggagacctgcgacaccggcctctacaccaccgtcgtcatctccttctacagcgtgttcggccacggccgctactggggcgacctctccggccacgacctccgcgtcatcggcgccgacatcaagcactgccagtccaagaacatcttcgtcttcctctccatcggcggcgccggcaaggactactccctcccgacctccaagtccgccgccgacgtcgccgacaacatctggaacgcccacatggacggccgccgccccggcgtgttccgccccttcggcgacgccgccgtcgacggcatcgacttcttcatcgaccagggcgcgcccgaccactacgacgacctcgcccgcaacctttacgcctacaacaagatgtaccgcgcccggacgccggtgaggttgacggcgacggtgcgctgcgcgttcccggacccgaggatgaagaaggcgctggacaccaagctgttcgagcgcatccacgtccgcttctacgacgacgccacctgctcctacaaccacgcggggctcgccggcgtcatggcgcagtggaacaagtggacggcgaggtaccccggcagccacgtctacctgggcctcgcggcggcgaacgtgccggggaagaacgacaacgtgttcatcaagcagctctactacgatctgcttcccaatgtgcagaaggcgaagaactatggcggaatcatgctctgggacaggttctacgacaagcagaccggttacggcaaaaccgtcaagtactgggcttaattaattaacctactactactatttactgctactatgcgttaatttgtgcgtgtgtgtttgagaataaaatatgttggtgtgtgttggtttttttatgtaggtatatgaataaaacgagatccatatgtaacgatggagatctcgagttgtttgtttgttggtcatcaatcgaataaagtgtatgaacaatatatcagaaatggttattatgtaattttgtctcttgttaaccttcatttgcttgccgcattgctttcttgggatggaatgaatactgcatagagaaactctgttattggtctagttgaacaagctaactgaggagacagtggtttcgaagaaaagtgtgtgattcgttctaaacccaggctaatcctgctgttttagggtcttttatgtagtagtatctgttatcatttctggtcaaagtacgaaagtatcttttgaattttcagttttcttgtgcgtgtttccttgtcatttaacggctcaataacagcatagatgacgtgagtggaaaatcattctgaaagtgacggaaggatagtcaattttgtgacgcaaattaatcaacaaataatagtcttgtagtaggaataagtacgtgtagcagtgctctttgaaaaagtgtttgagcaccgaaaaccattccacagaggtttgtcgataccacaacaaccgagcggttatcgatgagaagtaatcaattttatcaaaattttgaatttagtgtggttttaattgaacttggccgatttgtcaattaatttacaaatacaaactgactcaataaagccaataactataactaagcagttatcgatgttttttttttgtaagtttagtggcattcacatcccatttatacattttgtctcagaaaattttagatattgcttggaaatttttgaacagttttttaattatttctttccttgggtaaaatggtatttagccctcgtgtatcacttggtacaaactctgcatccatagcattttttttacgcaaaggtgatgtacagtgattttatctcttcacatgataccaggcatgctctgtgttgctctgtttcatgtcaaaaaaactactgtcagcaatgttcacgagcgaagctgtataaattatcactcatagattttatttcttcacgtgatatgtgtgacatactaacatgttggtgtacgccaaagtttttgcaaggattaaacatctggaaacgcaaatttaacttggtgtatgaaaccacataacaaaagcagtgcagctgatccgaaatgaaacggatcgatcagagtcagagcatgcctttgatggtctgaccgtagcggctcctcctgtcgaagtgtcggttccagagcacgacgccgccgtagttgggcgtcccccgcaccagaggcagcgcgtcgaacaccagcgccgccgggttgatccacccgtcgctcgccgcgtcccacgccgccggcagcccgacgtggacgctcgcgttcgcgtacctcgccgtccaccccagccacgccccgtagaacggccgccgctccgacgagtcgtacgagcacctcctgtcgtcgtagaaccgcacgtggatccgcccgatcagacccgtcgccaccgccggcttgccgttcgttttcttgccgtccatgcaccgcaccgtcgccgtcagcagcacgccgccgtgttcgccgaggcgcttggccagctcgtcgtagttggccgaccccccgtggtcgatgtagaggtcgatgccgtcgaccacggcgtcgccgaaggggcggaacacgccatgtcggccgccgccgaggtaggcgtgccacaggtggtcggggacgtccttggccgacctgggcgtcgggagggagtactggtcgccgtcccccccgatgaagagaagcacggtgacgttcttggcgtgctggcagtgcttgatgtcggcgcccacgccggcgacggggtggccggagaggtcggcccagtagcgcccgtggccgaagacggtgaggaagaagatgatgacggtgttgtagatgccggtgtcgcaggcctcccggagagagccctcgtccttgttccggccccagaagacggtgagctcgccggtcttgtcgccggcgaccggcccggggccggcgaggatgaggagcactataacaacaaatgagagcggcaatgcacggcgccgttgtgacgacgacgccatttggaaattaatggaattagaattggatttggatttggttgatattctttgatctttcttattgttgtgaacgatttgtgaaaatctgtcgtgcatgtccatgctacttatagtgtgttaagtgagctactgtcgatcgatttttcagctcgattaattgttttcagtggtcgaattcccgtcttttaattctgtgtatcgatcgttatctgcgccgctgccatttttcattgactaaagacgaatgttgtgtgcgcctaactatacacaagttgcttgtaatgacaaaaccaaaggatggctccttatgaacaaatggactattttcagtgtagggcgcacctatagggacagaccctgattagattattcaatcttagctaaattatgcatgtgagctatatatgtatcagtcaatagttagattattagtatatattggaactcccataattatttttgcgtttgtcactactatgtatctctagtctattcttgtgtgccgaagtgtatatatactgttcatttgatgatatggccgtacgtgcgacgacatcgttgactgatcgacgaacgcaagtctttgagatctatatagctaaaagagagttgcattaatttgtcaaatgacccgaattctagatatacttgtatagtactagcacatgttatcagctgtctagcactggttagttttcagatgacgcacgttgatgcatgattgaggagatgcgtctttgacacggggagatagtttggtttgtgccggacctgtgtcttaagccctctcgaacacgtgaatggttaccattcatttcaaaattccctctctttttttctaatatactgtaaaaaaataaatttcttttaaaaaatagcattcttttttttaacaatctcggcgaattcccgttttaacaaagtagtcattacgttttatattacaaaagatgaaatttaagctaaatcgaaattgtattgtgcatatttatagattaatatatgaactgcaacaaaattttcattcattctcttttttctttgcgattacaaacaagacacgcgcacactctacacgcctgtgattatgctcccctagcacgtactcattgtgacggagattggcgatgggtataactttatcaccacgcatgctctctatgaagcaacgtgtgagtaatactccagtgggattcaaatccagtggatataactcaatcaccacatcacactgttttacagtaaagtacaaagttttgaatgagcattcggtttgatatcaaaattttgaatacaaactagacatggatatataggatagcagattctaatatcttgaggggatgttcccttgtgtatatttttcttttaaatttggtacaaataattatgaaaaattgtaaaaaaaaatattagttatgtagaatatagtgatatatatcggtccaccaaagttcaaatccaataaacatatcgaaaaaaaggacaaattcatatttgtgctactattctcacgttgaattttttacatatatatttggatgtgtgagttgggtttgggcctaagattttatagagttgtatagatacgttatatgaatattgtcatttatttttcagatttttataaccgttaaatggtttttaatcaaacgagaggacatccctcgagggatcaaaatagtttattcccggtatatagctagcccaagccccactctccaactcttgagaacaaatacaactactagcagatacgtagtgcatacttgaatttattgttcatgtaccttaattcaagcatacagcaccctgagagacactcacaaattacatacgcgcacacgtacacacgctacgcaaacaaattcaaagctggctccattattatacacaatcatgcatatactattgggaagaagaagttgatcgaattgaagctccgatgaagcagcaatggcggccggattgaatgtgagaatcgatcaaacgaagtccttgagcgccctgccgtagtagttatcgtaggctttgtcggcgcctcggtcccacagcatggcgccgccgtagttgctcgctgtctgcgccctctgcatcacggcgtagtagagcgactccgggtttatccagtccgccgccgtctcctccgccggaagccccacgtacacctggctcgccgggaaccgcgacgtccacgcgtcccagtcctcccagtcgaacaggctcctccgcccctcgccgtcggtcttgttcgtgcacgccgcgtcgccgtagaaccgcgggtggatgcgccgcaccagccccgtccccagcgccgccgccgcgttcgcgtccgggtacacgcacctcggcgtcgccgtcagcagcaccggcttgccgcggtagccggcgaggcgccnngacagccacgcgtagttcgccggcccgccgtggtcgatgtagaggtcgacgccgtcgagcacggcgtcgccgaaggggcggaacacgcccctgcggccgccgccgaggtaggcgtgccagaggtggtccgcgacgtccttggccgaattggcggtggggagcgagtactggtagccgtcgccgccgacggagaggaggacggggatgttcttggactggcagtgcttgacgtcggcgccgactcgggagacatcgtggccggagaggtcggtccagtagcggccgtggccgaagacgctgaagaaggagatgatgacggtggtgtagaggccggtgtcgcaggcctccttcagtgagccctccgtcttgttgcggccccagaagacggcgatctggccggtctttccggtggcggtggcgaggcacgggaggaagacgacgacggctactagcatcgtcgtcgtcaagagacatagctggtggcgcgccatggctgatatgatacgatggcttaattagtacgtgatgtgaaggcatcgccggcgacatgagtaggtatatataagccgccatggccatggccatgcagaagataagggccgggggagctgtggtcgtcgtcaatggcgtgccggtgccgcctgcagacaaatcctggcgcggccgccgcagaaatcgacgaccaaactacacatggagacggactgcaggttattgttttgttccgagacaagtcaaatttaagtcaacaacttgcaatcaggacgaaacgtgaggctggtttaatggtttttgtcatgacaacaatttgtcattctctgcatgaagaatttatacgcctggaagaagcatcacattgacggaatatattctttttcaagtctgacccatatacgaacatgcatgtgccagtagtagccttatatatacatataatcaaccaataatgcaatgcaactatggtaaacagcacagtgaaacatgctggattcttttatatttcaaaactaaattaacataatcatactactttcaagcctgacccatacgaacatgcatatgccagtagacgggtacagatagtaacagatgacgcaatgcaggttggtaaacaacacagtgaaccatgtagtataaacactggagtaacattgcaattagacaatgtctttgatggcacggccgaatccggtgatcttgtcgtagtagcgatcccagagcatgacgccgccgtagttggcatcgtcctgcaccgacgatagcacgctctcccgcagcgtctgcgggtccacgaacccgctcatctcctccatcgccggccaccccacctgcacccgcgccgccgggaacctcgacgtccacgtcctccacgcgccccagaacggccgcgtctcgaagtagttgtagtcgcacgagctctcgttgtagaaccgcacgtgcagccgctcgaacagcgacagcgtcttcatcgtctccacctcgtcgtcgaacagcgccagcgagcacgccggcgacgccgtcaggcgcactgccggcttctcgcgaccgaagctcctcaggcgcctggcgagctcgtcgtagtggccccaccggccgcggtcgacgtagacgtcgacgccgtcgagcacggcgtcgccgaacgggcgggacacgcccctgcggccgccgccgaggtaggcgtgccacaggtgttcggccacgtcctgcgccgacttggcggtgggcagcgagtactggtcgccggcgccgccgatggagaggaggacggtgacgttcttggccttttggcagtgcttgacgtcggcgccgacgccggcgagcgggtggccggcgaggtcggtccggtagcggccgtggccgaagacggtgaggaaggagatgacgacggtggtgtagaggccggtgtcgcaggtcgaacgcaatgagccctcgtccttgttccggccccagatgacggtgagctcgccggtcttgccggcagcggcggcgccattgatgatgaggagcacgagcaagctgcaatgcagagtagccaacagaggcggccggagttggagcttcgacatcttctcgatcgggccgatgatacaacacgcacacactaattcagttcattcagtacacaaattgaagtcagtgacagtcagtatatgtagctcactgatcactagctagacataccgtacgtatgtacggatcatgtcggcgccgtgtacaaattgaagtcagtcggtctcttcctgtgtgctgcagatagcacgggatgcagtagtgctggtgcatgcatgtatacaagtgaatgcagagaaaaaaagattgatgagctggctagatcgagaacgaaataatcagctgcaactttggtcataatctgggtggcatgcaattaagtcgtgtgctgtacataggaaatatgcatggagtatcaaaggtggataaaaataaaaaccaaatacacagtttacgtgtaaattgcaatacgaatcttttaaacctaattacgccataatttgtcaatgtggtgctacagtaaacatttgctaataacggattaattaggcttaataaattcgtcttgcagtttcatgacggaatctgtaatttgttttattattagactacgtttaatatttaaatgtgtgttcgtatccgatgtgacatgtagacctaacgaaatctataatttgttttattattagactacgtttaatatttaaatgtgtgttcgtatccgatttgacatatagagacaaaaaattttgctaaaaacaagtcctaaatattccattcaaatgagtccaatctttggttgcttggttcttgttcatctgcttgatttgaggcaggggcggtaccttgaccaaacaaaatcctactactgactaaaacttcaattcgtgcttgcgtgcgtgtttctgagtcatcagtgcgcgcgaggaagggaagcttatcacaaatactaacttggtagaaaaaaaaagtttattaagtagtgcatccacattgtcataggctaaacattgtatctgttttattgattcctaaatattttttgtactaaatggctgtaagttttttttcgctgtagtatactgcaagacagtacggtactatagcacacagcacataaaccactgtatattgagtgtatctaaacgaagagatcaagcagctgcagggaggaactggcccgaattctggcatgacgatctgcttatggcccagatcaatatttctaggccgatgcctcctcatgtggccacctagggcctggcccatctgaaagccaaacccacacacctcgcacgcgtggattagaggcttggacgggccgggccgccgcttgtggtagtgggccgaaggtgactggtccggtggccgccgagcgcctggtgcgacgggaaccgccgcccgcacgtccggcactcgaacgccgccgccgccgcctcctcgtcccgccggcgacgccgtggctccgcgtcctcctcatcgccggacgatgacatcgccgtcgtcgagccgcacgccagcgacagcgagagctgcacgtcgagctccgcgagctggctaagttggttatcgtcttcttcttcctcgagctcaagctgcagatcactagtgtagtcctcctgctggtccatggcggtgacgacgacgaagacgtcgctatctctcgcgaacgcaaaggttacacttacacttacacttcactagcttgggttaattaacaaaagattagattcaggtgaagcggccaagccatcatagcatatatttatagagagatctatcgatggatcgaatatataataatgcatgtgcagtgttaatcagtgtgtgacatgcatatatgcaagggtgtcacgcaagaaactactcgtaagagatagagatggaatatgttccatttcggtttgatttacacgtaggtacgagaatcatgcaagccgcgtgtaccactagatctattaatttcagtgtaattaattactagcagcgtcgtcaagtcctcagtccatgcttgtacttaaattaggatatctggatttggataactccggtcctaattaacttagtgagcaagtttgtggtaactactcctatagcagagaaattaatgcggaagtacttccattaagtcatccatcacaacacaactgcatgctaattaacatggctgtagttattagtagttggtaatctcctttaattcgcactccatagcttagagatttcgaacctactatgtcaaaatattagtaataccaaaacctagctaagttttgataatgctaactttttagttatgtgtcttgttgacatactttgatagtaaaccaaacactagcaatgttactatttgaagtgccaataattcaataggtaatattttggcttcaaaccaaaatggtcattcaagctatctttgcctgggagaagcatgcatcaaaatgttgatgatatcgtagatacatggctccatccacccaagccaagttgaaattaaatctaattttcacaaatattacatgcacatggatgtgcttttaataggattttagtgacattaaagatttaccgttggttttgtactcactagctagttagtgtgcgtatactaagcgtgcgtatctcccgtgtaataaattttttttattgcatgcttgtttaatttatagatgtgttgcaaataattagttaagaaatatatgtggtatgaaaagaacatgggactaattaatggcatgaatcaagacattagtttggaataagacaaggaattattagctactctttagtgctataggaaccttgctgtgctagcttatgactaaagttgtgggtacgtaggtcaagctagtctcctgaaaacaaactatacttattaagccatcactcatgcaggaccgctcgttacgtgttgtagatgagattcagatccatatcttagattgttcctgcagtgggatgccaaccaaaaaacgatgggccaatcgatcgaatcaaaattaatattaattaagaaaattatctgttaggaagttgcttcgaaattgcatggtgatctatcgaattcgttgatatttctttttgttttttgaagactattcagccattcattcattaatagtatagcagtacacaactagctagtgcccagtgacacaaaaaaaactgacctgtcaacaacaagcaaatttcatggaaattctgcagcatatatgctgtactccggtagcttccatcgtccatcgtttaattagttgcttaattagatttccaccaatcaaacaactgcgatgcgtcgtcgatcgcatgcatatgcgttaattaattagctcatatgttgatcgacgacgacaagctgatcagtagtaccatatactgctagctacttggcattgtactgtactagcaacgaacgtaatctacattgaccttgtcgcattattttaactatactctctccattttatattacttatcattttagcttaatttatcctatataaaactttcatatctctgataatcaaatttagacattcataaagtttaaaattatgagtgttatattttggattcattatagtaagaaatactttcataatacatcattggtatatatattgttaaattatagaaaattttaaaaattaatggtcaatataaaaatgtttaaattaaaaaataaaacaataaataattttgaacagatggagtacttaattagtttaggatagctactagctgcttagcttgtagtataagatgtgatatgcatatattagcgtattaattagtcacagtttagatttcaacttttgccttcaaacttctaacttttccgtcacatcgaactttcctacacatacaaacttctaacttttccgtcacatcgtttcaattttttcaaacttttaattttggcgtggaactaaacacatccttagtgcgacagtacattaccgtgttatatagcaagcacgtcgatcggtcgcgtacgcgtacatagttcaaattgaaggatgcatatatataaacaaatggacaattctgtattttctcttgactagaaaaaatgcccgtgtgttacaacgggtaaagtctattttaatcttattattgttatatggtttagttaagatgaaattcattatgggagtgcgcttggatatatatttttaaaaaatcatgagctgtagttaggagtgcgatcgtctcaagttagcatgcgagttttttttaaacagatttcttatatgattccttctgtattaccaaaagtgaacgattttaaaaaccgactcaaatacggatatatattttcataagcaaacgaacttaaaaaccgactcatacacggatgacgtaccaaaataccgacaaaaacatcttcaatttttataatagtagagaagaaatatagattaaaaccaaaacataaaattaaaaccgacttaaacatggacgacgaactgcggatatgataacaaatatcatgacgatcatgtcatggaaaccaccaataatcacataacaaaatctgtaacgaaaacaaccattttcaagagcaatatatatatagtggttgaacttgaaacatgttccattgaacgaatacaattaaaatcacgtgtatttaatcattgaaaaaatataattgaacattacaaaatcaaagacgaacttaattggtattgtatcttgtggcgtatacgtgtatatatatctagctataagcatgttgcgtgtttgtataccactccagaacaaacttaattattattgacattaatcactggttttattcaattcatatattgatttgtccattagccactcacaaaaagtggatgaaattataattgtgcacgtcgtcgtcgtcgtcgtcgtcacgctcttccgacgaggagccggacattgtcgccgccgccgccgccgccgccgtccacgtcgtggacattgtgccattacgactcaccagcggccggtggcggcgcatgtggccgccgagcgcctggccggtggcgaacaccttgccgcacatgtcgcaccggtgcactaccggcgtcgaggcgccgccggcgccgagcttgccggggcgcgcgccgaggaggaggtcaaggccgtcggcgcgcacccgcggccgcttgtggctggtccggtggccgccgagagcctggaacgtggagaaccgccgcccgcatgtccggcactggaacgcgccgccgtcgaggtgcacccgcttcacgccgccgccgcccttggcgatcaccttgctcgccggcgacagtgtcagcaccagcattagcttcaccggcgatcgtgtcgccgtattggtggccacttccatcgtcggtaaactaatgagcttaaagcttaattatatatattaattaacaccttaattgctgcatgcaaaattaaagtgttaatagcaaaccagctaccgaatgttctaatgtcaagagatgggatggtatatatagatcgagaggttggccggggacgttgaccggaagtcaacgtcgagctcgaggcagtacacatgtgtgaagttgccttgtgtttcatggaattttagttggagcgtgtaaacgcgcgcgaacgtatgcttgtgacgacacaatcttacgcactagtgtgcgcgaggatgagatcgatgccttcagctcgcatcctaccgtccgctctgccttgagattcgtgcggtagtttctgggaagctacgtgcacatggattcttgcacacggaaatattatcttgtggatagctagtatgcaatgccgtgtttacgaagaccgaattcccttgggtttgcatatgtgtggatacgatgttgtcattgcaaatgggaacaagaacttaagcgtgtgttgcatcttcaatttccttgttcgttggtgaagtgacatgtgccacatgcatcttctatcttccatagttgaaaagtattaatttgtactactcaatatccactatccaaaaaaaaaacaaatattaatgacctagacttaacatcgaatcatctttactggattggatattgatcaaagaaacgggctaaccaattgactcagaatgagagtcagacttaatatgtttaacaaataattaacagaaattggatagcaaaaacgctgaactaaaactctatttctttgcttctagccgtgttgtctcctagaaggaggaaattaaccatgtaagatgttctattggccattaactcgtgtgtcacatgataactattttaaacaatccatgttatcatcttgatgtttactagttcaaaattataaaattattaaatcatggaaaatatcataattgagatttcaggacaacttggtatttagtattacttttaaatgataagatactagttaaaaactgaatctgcagactaattacaactaaacttaagcgtgttggatattcaaaatgttcatcttttcttgtttgttggtgaagtggcattcatatctttctctggtaggagagtgttagtttgtacttaatatcaattaatgaccaagacttaattaagatttagtaatgcatcttgttcggttggttggatatggaccagagtaacttgtgtactggctaaaaccaatggtgagactgagactttgtttatcaaatcagagaaagtgtatgacaaaaatacttaacttgaacactgttttgataatatataaaaaggcaaacagtgagctaaatttgcttccagccgtgttgtctcccacagggaggaaacttacttagatttggtccatgttgatttacatattcaatcttgcgaaggaactcatcaattgtttatggaagtgatacacaaatacgctgtcaatctatgtagtctgcaattaatgattattggtttcgggtacaggtacccctttgttgaaatttaaaaattgcctgatattttagaagtaacttatgggcaattgggcattttcacaacagaacaatacaatgactttgttctaaagtcaccagtcaaaattaaatacggaacaaacctgtggcttttgcctatccaagtggttgaatgcactagtgaatttagtttgccgtttggtagctacaaaactgatcaaagccaagttgagcattcaaatacatttggatgcaattaattaattaggctagtatattaattgttaggagtcgatcctattcctatgcttccaaaagagccaaagaagatagttgaaaaagtaagggttaattggatttatgccactgcaaatatgacaaattaaaaatatgccactactattcacgctatctgctggatgccactgtaaatttctaaaattgaaaccatgccactccgtcactctttccatcctccccgtcaatctttccgtcatccccatcctctctccggcatgttcaccacgttgacccgctccttcatcttgccgacggccatgagctcgaggaggaagtcgaggaagtcgctgtcgtggccgtccgggtgcacggcgtaggcggtgacgaacatggggtcacggccggcggcgatggcgaggggacgctctcccatgaccaccgctccgtccggtgtgctacgtcgtcaccaaggcggccgtggtgttcggcgcggcgcctgacgaggccgggctggggctgcaggccatgttcctcatgtcgctcgcgctcgccgacacgcacatcgccatggcctaccgcgccagctgccgtgaacgatgccgcctgctcgtctacagaatcaacgtcgaagctataagtgattgattcccttatttgctcgtatcgtatctaaaccctggattttgcttagtggtagcttgttgtcgaaacaagatttcggcaatactaaaatgggtggctatcaagctagaaaagtcgatgggtttggaaacaaggaattttatataggttcaggctttcttaatcaagaagtaataccctacttgtagtgtggattggaaacatattgaacccaaaatatgcaagctttccagattctaatccgtgttttcgagagattctggagaacaatcgaggcatacgcttgccaaccttttactggacatgacaacggccggaagaacccgacgtcccctcacgcgaggaaagcaatggtggagcggtggccggcggacgagggcgggaggaggcaccgccgcttcttcttgccgccgccggctgcggcgcagggtgtggagaaggtgaccgcggagttcgcgcgctcgatgcggagctcggcgacgaggtgcaggtcgcgacgtacctacggtcggcgaggtggccgagcaccgcgtcggcggcagcgtcatccggggcggtggagaggaggagaacggggagaagatggggaagacggaaagattgacgggagagtaacgggagtggcatggattcaattttaaaaatttcggtggcatccagcagataacgtgaatagtagtggtatatttttgatttaccatatttgcagtggcatggatccaattaacccaaaaagtaaatggttatccagaggaaaagtacttcaggtaattgatgagagtaagaccaggcagctagttaattgtagactcaattgcagaagttacagagaaatacattcagaaatagctgtagatgtggtaaaatatacggccagtggtagtcaacgagcgtacgcagtcgtatgtatgtataattgcaacgaattgaaacaatcaatcatgtgaacaccaggtagaaagagacgtcaaattataggttaaatcgaccttgcattagatatttacaatgagagatctttacagtggagtatgctggaaaactgcgtgaatgatgctgttaaattgttagtactgaattaactccaattgggccgtcttggcgataaatttctaatgggctttttattcgtcggctgcttgatcaaacacagactggctgaaaagggaaaagtacacgcaaggtccctcaacttgtcatcgagatacaaaatcgtccctaaaccgcaaaaccggacatgcggcatcccccaacttacaaaaccggtcataaaagatccctcggcggttttcaccccggttttgccccacgtggcggttgactcagcgtgggacccacgtgggccccacatgtcatggagaccacgtcagcctcctctctctcttctctttcccttcctctcccttcctcatctctctctctcacttatctgtaaagctagccggggcgagcaggagaggaggagggcggcgccacgacggcgacggcggcggcggcggccatagtggggaagcacggcggaggcgcggggagcccggaaccctgccgacgacggcgagcccgtagcccttgagcccgacaaactttgctacctaggcgccgatgccgtactcgcgggagtcgacagcgaggccgagctcgacgttggcctggacggtgtcgtggccgtcgtccaggaggttgtaggcgcagtggccgtgcgaccaggggagcaaggtgtcggcggcgacgacgcgggagcaggggagcaaggcggcggcgatgggcgcggccttgacctcgccacggtgcgcagcctcaacggcgtccgcgtggccgacgagatcctgcggcttgtccctgacgctggcacgttccacaccacgctgcggtgcgtgaaggaatcgacaagctgctcagaggattcgacggcgccgtgccgtcgcatcatccgtcgtcgtcttgtagccagcaaggagctgcggcggcagcggcagcgggagcgggaggacatcttncgctcggncgcctcgacgccgaggatctccaggcggcgcggtcgacggggaaggagcggcggagaggatatcgaccggnctgctccccacccgacgaacgcgagcgcgagcgtgaggttcgtgctgggtggtgacgcggcggtggagacacgggacagcaagctcggcggcggcaggcgagcgcggctgcggatggggagcggcggcgccgacgactccgcgccgctcggcctcatcgtcgtcggcggctccgggcgcgggcggaggtctcctctgataggcgatggcggccacggtcaccgcgccactgtacgcggcgggggcgtcgcaccgcctgcttctcgtcgctcgtccaccatcaccgaccgcacgagggggacgaggaggccggcgagctcgcgccgccctgagcccgcgcgccgccaccgaggagccgccgtcgccggctgcaccaccctccggccgcgcgcgccgccgcctgtgcgagagcagagagcgagaggaaggaaggagagagagagaggagaaaaagagagagggtgctgatgtggtctccatgacctgtggggtccacgtgggtcccacgctgagtcagccgccacgtgggacaaaacaggggtcaaaaccgccgagggaacttttgtgaccggttttgtaagttgggggacaccggatatccggttttgcggttcggggacgattttgtatctcgctaacaagttgagggaccttgcgtgtacttttcctggctgaaaaaaacggaagtattgaggaagataggcccaacaagaggaaggcctaatatagaagcagcccaagagcccggattcttctggtcgggtgaccaacgcaatacatggcattttctttttccagatagaatgaaatggaacggtgaatggtatgatttaaaaaacttattgttacaatacttcttataaaacccatttaaaaatttatttatggacttgtagcagttaatttattgtcttcactcctaaataattatcgcaaaatcactcagggtttcagccaatttttcgggaaaagtatacattgtggtacgtgtagttgatctcaaactaaaaccacacaaagtgatcgaattcgtgcagatgaggcccatccatttgtgcgcatggcaacatacatactccatatatttgctgcttgatatgatcgatatcgacttatctgaacgtcaagatcgatcgtgccccatgaatgacggatcgatcgatcaatttattattgtttcttgtctccatcatatataatcctcttctgttcatcaaagcctttttgatacacaacaaggtgacaaggataaaacggacgcacacagcatatatatccatctgaaaccacgcttatacgtgccacaagaatccacagaatacggaataaatatttccttcttgtcgaatagttccatgtatatccagaagataaaattaaaaattgaggaaatagatatccaaattaaattgtcaataaacatgaagcttaattaataagggtcagtttgttttttttgggggaggggtagaagagattaggagttatatggagggctaggcatatagcagttttggtgggatagagattgagagaacttcctacttttcaatatctggagggaactgctcctttacgttgcctaaacaatacttagccctctcttttctaagcaaaacttaatctctatctaaagtctgtgtcgattcccaccatctttacaaataaaagattaaaaaatcaaattcccaaacatcaccatcaattctctcgtctaaactcttaatattcttactcgtcttgccaaacttagtgctattatagatgattagtatatatttcccctctttcgtatcatatgtccctttggtttgccctaaagcgaacctttttaatttttttatcaaaattataaaataataaggcaacattttaaaacaaaaataaatatattacaaaatatgatcgatagtggattttatgaaactaatttggtgttgtaaatgttgttatatttttttataaactttgtaaggttttatgcccatagcttctcggaaagaagaagagtcattgtcgttacaacaaacataatatgaaacagagggagttgaatgatttcacttcacaaattttgcctgtggcaggtatccaccaatttattcctgtccacttcaagtctcaaacttgaagcttaaattttgtcaagtcatctggattctgtgatctacagaaccttttatatactcagaagtgtaggttggaatatgaatgtacatctctttgtattttcctcacttttacccctatttactatgaactttatattgtgttggtggtcattagtttgtgcatccttttttgttttgtgctctttgttaagagaatgttttgtgctctccgagaggtttggttatgctttttgttagacgaatattgtaataaatgaccgtaggatttattccatcgtccaaaaaaattctaatgtttttactgagaactcatgcaactataaatttagtgcacaacgtgtagtgtgaaccacggctcttggttggtgcaagtcacggtgtgaacccttttttctccttcacaaacttggataatggcaatgatcagctaatggtgaccccaattttgttcaataatagtatattcttttgtgacagagacccaattgtttgtcatgtaatttgagtccacatcatcacagtaccctactcttatactcctctatacaaatacaactacaatattcatctatacttttatatgtcatggttgttaacccaaatctcttgtaatgcaaatataacaacgagacaaaaaaagaaaatcacaattttatagtcaactagtaccaaataagccaaaaattacccttatcgtaaagacacatctacatcgtcaaattaagcgaatgacatttcttatcttaattaaatcattctacataaaatcctcgatccgactcaaattattccccatttagacaagatcgtctaagataacctccatttcttcacagaatacactcaaacgtacctccatacatatttgtatacacatacaaattgattatacacaagttcctatagaagatacatataacatgatactactacatctacaaataaagatagagggggagaaagagaaagaactccatcttccatagttccatccaacatccaggcagaggcagagccatccttggcttcccaaaaactctcttttttctcttctcccttcctttgttgcttctcctcctcctccatcgtctcctcttcaccttgcgtcctccccatccaaagctcacaacttgacgacacacgcacacgcgctcccatgtcctgtagcctcctctccatgtcaagccacgccgccccctcgccgtcgcagccgtgagacatccctccgcgccgcggcgagacttcccctgtgtccatgttcgccgctggttcttgattcgttcaggtctcgtgacaaacttgcttctcctcctgatttaatttgtccggtgcgggaagggaagcctccctctgcagcatggcgccgttgcgcggggccaagcgccggaggaaggcggcggcggagaagaaggctgcaatggcggcggccgctgcggcgggtggcgcgcccggagcaggcggcggcgactggtgggacggcttctgcatgcggatgtcaggtgcgtgcatctctctgagtctgtctgtctgtctgcgacgacggcggcggcggtggtggtgccccccgtacgtctcggtgagatttgtgcagattgcgtggcacgtcggtggctgctctggtgccgattttttttttagatctaatttgcatcgggttcgaattcttggagagctgaagtaatcttgtgctttatcgatcatatcaaggagcagttataaacttgttataaatggtggtactgcaataccactgtctgtctggtgatgctgcattctgatggatggacagccactttagtcttaggatttgtttaggacacctgctgctgttgctgcattatatcagttccgaatcgtagagaattttgagctatcaattcagatcaatcgattattctgattactatcagcaagttgatatgctcgtgcagttatcatgtctagcaaatcgagtatggtttcagagcaaatgcaggctgcagacaccatgaaattgaaagataattgcttgtttaattactgatgctagtcattgcttcttctgtatgttcccattttccaagctaaatgtgagagaataattcctgtcacagtagatgtgttctgcacttctgtattggctatatggaaagctcctgatcagtccataaaaaggcgagatgtactatagctactcttcctctaagtatgccgtgctagtcagtggcgaagccaggatttagagatggggggtgccatttacgagacgtggtaactcacttaaggttaagtgaacagtgatattgtagcgttgatgtatgatcactaactcgacatcatacatgttatagcgattagctagaagagagaatgagaacccatagatcataatttgccaatttaaacagtttgttccatgattttaattggagtcttgtaatcatttttaaaatgataaatcagttaactaagtcatttcataagtcctatatatagctaggcagttatcctatatagctaagctcatctgcaactaatgatgtaattaatggctagattataagggctaattatccttgggagaagagatgggaggggaggtcacataggggttaggggggtgttggccctccctggcccctacggtggcttcgccactggtgctagttgcagatcatgaagttatacatgtgatccaaccatatgcagcaccaaagcaactgttgttctaaacaatagccagaattggtttcgaactctttctagatggtaggggagttacatttttttttggaggaccaaattactgcagggatagcccccacagtattgtggtaccattttcttccaagttgcaaagtttctttagtcctgatttggtggtttagtaatatcacattgagagaagcacatcttccgcaaaagggtagtattgatttttctgactatcttcagacttcagcgaagggagatggattctaagttattacatatatctaaacgcaagcaaccaaaagacttaggaacttacatatactattattcaatgattgagctttctgctagttgtatttgttcaattaactgcaaacaagtttgtaaaatagcttgatgtttatccaaatcgcaacatatactgaccattttttatttccttttcaggaaccttgtctggtatacaggatgcacaaagatttgagtttatcttcaaaatgccaaggagaaccttcaactacatctgtggtttggtgagagatgaaatgatggtgaggtctagcagctatacctttcttgatgggaaggtgctgtctttagaagatcgggtggcggtggctctgataaggttgaattctggcggatcactagtgactgtaggatctgctgttggtgtaaaccactcaaccgtgtcactgattacttggaggtttgttgaggctatggaggagcgagcaagccaccatttgcggtggccagattccagtgaagtggagaagatcaaatccatgtttgagaagatacatggtttgccaaactgctgcggtgttgtagacacaacacatatcacaatgtgcctttcttcagctgagccaaactgtaaggtctggctagaccatgagaaaaattacagcatggtcttgcaagctgttatcagtccagatatgaggttcatggacattgtgacagggtggcctggtagcatgaaagagtcgagcattttgcatagctctggtcttttcaagatgtgcgagaaaggagcacggcttaacggcagcaagatggtagtgtctgatgggtcagaaattggtgaatacataattggtgatgcaggatacccccttcttccctggcttctcacaccgtaccaagaaaaggacctctcagattctaagctggagttcaataagagacacgcagcggccataacagttgctccaagtacattggcgaacttcaaggacacatggaaattcctgcatggcgagatgtggcgccccgacaagcacaggctgcctcggataatccatgtgtgctgcatgctgcacaacataatcatatgccttcaggatgcaaccatcgacgaggcagccatgtcgaacgatcacgacgcgaattacaagcagcaggtgtgccagttagcagatgagaatgctgtgagggtgagggacaaactgtctgagcacttggtcagcaggtgaggacaagagaagaaagagggtgtggatgtcccgaagaaactgaaccttcttagtctgctgcagcctgcagctgagtcttttagctgtgagtttcagttttgatgagtttgtttatttcttttaggggagaaaggggtagtgctaaactgctaattagtcagtcagttgtgacaaatgaaaacccaactgtaaccgtagagctctccagctcgcccctgtgatgtgaattacatttgattactttggttctgaatgaaaaatatcatacagatcaaagctaaagttgaactgcggaaactatctatgaaatcattggcatgattaatatttgtgatgaacaattagctttgcaaatgatttaatcaatgaatttgtttgagaatatgtgtgcatgttggtgtgagtgcgtgtgactaatgtgggtcaggttgtgatatttgtgcccaaaaacggttgttttgcctgattatatgtaggtaacttgaggtcagccttggtcaatggtgaggaccaagactatgctcatggaggagcaaaggtctagtgtggtcgggatatcatgtgaaaaagtgactagtcaggattcttagagattaattttggtcaacggtagggatcgagactagacttagggaggagttgaggtctagacggtcaaggatgctgggtgacgaagttggatacgagatggcacacgttggatggacacactgtgtgaaagagatattcgcaacaggcttcacgaggtgtgcgtgcaagcgtcgatgttcacgaagaaaattggttaaagaaaattgagcaagaggatatggtgctacagtccatgtgacactgtagcggcatgtatggatggcatcgatgcatgcatgtgtgtgttggctgtttgggaggcaagcagcatgcagcggctcggcaggcagagtcgggtcggttggctgcaggccgagtcggcaaggtggcagtccgactcggttggcgtttggtgtggctgcaggtttcggagagtttgagagaattacaaatttggtacgttgtaatttgatttggtaatcgacggatagagtcatagtgaaactagggggtcctattcctattttgagtaggagattttcaatataaataaagagggatggtatgtcttgagggtaagcaagtttgagaggttagacagggtttcatgagaaacttacgagaagtgttgtggctgcaccttgtgaacaatatacttgagaaatatagatcatattcaatcattaaggcatcgacgatctcttctagcttcgtaagttttatgtttatgtttggttttggcgttagcttgtgaatgttagttttgctacgattttgttaaagttaatccatccaaaacctttttaatacttcatagatcagatctggaaagtttcgttagttggttcttgctagattcgaattttgcttaagttttaggttttgtttagttttgctgaaattctgagacagctgactttcgatggtgttttctcttaaaccgtccggtggagttgttacttggtttgtctagtttattatatcaagtttgcaactcgatctaacggttggtttaagagaaatcgtgtttttacataagcattgtcgtgttgtttttaggctgacagtcagactgcgagaatacatgcggtcagaccggctaggcttcagtcaaaccgatcctagaaggtcggatagacaaccaaacgtgtgtgtgttttgatcaatcaagttttgattatttgacttccgctggcgtaatctaccattcaccctcctttctgctagatttggttacttgtgttcgattctgcactatccttttgcctcattcgggagtaaatttgttcatttccattgtaatcggtaaagaaacagaaattggaaaataccatcagaaacacctacgcgtgtatgtatgtatggaggcaattaaacttggtgtggttagtattagtgttgatttgttcccttttaagaaaaaaaaatccttcataatattattatgagtttgctgaatcttataaacaaaatttagtaatcaaagttactccatatgtggatacggtttcaagggaagagcgcttgaagaagacgtactccgattccttataagtttcatgaaaaagggccatagatgatggatcaagacccaacggggaggtaatccggccatggatcaagccgaccgccgtcgccgccgccgccaccaggagcttgaacatgcggcggctgatgatgattacggtggtgcctcctcttatcacctcccgctgccctccggattcaaggtacatttatcttgtcattttttatttttaaaattttttcataactctttagttgacatacaataaatggtttaaatttttcacaactattttttataattatttagatgccatgcatctatttgagtatttgagttttgtttgttacttgtacaagttaaatttgtacttgtatgcttgtgaagtgatatattatatattgatctatcttatcaatttttttgaaaattttttataactttagttgacatgcaataaacgggtagatatccactcgagttattagaatccatcttatcttatacaattgatcaaaccaataatccacttcgttgtgtgactgtgatatagtatgctttgctgttgcttatacagattccccgtttgcctactactgcctgcgccttgatgaggaggaagaagacgcacagaacgaagctctcgttggagaagctcagactaccgtccttgctatataggagtatattcattggtaaagtgagctgatagaatgttaatcgacacagctgttttgtatgtaggacctgctatgcaaagtggtatcacaactcacattaaaagaagcagggaagacaagcatactttcttctcggtggaaagatcgatggacatatcattctaatctctgttttgatcactccgagtttccaagatacaccgcagacagatttatcaactatgttaaccatgtgttgcagcagcacagcttcttggcggtggacaggttcgagatcaggtttccactccagaaacagcagacaaaacatgtggatagctgggttgcttttgcctctgcatcaagagcaaaacattttgtgcttgatttgagcccagctgtgcacaccaatcaccaaagtgaagagcacatgtatgtatttccagttgatcttctcgatggtcaaaatggctctcctatcatatctctccggctcggccttgtgtgcttaaagcttccttctgattttcttgcatagtttggggcatttttccctggtaattaggaaggttgtaactgctatagccaatcatagcctctgtttgtactaactattttcaattaacaccctgttctaaaagtacgatttctccaaaattcgtagtacatcagcattgtttagacaacttgttcaaagctacagtgtttgttaagtttataatatataatagttgatttatccagcgttcttaagcatttctcaactaatttaaacggccaagtggttcttgattcaattgtataaggcagttgtacatgatgtgtcaggcaggttgcatttcagagcatgcttttgctgctattgaactacctctttcatttctatcttaaatatacgtagtcagtaagaattcatcacatcaaggagctaagctagccaagtagtagccatggctctggccttcgccgtgctcgccaccttcgccgcggcggcgacgccgaccaccaccaccaacctcaccctccacaacctctgcacccaccctgtctggccgctcgtcaccgccaacgccggcctccccgccatcgccgacgccgccggcgcggccacccgcctcgacggcaacggcgacggcctcgccaccctcgcgttcccgccgggggcgtggtccgggcgcgtggtggcgcgcaccggctgcagaggcaacggcagcagcaggtgcgacacgggcgacgcgccgccggtgacggtggcgcaggtgagcgtgcacggggcgggcgggctggcggagtacagcgtgagcctggtggacgggttcaacgtggcggtggtggtgacgccgcacgggttcgagcaggggcggctgtgcccgtcgctcgggtgcgccgtggacctcgccgcggactgccccggcgacgggggcaggggggggtgcatggcggcggggcaggcggaggcgttcaaggcgaggtgcccggacacgaggacgacgccgacggacgtggaggtgacgccgcagcggtgcatccagccagccgagctcaaggtcgtcttctgcccgccggacaacacctcctccactcactgactgattcattgatggttagcaaggaggagtagtgattagtcgcaaataataatcctaattagcacgtagtaagaggcttcatgcgctgatggtgattgcattaagaaggcgcgcgtctgttcgtcgccggtagctacacttgttactgttagaaatgcatgctgtacgtgtgattcattcaataaatggtttaactccgaatctgccagttcagacctcaatccgatttatttgaaccatcaccaaattgaattccactagctacatagctaggccacaaacaatgcatggtacaaattcgtaaggttattattaatctgtgtggctgaggattgagatgtagtacaattagtatatggcatctgcaatatgctacgcatgtctctctccatcagtgccctgcttaattggtagctcaggcaaaataattatatttaccaccattgccgtcagggctccgatgcatatatgcttcattttcatttcgactttataagagtatattttactttaagggatactccttccaatttcataattcttaatgctttagataatgacaaggttttcaaaatatatctttgactatgttttttctattataacatgtacaataaattaaatatattttagctttagtaatttgtaagataaatctatatatatatatatatatatatgttgttctagtgaattagaaataaatattttttatattaatagttaaaattataaaagtttgatcccaatcttatcgaaaacgtcaagaattatgaagccggaggaaggattgagatatgattgattattatatcatatactctaatagacttgctctcgttttccctaatgctagtgctacgtccgtggtttacaacgaaattgcgaggaacatcaatgaatagttgtatgggttcaatttttatctatgtttttctgcgggccgggttggtttgtttcctacgcgaccaggaaagtaggatggtggaagaaaagatgtccgcttttaaagtagtggagcaacgaagcactatggagtatataggtccatttttaatataaatcaatatggagtatataggtagttagtggtagtaagtagttaaccttatgacgaagtaatcaccaaattaaggccatgcatggacgtctcctcttcctcttcgtatatatataccacacgacagcggttgcatccatccatcgatcagaggaggcatcatgaaggcgtccatggcgttcaccgtcctcgcgctcgccgtcgtcgccgtctccggtgcggcggcggcgtggaccaccaccttcaccatgcacaacctctgcccctacacggtctggccgctcgtcacccccaacgccggtcagcccgccatcatcaccggcggcgccaccatccgcctcgaccccaacggcctcgccagcctcgcgttcccggccgccgccgggtggtcgggccgcgtcgtgccgcgcaccggctgcaccggggcggccacgtgcgccaccggcgacgcgccgccggccaccgtggcgcaggtgagcgtgaacgcggcgggcgggctggcggagtacagcgtgagcctggtcgacggcttcaacgtgccggcgacgatcacgccgcacgcgttcgacgggagccagacgtgcccggtgctggggtgcgccgcggacatcaacgcggcgtgccccgcggacgccagggtcggcgccgggtgcagggcctcgccgcagttcttcaaggagatgtgccccgaggcgaggacgacggcgaccgacgtggaggcgacgccgcagaagtgcttcggccccggcgagctcaaggtcgtcttctgcccaaccaattgatgactgatcgatcaagccatcatccatatatgtggtcaattggcgatggaattaataagcttgcgattaaattatttgtgtgatttctgtgtacgtgaccatgtaacaaaaattcctttcaaaatctaaaaataaaaaaaatcgtggcatttggttccaaagcacaaggctacaaatggcggcatcacatcacatcagccattccaacctcgtagcaaccgtcgaacaccttgtcttgtagtcgccatggccaacaaccatgcctaagcaaagcagagcgacacctgatcgcgatcgggctcaatcatcaaagcctcgtcgcccatgtctctcccgggggtgagcgcgtcgacgttcaagtcgccggtgttcatcggcctcctggccgtcatgtgcgtcgccgtcgtgctcctgctgcaccactgcgtcctcgtcaccttctgcgacaccaggaggcgccgtcgacgccgacgccgccggggcacctccacgcagcagcagcacgtgcagcagggggaggacgacgacgacgacgacgacgaggacgacatgatgagctcgtcgtcgcaggcgaagctggtggtgtgcccgtacaagaaggcggaggagtggggcgaggcgatgtgcccggtgtgcctgtcggagttcggcgacggcgaggcggtgcgcgtgctgccggagtgcatgcactacttccacgtggactgcatcggcacctggctccgcgccaacaccagctgcccgctctgccgcgccgacaccacgcccagctccggcgatctccaccaccacctctccatctccgtctccctagaagaaatcctagtgcgcacctagcacccacttcaccaccgcgatattatagctgtgggcgggcggctcgccggcctaaccaaatggctggctggtgccgtagcggagtgtaagcagctgctctgcttcagtttttggagggagatgcagaaatgaaattcgttttttgcctggatttgatgcaatccgatcaatgatgaaatgtttgtctgcaaatcaatctagcagtaactgttaaattcttactcattcttatgcacatctgcaggtgatttagattgacaccctgactttcaatatcctattgaaatgaaatgcagaactgtacacaactttgctcatggtttttcgtatgcagatgaaagtagtctaattctacgaattgaggatgatgaacaaagagcaatcgtgctgcaaatagtaaagatttggacatctcccagagcattgagagtaaccagagaaaacgataaaaacgatatgaactacagatttccactcgatagtaacaagtaaacaatccttgtgaccgtcgtcaagcctccataagtaggagtagtatgataagtaagttaccgctaatcactttgcccacggttaatctagctagccaagccacgccaccgacttccggcgatgtccaacaacaacggcaaccccgggtactacaacaacaggaacgccggcgatcagtcggactacaaggcgacgatcgccatcctgttcagcgtcttctttgtcgtcatcctcatcaggctcatccacttcatcatcaaccagtcaaacaaccgcgctccggcgaacggtggcgccgccgctactagcgacaggcggctgggaggcggcggcggcgtttcacgtgtgccggccagacttccccgtcagcgtccgggcggcgccggcgccggcaacggcaccgctatggcgtggcagccaccgccgtgcaccagcacgtaccggagggacgacgggtggaaggagacggcgtgcccggtgtgcctgtcggagttcgccgacggcgagctcatccggctgctgccggagtgcatgcactacttccacgccgcctgcatcgacgagtggctgcgcacgcgcgccacctgcccgctctgccgcgccgcgcccgccggcgatgtctccacggcgtgacataatgctagctcttgtctgtgcatctctttactgtttttttacttcacagataactcattcatcaatgtacattcattccaatataatttgatcatatatattccgccaacaagagattaaaaagtgcttccccatttagcatccgattccgcaaaattcaacctgaattcgcaaactgcagcacttcacagtgcaatgcacgcacgcacactgaaaattttcagactcaccagcagagagaagcagtcgtcaggaaaattattcagaacaaaagcaaccgagggctgttagcttgttaggtgataatatgaccttcttctaggataataagagcttctatatatacaagggggctagaaaatcgaagcctgcagttatgtgcccaacaatctaagaaaaatgatggcataaaatgtctatatgctgattgtacaatgacaccgtatagttatttcttccaagccctatatgctcacatcttcctcagattatcaagccgggcctgtaggtcgtcatctatcccaccgtccccacctccagcggcttcagcttgagcggcaacctttcctgctccaaccggtgcagcaacagcggttgaaggagccccgacaagctgtgtttagagcacaaggttgtcaatgttacattgtgaatcgaaaatcccatccatacaactgctaagttagtgtatcctatcgtagactcaagagaagaatggcatactagcatgatgcttacctctgagttgacgtcgatgccaatttcgtcaaggacctggtttaccagttcttctgtttcttcctcctcctcatcgccctccaaagcatcgtcaatggcatcattcattgtgctactgactatctccatcttctcgttttgtatctcaaactcccgcattatcttctgcagagctggtagattcatctgcctgttcatctgtctcatggcttttgtgacacccttcatggcctcacccatagcttgtgtcgatttcaatgtctgcaagcattcagtaacagccattaggagattttgcacaaaaatagtttgggttgttaagaaaaaggtcagttatctgaatttggtaagactgttcttatcacaatttacggatagaataatccgcttaaatgcccgaacagaactatagcacctgcttgactgagataattacctgaattcgaagagatacaccctgtagctgggacttgagggcatagaattttgtgatctgatgtcttgtgcggataaggtcctttgccataatttttacggctccctgtgaaaaatgttaaagggcatcaaaacatatgccacaaccgatgatcactaaaagcaagcatttggagttctttttctctttttaatttcatgttgggctttgagttacaagcagcacaaaaactataacttagccttaaggggacaaaggtaaattctatgaaatagaaattcatcaaacagatcctgacagaaattctgctttctcctaacagaacatgtcaacaacaaacaaaagcctgtaactgataatctcaaccagattaaattggttagatttaaccaatgtgaagcaatcctatgcaaataaatgtaagcaatgggaactggagagtagaataagataatgtgtatgatacatttttagacctcataacatctgccaagctactgtgcgaaattgcctaatcaaggaagaaatgtaacaccaagccatctattgtataaggtatggtggggatttttatcagacataaagcttagtatgttggcattcagtaaagtatgtgacaaggttgaatcgaatgaaactattgatgaatatgatgggagtatgaaatcataagtgagggaaggcaatgagtttgggggggcgcaccatctgtccttgcttggccaccttcttgatctcggcgatgagcttcttctcctgagcctgcaggccctgcctctccctctcgatctccctgatggatttatccagcatccgcttgttctcccgcagcaactctgcatgccgttgaccaaaaacgaattcaatgaacacaaagacttattctatttcgctccaagaaccaattccgacaagattaacgccgttggatcggaaggaagctattagggttcttccggcgacgggagaaaaatctcgagtttggatcccaatcgggggggaagaagcacgcagatgtggtaaggaggagaaagaggaaggacgaaccggctggggtcttccgcttgccgaagatgaagctcatggcggctcgatcgattggattcgggtttcgatctgctccgcgattacccctttccccctcgctgcgatcgatgcaataacccttcttcttcttcttcttcttcttgggtggattcggttgggttggggattcgcgatggatttgataaattgggtttcgattgattcgtcaccaagtaaaccccgtaacgcgttttagtgagttgtgacgcgatgcggcggggtgaccttttctttgcgtccgtgtcaacgcgatacaaataagtttatcttttctcctttgagttgtttcaaaaaaaaaaacttttcttatttgaatcccaaacgtattcggttggaagctaattttgatttgtttaaaccgaaaacaattagtagctagtactactctaacccctttctgtttatgctagacttgtggccttagatttttaagtcaattttttcctggtttattagttgattttctatacttgctaaaatactccatccgtttcgtaatgtaagactttctagcattacttatattcatatatatgttaataaatctagatgcgtatatctgactagattcattaacttctatgaaaatacaggcaatgttagaaagtcttacatcgtgaaacggaggaagtagtagcacataagctcaagcattttttttctttttttcttcttcgagaagtccaatgcaaccttccctccctacagtccatctaaatttatttgttattttgttgtgaatcatccaaataagtcatcaatcatgttaagttcatgtgttttatattcctgtaggatcggtacctttttctgttttcatagtttcaaaatattgtgttcgaaaaaagacaaagtatgttgtgtagattttctaatcttctaaacataataagcctaaagattaccccgatgttaaatattaggggtaacggcctaactggccatttgtttgacatatttgcgcctgttttttatttaaccagagggaaaatagggggacgttgtcccttgtaccgctctaatgttcgtcgacgtatgcgaggcagtcatagcaaggctgcaagcagtgttgtatgcgaggccactggcttgatcccaaatgggtcaccggcgatcaactgcagtatggcgtcgtccttcggagtgccacctgcattgatctggaaccaccctttggatatgttccatcgctctctaaggattggggttattcgtcagcataacacaacaccggcatcctctattaatatttcgttatggatattggggatgtaaaaaaagaaattagcgctattgatcaatgcacgtgaatagagaaataaagtcgcatgggcaaccggtggaaatggccatagcgtgattttctcccagttttcatgccgagagataaatttctcaacacgttgtgctaaactttcgtgtaccaaccaattatgcttgcattagtaaaaaaaaaattgtatggagacaggcagagtggtgttggatatggattacagaatattggtaagcgttagatatcatattctaccattaataagtagatgccgcgtttgcaatgaactgaatcgatctgtactccgtgtgtatcagtatcatcaattcatcagtgttgtatgtccaggatatatgtatgatccatccatggatggatggttccaatctttgtcagcaaccaagcgatctagctatgtggatcatgtatatggatgcgtcctacaaaagattaaagtagacgcgttgcaggcagctatccatccgctgtgtgctagctacttgttgttctctgtatgccatatgctgatatgcgtatcatccacacaagatatatatgtctctcgatccacttgcctgccaacatgtacaaatcttgttcaggatactgttactgcaagtgttttcaggtaaggagttcaggaagagtctcaactcaagtaaagataagtcatatgaaccacaacatgcaggatgcagcctaatttttctgatgaatagcacagtgcacaaggacagaaagtggcattgctgtcatgggacaagcatatatgttgttttgctttcggtttgatttctagcactagaaaaattcagaggcgctcctgtgcagcagcctgcaggcaaagcaaggctccttccattccgtcagattcaatatcgtcacaggcatgtcatgcacactcagctctccatctccatcggtgattcatcagaggagttgagtgaggtaggtagctatccgtccgttacacttacttagccatcgatgcacgcgtgcttcaatttatgattctactgcatccactgcaagagcccatggcgattggccgtcgtctctcctctcctgaaacctcaaactgaaggttaggttaggttagattagcttagcttaattggataagctcttcgatcgtctgctgaaccatggtcgtggtcatgccgatggatgccgcgcccaccacatcacaatcttgccttttggtttttgctgcagatatgctaaactcatctgtctctactcttcccttgcaagctgcaaaatccattaccaaccactaccggttgttttctattagtcttctcttcccccactccactactaaaagttagtagtaaaacaaagaagaagagtatcaatgactgattgactgactgatgaagagagatcatattggcctgccagttagttgttgcatctcagctttcttgcaaatgttcagaccttcactgcatgcccaataaccatatgaatgcccgtttatatgcgcaacatgaagtggaactgatggttccaattattgtgatatcttcttttattatggttggtttttctgtctggttctaacatgatgagagctagggagaaattatttatttatatatggatggacaatacagattatatttacagatttttggctggtccggtccttcttaacagctgatacagtgcatctcgtgtttagtcatctccagtccacaccacaagcagcagcagctacccggcaaaaacaagcagcagcagcagctagtgattgatgaagaagagaacagaggctggctggttggtatgcaaattccaattaagccaggctacaaccttcagagtgtggtccttaatttcctttgcttcatgcaggatttcagcataagcttgctgattgctgcctacatttgcctaaccaacagaccttctaagcctgccatgtggcccactcgccttgccgggcccacctgtcagcgagacactgtgcagttaacaaccccctctcctccatttgcatctagattgctagcaacatgattgatgtctgacctaatggtattttgtttccatgaggaagcaaatttcatttctttttttttttctcagctggcatctgttgtgcctcgtgacctgaaaatctgtaattttgtctcctcatcaggcaaggtattactctacattaggagaagaatggaacttaattatgcatggatcttctctacccttcatccagccctaccaatctgttttgtttttcatgtggtcctatgtatctgtgatatgcatgctactggtaatagtgtggggggaaaaaaagaaaagaagctgctcatctcagtggtgagaaaacacattgatgggcatatccactatgcacttgttgtattcattgcaaatgatgggcctgtaaaagccatcttttcaatttcatgtctcaggatttgttgctagcctttcatgtgataaacttgtaagcattgcacctggggctcattattgaaattctgaagctaacagtatcatctgcaatggggaaagaaagaaagtccaatgttcttggcttcttgcaaaaaggaataaatacatttgttcagggaaagacctgcaatcaggttctataattctcaattcaacctggcttttgatggattttattctttaagatgactcaaaagacctatcttttgatggtgcaacggttataattgaggtcacaagtagcatatgcttttcttttaactatactagttcatctttgctaatccttgtgcaagtaaatggtgtaccccatgcttgttgataagtttatgttacatccatatttgctgataaattttgctacaaaaggtaggataaaactttgcacatgggtacatctttgtacaaggaagactagcagccagcttactagaacgaaaaactacaaaaaggaccacatatttgtatcctgtgtctgtatgcacggtcgtgtacatccatatttatacggttggtgagaaaatgctgaagaatgaagcagagaaacttgtttgtttcccggcaaatatggtctatgaagcaaggttgtatgtactatactctactgaggaccagacaaagacgcatcttctcacctactagctatgctacctagcttcatttccagaacatattggtatatcttttgcaatagtatgtctgaataatacactaatcttgacgtagtagtagaccagatcaccagagggtccggtgccatggattgaggctacaagtgtcattgttagtgcaattgattatgtctagcatgtatagtgtacatgtatgatgatatagcccatgtctcgaggtgattaaagcttttaagctctcaaggttggaaaaaaaaaggtgagaccatgtgtgtgtacagtaatttcagagtaactgcaacggcaaactgaaacaagtgtgaaagttttcagttgtcaatttggggttcagttttgtttattggagagaatcctggagtcaagtggagattccaacaatcaaaatttaaaaacaaacatgacctgaaaatcaattcaagtcctctagaataaaactaatgttgtgattccttaacaccctcatttagctcagctaatgtaatcatcatcatcatcatcatctctaatccaatccacaaatccctccaaaggccagcttaaatatataggctgtcttgaggacaatgttgatttgttttttgcagaagcaaacatgagagtccctctctccccttccacattccacctccccatgtgatgtgaagccctcccctgtcccctccctacctccatctctctctccctctcttgaacactgagcctctttgcttacatacaattcagtagtgtagtaattcactgcagcagctgcatttgttttggtgctgcactcactcactcgtcttttggtttcttgggggtcaactgtgctgtgctcttccatctttcctttctcctcctcctctgcttctttgattgctttgcactgtttcagctgggtgtgtgcttctcctccattccttggctcctgcaacttttcactgttcttggcaggttcctgtgttgctttgtgttgttgctcttgttctttctgactgttctcttgttcttccataggatcggatcggtacaatacagccattccatccataaaggtggccaaacctcatctttcagattcagcttggttgttttgctgcgtgtgagcaagttttctgagcttttcttttgtgcaagaagcaaagaacaagacaagaatctggcttgcttgttctttatcgttagaaggaatctccgcttgctgctgcttcgtttctgcatctgtttctgttcttctaatggtgaatgaataatccctagagcgagagagagaaagctgtagatagagttaaagatgagagctctgagcagagtcggcgtcgggttggcggtggtgtccgcgctgctactgctcgcgctcgccgccgagctctactacctcttcgtctacaagcgccgccgctccgccgccatctccgacgccggctcctcgccctcctcttcttctcgcgagctgctccagcttttctgcttcaagaagccgcccgcgctcgcctcgacctacgcgcaggagccgcacgccggcgaggcggtgggggccgtgcccgtcgacgacgacgacgacacggtggaggcgcagctgatgcggctgggcagcctcgtcggccccacgcgggtgctcttcaccatcaaggaggagaccaaggaggacctcgagtccgaggacggccggagccggtgcgggaggagccggagcctcgccgagctgctgcattcgtcggagacgccgttcatgacgccggcgtcatcgccgctgccgatggacaagtccttcaaccctctgttcgagcccacggtggcggcggccgtgacggtgtcgccgccgcccaagtttcagttcttgaaggacgccgaggagaagatgtatcggcgggcgctcgccgaggaggccatgagggcgcggaggtcgccgcagacgaggtcaccggcggcggccggagaggaggacggcgggtacatcaccatcatggtggggaagaacaacaaggtcatccccttgccgtcgcctcccagcaatggtgatggtgatctgcagtagtgagttctttgcaaaattttaattaagaaggccttaattaactttgttcatccagtgttctagtgtagctctttgcctgtaattttctctctctctctctctctcttttctttttggtttatggtcttctgatcatgccaaattggatggttggatgtacataacatgaatattatcagcagccaagaacttcagatcaatatatttttcttcttctaatgtgtacttaatgacagtaattttgttgacgtttaacttggtgtaattaatgttttgatagagttctgtcattgttttttcagggtgtttgattgtaacaatttttatgatgtatgtactacgcggttagttatactacatgttacaaacattaaaggattatctgaaaatcaaaattccttcagtgacatgtttattaatctggtttaaccaactgtgagctcagatgaactttttccctttttctcgtgagctgtatgggtggggactgtatagaatactactgtgcactcaattcatccatcagaacagaggaatggagaaaataatatctgaaagctccatgctgacctgtctcaaagtgtaactttatactctcgactattagctaacttatatagggtcttcaaaacaaattccttgcaacttctctcaagttacttaatcaccttttaactgtcatcaagtcacacctcagtcacgcgattagctttagttagttcataatgcaaaattccttgcaatttttgacaagtcttcttgagtccttttgagctgtccttttagtcacaactttattcatactgcctttggaacaaccagggcacagagggaacaatgtattctaggcctttctataagtccaaagtgtggaattctttttatttccacagtgaaagctatcagggaaagatactatattctcattgctgtaattatgacttcatgtgaagtgattctgtttgcactttatccacactgcctttagttagtcttttcatccagccaactcttttgagttttcagttcatagtgcataccacaagccctgactgcctgaccctgtcatctttgtttttcttcatgtgttcttctctggtttatattgatttttacagtcaaagtttacttgagaggtgcagagaaaagattcctagaccaacatcagacttgcagtgtactttaatcaaatccgtaggctatttcttaggaatgtgattgcatttctgattataatcaactagcagtagtgtcaggttacatcatatcttctgattatagcactaaagttatgaaagaaatggaaagagaaattcacaatgtactaagactgtgtttagttcagcgcaaagtttagattttggttgaaattggagatgatgtgactgaaaagttgtgtgtgtatgataggttgatgtgatggaaaaggtccgaagtttagatccaaactttggatctaaacacagactaagtataaatgagttagtacctgtcatgtcctgtctggaattttcagaagtgcatgcataaatggacagagaaaaattctggcgagcaattctacggtccttgagaaggtaccatgaggtactaaaaaattagtgtaaaatttggtatctcatggtacctcatagtacctaggtatcaaaatgtaccaaatttataatagaaaaattggtatctcatggtatctcctcaagtaccattgctctattctggcagttaggcatttttattatcagtgccatgtttggttagtagagcactcatcacatgtactagtaggatcatatttggtctaagatacaaaagatgaatttgggcattcgcattgagttgtactccgcttctttcttagggcccctttgaatcgtagggtagaaaaaacggaggaataggaaaaatacagtattctgataggaattgaagtgtaaaacagaggattgcaaaacacaggaatggtcgtttgattggagcgcaggaaaaacgcaggaatcggatgagagagatagactcaaaggaaattttccaagaggttggagctcttgctaaatttcctccaaaatccacatgcaatgtgccattctataggaatttcataggatttgaaaagcttcaatcctttgaatcaaagggccaaataggaaaatttcctataggatttgaatcctatgaaattcctacataaatcctttggttcaaatgggcccttaacctgaaaccatcactttgatctgaatcctaaactgcagttggtgaaacctaccatttctgacaaccttttctcacttcactagctgaaattaaattacacagacttatctgaacatacatgtggcaatgacttctcctaccattccttgatcaatatatatagtcttgtgtacaccaaaagaagaagaaaaatactgtcttgtgcagacacatctactttcatgtatgtacagtgtttgtttcaataactgaaagccctagatagccctgttgacattgcaatactaaatcaaagtagtcactgtgccagtatgcaaatgatgatgggtatgttctaacttgagattagacaagtagggaggaagcaggcaaccgcaatttgctggctctctctgcaggagttaatgtcgatcgattgcgtacgtcctgatctggctctaataccccggcccctgacattagcatcaagcaaacaacgtaattaagtgtggtcataatcccccttaacacgtaatctgcttctataatcagaagaggtacagtgcttgtgattaggtgccgtacgtgcagtagattggtcgcctttctgtaggctttaagcgtcagaattgtctggtagcctaacaaaaatggggctcctggctggcaactgttgttgttgataagcatccaaaaggaaaaatcctcgccatgacaagattgtggtttgcagagcagtttgttatcatgtatagtaattaacagcctgcaaaatttgcaagaaaccaagacattagatttaatttgttggtgaggcaccatccgtgtattaattctccactgatgatgttgttgttctagtatagatggattaaattgagttgtgtgtgatatacttttatttatttatttggtgtcgatctcatccattttgacgtgttcgatcagtcaggcaaaattaggatggtggcgtttctagtgatgtgcaatcaactgtgtgtcaagtgttgtgcttcattcagtgcatgacctactacatatggctaattggctatctacgtaaacttacatacttacattacctacaactgcattaagggccctcattaattatttttttcgattaagagccctgattgattaagttgcgcggcactatatagatggttatatatgcataatgatttctttttttaagaatacactataaacacaagcactcacaacacacgtgcactcaccctcttgtaaagttttctatgtgctatgtttgtgggcatcgtagaatcatagacatgacgtcgtatttcgtaacctagcgctaaccctgaacgatcttatgaggaaatgcattcaagaggttgtcttgtgaatagagcaatagttccaaattggaaaaatctgttttcttcccccctacaatttctaaatagtacaatgtaatttctgttgtactacccgcttattttctaatgaatgaaatttagaaaaaaaagaacaattaactagctagctagctagtgtgacactgacattcgagttcagtacgagtcctaaagaaggaaaataaaattgagccaccgttccgaccattctgatctactggtcgggctcatcgacaagtgcgaataaaaaaatgtgtcattgtaaggattaaaaatattttttatatcaaatattcaaaatagttgatttttatactgctaggaactgccagtagtaatttaagtaaaaaataataattgaatttgtttgggcttaaagaaaaatcctagctcggtcacggggaatggcctggaaggaatagggtgcataggcagcctacacatagagtcgagtttgcaaggtcatattaatggtgttttcatatgacttaaaaaaacagcggaatttgcgggtaaatgatggacatggatggtcctttttgcatgcatgacaatatgatagcgtgttgacaacagcccatttgcctaattttgtggttaaggtgttgttcacatcgtcaccgaagaacacaactaaatgcttattatttcaaaggaccatgctccggaactcatgggttgtgattgacaatataatgcacccaaccatgcatctgaagttagctaaaccctactagattattgttttttgcagctacactgatatactccctcctattgtaaatatttaaaagttaagatatttaattggctaaacttttaaatctttgacaattgttatgtcaaattaagtttctaaaacctaacgagtttacgacattatggtagtattatggtaagtttataaacaccatttgttttgtattccaaatcaagtactcaagaaattaattgatggccaaagttttcaaagtaattagctagttttcaatctaggaagattactgtctcatgagaagtcacgatgcaagtttgacctcacgatcaacctgcgcaatatggtttatcgaaaaatgggatcgatcaggggatactatacaattagcgattaattatcgttagtcgtacttacggtgttaattagtccgtgacatgcatgtatggatatgacggtacgtgtaacgtacgtagctatatactatgtacgtattcatgtgagctggatggtgtaagatcgacggtgccgtatatacgtatgtttcttgcaacagcaaaagtacgtagcgtacgtggcctgttccaaccatcgatcgagcagaagctgctcccatctagttgcaagctcggttaattttggccctgtttagatgctcacaaaaaatttaatccctttcatagagacttatatttatgtgagtccctcccatccaaacaaccccttattattacgatcaattatgataatctcaaatgtttaaactttcactatttgataaatgaaaatttcctttgggcattttcaaaatatgtataattatccgaaggacaccacaaaatcgtgtcattaaagaggaaaaaaaatctgtaattggttgcccacatttaacaactgaatttagttctacatcgctgacatgaacaactgactcttaaccctcctcatcgtcaacagctgaggagccattgccttcatcagatctagttgcgtgagatgtgcctggcaaccaagggcaatcttgttatttttaatttatctctccaagcttttacttggaaatgataaaataatatctccagtttagtgtagccagttacacaagtctctcaacagtgacacgatcttaccgcatccccaagccaattacacaaaatttaaatgtcatatagtaaaatcaagacaattacaagtgtcacatacaacacgacaagaaatcaaaaaacaaaacaacaaggcaacataggaccaaccatttcgcttataactaattatacttggtaacgcttattagcaacaaaaataatttatgggtataattttatatatgcgttctttcttacttaaaagtaaaaaaatatataaaaaagtagtcttctagtagtacttagccgaaaccctttttctcgtacaagtttggttgttttggatggaatccaaaaatataccctaccaatattttgttagcggtttttgtttaaagccaaattattggcattgcaatgtctaacttggcacattctagattataaatcagggttttggtttcttattgatatcaaatcaaacaccattttatcctatcaaataattagtagtgctaaaacttagctaggataatgaaccaaacaagtccgttaagtagggtaatgaaccttactacatgggccgcggctttgggacatccacagggctgacaggcatgcagatgctgataaggaatggaatggaataagtccattttgcctccctcatctcttgcgcttgcgtgaataacatccctcaactggaaaaccgggtataacgcctccttcttctctgaaaaccagagcaaatcacctccctcagtggtttggctggcggtttcgtccgacgtggcgtcgttgacctgttgacgagctgactctgtgtggtgggacccacatgtcagtgcaaactctcctttccttcttcctcctccctctctctctcccttctctctctcccgtggcctctctctccaccttggccagagcaatggcggcagcggtggcagacgacgtcggagcatcggtcgccgtcgtaccaaagtagcgagagcacgcaggacgtggagaaggggagagagagattgagagagtcgtcctcgtcaccgccggtgccacgcgcgaagaagaaaaggaaaccgaggataaggggagagagagagtcgtcccgtcactgccggtgccgccgtcctagagatccctcgcgagctgtgtcccgccaccaccgccgtccaccaccggtcgccgtcccgtgctccttcgctgtccccgggcggagaagaaaggaagaccggggagagagggggcagagagagccatccgtcacggcgagctgcgccgccctggagcgttgcgatgctacttctggcttcttcctgcgatgctactgaggatgaagaaagcctctgtctaggtaattctttttcttcttttctctcactcactccatcagctgctagctttgctagctaggagtagctagctgcttgtgctcttgctgtcgagaggaggaagaaagactcgaggtggttggctgtcgtgttgtgcatggctgcattcagagccccgacggtgatgtcatcgacagcgtgccgctgcacctgcaaccggcgttcgaccacccgaagctcattcatttttgtttcaatttgcagtgatcgtttctatctccagcgacgtttcttgatcgtgtttgtgattgtgtgcgcgtgcaggttgagccggagccagaggagaggcccaaggtcggtggcgcggcggcggcgcatggggaggcggcggaggaggaggtcgtgttcccgatggcgtggacggacgacgacgagttgtgcccggaggggacggtgcccgtgcggcagacgacgaagcgcgacgtgctgaggtccagctcctctccctgtttggggatgaagcagcctcgtgccggcgtgccgctggtgtcgtccgcgtgaggaagaagatgggatgggggggc

SEQ ID NO: 22772 - DNA, 2072 bp, Oryza sativa
attatacccggttttccggttgagggatgttattcatccaagtacatgagatgagggaggtaaaatggacttattccgaatggaatagctaaaaggaaaaagtacaccgaaggtccctcaacttgtcatcgagttacaaaatcatccccaaacgcaaaaccgggtataacgcatcccaaacttacaaaaccattacaaattaggtcccttagtggttttgatccggttttgtcctatgtggcagctgagccagcgtgggacttatgtggaccctacctgtcagtatgccacgtcagcaggtacctgtttcccctcctctcccttgctcctctctctcacacacactcttctctctgggaaggccggccggcggtggggaggaggtcgccgggcgaggaggtccgacggccggccggcgatgcggcggcggcggcaggcgtgcgcgcctcctcctccccggttactcccacgacgccgactacctcaccgcccttcccaatccctatctcatcgccgatgccgtccgccgggccccgccaccttcctccgccctgcagcctcgccaccctcactctgcccgacgcggtggagctggtctgcgtgctgaagcaggtggaggagaggcggctgcccgacacggtggagctggtctccctgagctcccatctgaacctgacaccgaaatggcatcaaagctgttggaattgtgaaggtgatcgacaggccgtcaggcccacgcatgtttcttctcgctgtaaacctcatcccaggaggtttgtttgtcaccaatctatcctgtaaaagagatcaccacaaaaacagaggaaagtcagatcctacatccattgttcagttccataatctcacccttatcaagcaaaaatgaaacaatatgattcaggttcagcaagagaaattctgatcccaaacagttcagcacaaaaaattcttatctcaaacaaaaaatatcacacagcaacacaaaaaaattgatacagtacgattcaagttcagcaagagaaattctgatctcgaacagttcagcatggcaattgctgatctaaaaaaaaacatgatacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaagctctcaacaacccggagcaggtgctgcgcaggatggagcaggagaggcggctcgtgcggatgggcaccgccgggagcgtgtccatccgcgtcctcaccagcggcggtggcggcgaggccgtctccttcctcttcaacggtgcctcgatggcctcctcgggagccgccgtcgccggccgcaccaccctccgggcgtgcgcgccgccgtgggggaagccgacgaatgcggcggcggaaggaggatgaggacgggagctattgtcactccttgctacgatgaggacggcctcgagtccgccgagagcggcggcaaggctcgagagtccacctctgcgcccggcccgccgccgcctcgtcgccataccaccctgccgctcgtcgccggctgcccagctcctctcccgcctcccgcgcgctgctcctcccctgtcgcccgccgccgcattcccaccttccgtcgtcatcttcaccaccggcggtgaagcaccatcagacgccgccacatctccggcgcccgtcgcctcctccatccctcccaactcgcttgagcggacacgagcagccgcaggagctcctccagctccggccaccggcgtggtgctcgtgctccgccgcggcactctcgccggaaaaagaacgaagagaagagagagagaggaggaaccgaggaagaggagagggaggggagagatgacatggcatatatgtgggggtcccacgctgactcaactgtcacataggacaaaaccaagatcaaaaccataaaggatctattgtgaacgggttttgattagttaagagaccccaaatattttttcagttgaggtacgattttgt

SEQ ID NO: 22773 - DNA, 3761 bp, Oryza sativa
  unsure (1)..(3761): unsure at all n locations
atttacagcccaaaaattacgaaaacctagctgcatcgcatcttcttctcctttccccaggcggagcaccgtccgatgagcatccaacggctacggtcagcaccctcggaaccttcgagaacaccctccccgctataaattcccgcctttccggtagcatctagtcttcctctcccactcttcctcctccccaaaccctagccgccgccgccggcgtactcgagagaaacatcagcatccatggcgggcaagggcgagggtccggccatcggcatcgaccttggcacgacctactcgtgcgtgggcgtttggcagcacgaccgcgtggagatcatcgccaacgaccagggcaaccgcaccaccccctcctacgtcggcttcaccgactccgagaggctcatcggagatgctgccaagaaccaggtcgccatgaaccccatcaacaccgtctttggtaactacttattccctgctcctcagtcctctctctttctctctctccccccttagatctcatctctaaggtcttcgtcgtcgtcgtatgctagatctactcttgcccagctcgttcagatctgttagatttgtgtgggatgctctaattaattactaccaacttagtagatctggaactcttttgacttgcagatcttgctccactcctgttgcattttgaatctgtgttgatgtgatttaagttgttggcagtgctttttgcatactatttgaatttgtggatggttagcagtcagtacactaggatttattactggatctggacagatatgctcgtttcaatcggctcgatttgctatgttgatagctaacatgttgtgcttgtcctactgccctggcgcaaatttgatccatgcattcttttcgttaaatgatttgtcaagtagtaatgcttgtttgaaaatgatattattattattattattattttaaataaatatagcctgaaacattcttagtttcgaggagaagtgatgatgtcttatccataccacatgtctgcatctcatatgatgattaatctacatcatgcactaccatctgatctcctctagctcatacagcttttaacaagttaggcgatagatgtttgctacaaacagtcaactggatttgctttcttgaaagaaaaaaaatgaaccgtgtagtttgcaacctgtgatgtaaattaacccatttactgaactacattgattatttcagtaaaatcaccatctttcggctgaggttgcatgcttagttattatatttttaccaatgatgattttgttatgtagccagatactgtactttcttatgccatttggtatctgactcattgtctacttttgtgactatgtgtctcgaaatatggcatataataagggggaacggatcttgcgacattgatggctcctgtatgagcctccaattactatatagccgtttacatgttcttatcatgttacttttccaaattagtgctgcacatcttgtctgtttgcaagtttgggttcattcatattgctgggggcattttaatacatcttaactataatgtaaatttcttgtacatcgctaaaattttctgccttgattgagtagactcttagatgacatctatcttaccttatgcacttgattcgtatttctgttacaacattttgattacttgatgtagttcacacaagcatgacacatctctttgaaaaaaagatttcattttttaaagcaagcctaatgctttaaggtgggagaagtgatgatacttaatccatacaacatttctgcatctcagatgatgatcaatctacatcatgcactaccatctgatctccccatcatacaattttttattttgttttggtggattatataactttaacatttgataaagtgccaacagatttttatacacaatttcttatagatattaccatgacagcttgcagcctgtgatgcaaaagtacccattaaactgaattacactgattattccaaacaaatcaccatctttcggctgaggttgcttgcttgtttaaaattatgaatgcttcttgcacaaccatttagcactttcggtagtttgtaatgccatttggtatctgacacatggtctgcgcttgtgactatttgtcttgaaatatggcataaaacaagggggaacggatcttgcgacattggtggttcctctatgatcctccaattactatatagctgtttacaatttgttaagttaggagcataccttttgctttgtcatcaaagtcttggttcctttgtatttctagttcagattcatttttcttcagcttttgaaacataaactcagtatatttttactgtaattgctgacattgagtcttctctgcagatgccaagcgtctcattggcaggaggtttagcgatgcttctgttcagagtgacattaagctctggcccttcaaggtgattgctggacctggtgacnagcctatgattgttgtccagtacaagggtgaggagaagcagtttgctgcagaagagatctcctccatggtcctcatcaagatgcgtgagattgctgaggcctaccttggcaccaccatcaagaatgccgttgtcactgttcctgcctacttcaatgactcccagaggcaggccaccaaggatgctggagtgattgctggtctcaatgtcatgcgtatcatcaacgagccgactgctgcagctattgcctatggtcttgataagaaggccaccagcgttggtgagaagaatgtcctcatctttgaccttggaggtggtacctttgatgtcttccctcctaccattgagaagggtttttttagggtcaagcccccagttgttgccacccattttgttgtgaaatttttgccattggtatggtcaacccctttgtgcaagaattcaagaggaagaccaagaaggatatcnctggcaaccccaggctttcaggaagtttaggacagcttgtaaaaggcaaaaaggaccctgtcctccactgcccagccaccattgagatcgattccctgtatgagggcatcgacttctactcaaccatcacccgtgccaggtttgaggagctcaacatggatctcttcagaaagtgtatggagcctgtggagaagtgcctcagggatgctaagatggacaagagctctgttcatgatgttgtccttgttggtggctccactaggatcccgagggtgcagcagctcctgcaggatttcttcaacggcaaggagctttgcaagaacatcaacccagatgaggctgttgcttatggtgctgctgtccaggctgccatcttgagtggtgagggcaacgagaaggtccaggacctcctcctgttggatgttacccctctctctctcggtttggagactgctggtggtgtcatgaccgttttgatcccaaggaacaccaccattcccaccaagaaggagcaggtcttctccacctactccgacaaccagcctggtgtgctcatccaggtttatgagggtgagaggaccaggacacgtgacaacaacctgctggggaagtttgagctctctggaatccctcctgctcccaggggtgttccacagatcactgtttgcttcgacattgatgccaatggtatcctgaacgtgtctgctgaggacaagaccaccgggcagaagaacaagatcaccattaccaacgacaagggcaggcttagcaaggaggagattgagaagatggtccaggaggccgagaagtacaagtcagaggatgaggag

SEQ ID NO: 22774 - DNA, 5833 bp, Oryza sativa
  unsure (1)..(5833): unsure at all n locations
nnnnnnnnnnnnnnnnnnnnnnnnnnnnnnnnnnnnnnnnnnnnnnnnncctcaggcgaatccgagccgttggctcgtctcccctcgtctcgtgcaaccacccggtgtgctcgctttcgcctgtatcgccgtggttcgctccgccgctcgccgctgttgtccgcccgtccgttccggccggcgtcgtcgtctacctcccgccggcccacgtggcagccacgtaggcgccacgtcggcgccagctcagccgaggtcgggacgggccgaccccggtcagcccctcccgtgcgcgcgttccaccgcgagccgtgaggctgcgcgtgggcccgccgcatccgttcctccgcagaccgcgcgcgtgcaccgcgtccctcccccgcccgcgcgcgtgcgccacgtgctccctccgcacggtgagccgagccgctgacaagcgggtcccacccgggaccgcgcacggtgagcccggtccaccggccctctttctcctcccccctgcgcgcgcgcacttgggccgccttgggccggccggcccatttagctcggccggtccgctccttttcccttgggccacgccctagccgcccgaggaaaagtctataatccctccctcttttcttttcttttctttttcttttccaaaaaggatttaattaaatccttttcctttagaccaaaaatccaataatcttagaaattcaatatcttcccaaccgtaagtccgtttgactacgttcaacttccaaaattcctcaaatctcgagatctatctaatggcacgcttagaggtcattaatagagctttattttcgccgtttgttgagttgtcccatttcgcgtgtagtttcggagcccgaagacccgtagtgcgaggatttcgaggatcaagctccagatctcgaggaaggcaagccacctctgaacatctcgagcctatatttgaaatttaattatgttgcttgaaaaatattatgcattgataggatcgcacttaatctgtcgtcccgtctgctaggcagatcagcggacctacctaatttgttgcattgatcctccctttgttaattgttatatcatgtccccttgtaaccatctagttgcgtctcgatattcgtgcaccctgtgcgagtatcgacggacgccttcaaacttaaaatctgaaaaacaacttgggtaaaacttgggtttacaaaaggcttggaaaacccgacacctgggtcggtgcttgcgaactaaatgaatttccaaaaccgcggaccggggaacgtaccgggagtacggtttcccgctctcgcacttaaggaccgattccttggaatttcatccaaacataagtcaagtacgaccacatgggtggaatgggacacccctggcggagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggttgatccccacgggctgggtgacccgggtttgtaatgtcgtgtgggtaaagtgtaccccctctgcagaggttaacaaactgttcgaacagtcgtgcccacggtcatgggcagatgtgaggtgattcctagcgtagttttgtttgactactgcttgtgaaattgctgttgtggaaaggggatcgatgtttggaaaatttgcagctgatgggatcagctaggcccgggtggccgtttgaaagttgttggcccgggtggctgtttgaaaagctattggccgggtgccgatcttatgtcatttctaaagactgatacattgcacatactccgactggacgagacgcactgtctcatccgtgtcgtttgagaagcactcacttagttgtttacaaaaaggagttcaaataaaaacaattgcaaaaacaacagcctttccttgaagcctgcattaaacacttatttctcatggcttgctgagtattcccgtactcacccttgctctatataaatatccccccccctcagttgctgaagaagatgaagcggatcctgctgatgaggagttcttccaggagcaagccggctacgatgagttttagggtttcggcctagttcccaagtcgcgcctgtgttggttggtccaagtcctggcttccgtttcccttatgtaatgcagttgtgagctcgggatctgtccacagcccaacatgactatacctctactctataataaagagacctctgttgctgtgatattctgtctccctgtgataccagcactgtttcctgggactggtatcgattaacaggttaatttggagcgtcacgggctagttccggtcgggactggttcggggcatgacacgtactcatggagttgagtaccgggactcatatggtaccctggttggaaatctaaaggttatatgttttataaattctgcttttccagattgtccaatactgctttttgcaaagaaccctattatatgtcaatgcataacatatttccgtgataacttgctgagtattgtgaatactcatccttgctcttataacctcctttttcatatctgggtcaagaggaggacccttatgactattactacaaagaccctgataacttagaaaatccctaaaggttatacctcactagtcagaatgtatagaaacttccgctgtgtactaattagatgggtgaatacctattattgtaaaacccttagtattgtaagactttaacgtatgcaatgaagaaccagttatattgtatgtatcgatttttactgatccagggattgatacattaatctcagtcggatccaagttgttagttttgggacccgacaggatagctagctggctatatggatgttcggagagtctattttagaaaggttgttggagattctctaactgctatcttgttactgaattactcctacctaacatgtcagaaagatgaatgaaatgcacatccctttttacagaatatagggggggtgtttagatccagggtgtaaagttttggcgtgtcacatcggatattatataggatgtcgcatggggtgtttgggcactaataaaaaaactaattacagaatccgtcagtaaactgcgagacgaatttattaagcccaattaatccgtcattagcaaatatttactgtagcacaacattgtcaaatcatggagtaattaggcttaaaagattcgtctcgcaaattagtcgcaatctgtgcaattagttatttttttagcctatatatatttaatacttcatgcaggtgttcaaacattcgatgtgacagggtgtaaaatttttgggtgggatctaaacaccccctaactctactagcttaaaattgatattgtacctaacttctccaacaaattgctaatcttttcacaaacttctatctgaaacacagctatacaagcttgtttagtgttgcagcgtgaaattactagaccaaatacctgtttagtaaaattagccccagtatatataagaaaaaaaacagttctatgcttctgaaatgcaaaagacagataaaactgcacctactacatcagtctgtaattatcaaactatctcagcacatggaatgcatgataaaccaaactagcagtatttcaaacctgccagtaatcaaagaaaacacaacccaggaatatgtaaagtactagaatttgtaaggaaacacgtatagaaatttgcagggaacctttggcccaatgttcctcaaaggttatgttaaaatacttaattaaccgtgcccaaggaacgaacgcagcctaacagatgaagctattgaccaacaattgactatcatacaacaaatttgaatatttgtaactagtttagtggactttttctcaggtaccatcaagatttaatatgctctcctagttcaaaaaaaaaaaaccatcaagatttaataacatcctgtcaaaagaaaagatctatctattatattgcaaactaagcagccatttttattttggaatcatcaatgtcaatttcacataaataggagtatatcacagagcaggtcccagtgatcaactctcaacaatatttacagaaaattaacatgtcttcaatctggtaacctctttttgatgtacttgtctgactcaaatacaaggatatccagcaagaactgcctgtcaaaatgaaactgtgggaaacatcgggaaatgtatgacatcttttattttgcggacagcatgcagatatatacattgaataccccaccgcccaccctttttttgttaatcagtatcgctgtttaactgttgtcagatttgaaactgatttttttggaacatatatcacaactttatgagtgaatccatacaaacacaagagttgtactggcccacaaaccattaatattagaaagtaagacagcgatacacacctcaaacactttgaataattggtgaacaaactgcactgctcaatcatgcaactgttatacttttgccagggaaatggaagtatcaagattttttttgaaagaagggaagtatcaagaatttgcgtacacaaaaggaagtgaattaaacatgacaaagagaacatatcatcaaacacgacaatagtgaaaacactatagtagattgtcagcaaacagaagagcacacaggcctaaactatagtagcaaaaaaaaaaatgaagttctcaatttatttatgctggaaatatatatatatatatatatatatatatatatatatatatatatatatatcaaaatcttatgtagctagctctacattgcaaatgaagatattatatcatgtaggagtatatatctagttctcaatttgtaagtaattgaagcagataattaaatcttgaactaaaagagggatttgtgatcacgatcagctacccatgtggacatggcgtacagtatccgccccttccatccctgcagcagccaattgtgatcgacgtcgatgacgaagtctttgtgatagagttttttgaccttgtctctcacaagctcaaccacctgaggctgcaatggcagctgcgtgaggccggcccggtggttgcgcaccagccactgcttgtacgtctccgggcgatccaccctgtctgcgccctcgcaggcgatgacgttgagggcccagcgccccaatatgtcccgctcgatgagcagccgctcgtcgttgtcgcgcgggatggtggcgtccagcatgtcgaactgcgacgagtagaagaagagcgtctccctgaagcgcgtcaggaagaagggcgcgccgtacgcgccattgacgacgcactggacgaacacgtgaggcctcatgtcgcggatgttgttgagcaccatgtctctggggctcgggctgtccacaaccacgctctcgtcctgcagggcgttcaagaagtggaggcagttcaccacgagcacctcttcttcttcttcttcttcttcttctcggtcgaggtggaggtcctcgcggcggaccgtctcccactttgcagcaatggcttggaacctgaatggcacgccgaattggcgcgcgcagttgctcagccgccggcctgtctcctcgatctggtcggctggccggaaccccggctgcgggaagtcgatgcccgtaatcctcacctccggcggcccgccttccctctccgacagacacttgaacagacctggccactggaatccgtagctgaggccgtagtccacgatgtgcagcttgcgcttccccgccacggcgtccaggatg

SEQ ID NO: 22775 - DNA, 8856 bp, Oryza sativa
cctcctccctgcccttgaggaacgccatgttgagcatctccatgttgtcggcggcggagaacagaagtttcaggtctttgtcgtcttccggcgcgctcctggtgtcgccgacgtcggcgtcgtggttgtcggagacggggtggggcggggattggagcagctgagagagctcgatggggtcgtagggccaggaggcgttggcggcggcggcggagttggttgtgttgttggtggtggcggaggcggagtcgtcggaggagttggtggtggtgtcgtcggatggggcgtcgaggatttgggcgtagggctgctgggcgtggaggagagcagggtggtcgggaaactggtagaagaacttgtcgtcgatgtcgtcctccatgagcatgcgagagatgaaggggaggatgagatcgtcatcgttggggtcgtcgctgtgcggcgtcgggggcaggtcgaggaagagcgacggagagaagggctcgaggtcgacgagttcctccagctgcggcgcggcggcggccatggccgggctgtggattcttgcgatccgataatagtggatgttagtgtggagggagacaatggagacatggaggagttaatggagacaggttcaaggaaggcggcggcggggaggaagacgcgacgcaactcaactcgacctcgtcttgtttattggtcgtcgcccccacccaaagtcgtttgcgcgccaatgcctttgattacgatggaatatacaaataaataaatatatactgattatttcccaaacaaagtgattttttaatttaaaaatacagagtgatcgattatatattaaatgaagaataactagctgggtggcccgcgcaattgcgcggctaacacccatataaaatatctatgttttacatatgattttacttaaaatttgttaaataactatctcgttatgttagaacattgaaaaaccgactttatcaccccggtgcttttaatagtcatgctaatcactacgccttatttctttgtcatcgctttatttacttgctcgatctaccaatgctttcattcatcctccctgaaacctctacaaatttgaccttgtggttttagagttcattgtattgttgggtttcatttttataatttttagaagtctcaccaaacgccgctactatacttctctatggcccgcctgctgcctcccatttttattatcgttgagatttgaaaatcgaacatgataataattgaggggttttttttactttctagaaatccctccaatcgtcgagatcatgctgcttaacgacctgctcgtcgtccctcctcttaattatcattcagattctatttaaggttttatttatagtttttacatgtcccatctacctacaccactctaattttttatgggtctattgtttctctcatctttattataatttgttattgttgtgttctgtatggactatttttttcaaaaataaatatttctcattgtgatatttctttcatttataaattgtaatcctacttgaactcttataattattttttatttactttaccacccttggcatgtcctcctgtggcaactgcctcctatctcatttgtttgcacacactcacttgcccattgcttctcttctttgtcatctcactacaccggtaatatccatatcattgataggatttttttataatttttttaaaattcctgcaagccgtcgttgaatgccgccttatttgccgtcccttggtaatatgtttgttttcttttgattaaatgtggtatttttttagccctgcaaatgtgaattaattcttagatagaatatggtcgagaattgatgatcgaacattacaggctgccaaatactgaccttgatcttgatgtcttgataatttctatacctcatatgtaatatttgatatttatagtattatttaaccataaaattatctccaaatgcaagaaaaattaggaatatatttttatctttcaatctacaaccaacaaaacaatttaacttcttacttaacaaaattttgatcatattaaacttgcctttcaatgacatcgtgtgggcgcgtggctgattaaatcacgcgctgctgtgcaaggaaaggaggcattggttggctgagtgagtttgattgttagctgacaggtctcttttttggttgtatgcggtaagtgccatggaaacagattgattttccttttttttttttggtaagtttctccatggacaaaagaaacgttgtcaaccctctgtccggttgggccatcacagtccgaacaaaatttttattttgctgtatagtttttttttttacatagtttgagtaggatttgtcatgtactctttcttacttatactattccgatcaatctcaacggttaaactataagtctgtcatgatctagcggtgtagattttttttctttttcttcgattaatgtgggaatttttagcctctacagcgaacgtggtgccttctttttgagctgtcttaataatataatagattttagaaatattttttatccgtcttcttatcagttactaatggcacaagagctagtatgcaataaaataatactgtgttgtaattataagatttgccaaaatctactataggtgctttgtagtattcttttttgataaaataaaataatgacttcaattggactcctcacaccatgttttgtatgatgacttatcactgacccacacccactctctttgttatttttttttttcattttggtctttttcctatatatcgtgagatttggaatcatatcgtttggacactggtcttgtttttttgagaagaatatcgccaggtgtacacgcatcgaattcaggttcattgaaatgagacacaaagtttattttcttttccttgaatcgcaagacagtcatatacagatgatgtgctaccagtagacttttgtatcggcaagcacacgcacgtgcgtttgactttgactttttagcatctcaaggctattatacccctactaagcttcacaatctatggcctgtttaatcctctgccaaaattttttaatcttggtatatcgaatgtttagacatatgtatgtagtattaaatatatgaaaaagaaaataattacatagattgcgtgtaaattgtgaaacgaatcttttaagcctaattgctccatgatctgacaatgtggtgctacagtaaacatttgttaataatggattaatcaggcttaataaattcgcctcgtagtttacaagtggaatctgtaatttgtttcgttgttagcctacgtttaatactttaaatgtgtgtccgtatattcgatgtgacacgctaaaacttttcacccctgaatctaaacacagcttataaagataatttgataatttagagagtactccttccgtcccataaaaaactaacctattactaaatgtgacatattttagatatatccgaatttgttgtactgtaatatcatatttattatgtcatatttatttagtattaggtttttttttaacggtgggagtagttgccttgctagatggtcttttactatgcaggtgacacccgtaaaattagtttcatccgtaaactgttgtcaccactttttaagtagctataagtggtggacggacatgcagtagtattattattcaagcattggaatgaattgattaattgatgaatacgtaagtaacactactggaaaaaaaacagttttataggcggctaaaacgtatttttcaggcgtccataacttctgtccgcaaccaaacgcctacgaaaatcaataatttttgcgggcggctgaatccacccacctgtgaaaatattttcagcgtaaaaaatatttggcccgcctccccttcggccaccgccaccacgagctatgccatcatgagggttttgggaggggagagggaggggaggggagttgcgccgccacgagctcaccgccccagcccgctcccgccgtggagggaagggcggcaggggggagcgtcgccgacgacctctgaccttggccactgcatgcagccgccgtcgccaccctcccccatgacgcttctggatccgggataggagggccgacagccggatctgggaggtaggagcgctgccgccgacctccctcctctgttttccgcctcgcgtcaccggccactggcctccccctcccccctttggctggatctgggagggagggaaggcgacccgcgccgagggtgcgctgcccccgagcgtcgcctcgccgttgctgccaccgaccccgcgcctcgccgtcgcggatcctactggccccgccgccgaacgcccgtcactgagtgagaggagaggtgagggctggttgatggagagaggtgagggagaagagaggccggttgagggagaggataggtgaggacttagaaaaaatctaagtgatgagtggtccatttatattccacgcctattttcgtaggcggacgtaagaggtccgccttcaaaaataaatggtatttttacaggcggaccgcttaagtggtcggacagcgagtttcacctcagtttacatttttgtagacggtcatttgggtccgagagccatatccacctacgaaaataaaaaccctcacgtctgaaaaatgctttttctaagtagagtaagctacctaggcagcttgtccgttatgttaacgatgactaattaagttactacgctaaaccttcgtattcgatcatgcagtaactaactttggctgtgtttagttggatcaaagtttgaattttggttaaaattggagatgatgtaactgaaaagttatgtgtgtacgataggttgatgtgatagaaaagaactgaagtttagatctaatcacagcctttatggcaaaatattaaaatgcagtcactagctacggtccaccagtacgtccgggcggtcagtgcttagaaggctgccttttctttctttactactttctttgccaccatgttgggattgagttgggccgggtctccaaactgcatgtgatatggtatggcgttattgggccttcatgaactttcttaatagaccagaacttccgggaatcctagaggaataagttcacttggtgaccctcaaaagtgatcgaaatctaatccgtgactctaaaccacgaaaccgatatcttaaccctcaaacttttaaaaccggtgcaatttgacttccttgacggttttggagagcggttttactgacgtggcgcctacgtggcggtattgaccaggactcttttaaacatggcatgtaggtggcatttagaattaaaaaatatgtgtgagacccatttgtcattgacacgtgaaagaaattgtaggacccacgtgtcccttctctctctccccctccagttccttctccctcctcgccgctcccccctctctctctcccgcggcgggcggcgagggccggagtggcggcggcggcccgcccgtccatcggctccaccttcaccgccgccgtgtggtcattgtcaccgtcgccgccgtcgtgccgcattcgcttccggccgacggagacgccgaagagcttcgtgccggggcaggaaggcatgaggttgaggatggcgcggaggaggcgttggcggtgtcgagctgctgcgtggagccgtacttgcactgttgggcatgaggaggagtatgttgttgcagagcttcctcatctggctgagctcccgtgcgagctgcgcgttctcccgcatgccaccggacgcgacgccgccggagccggagccggatggcgcctgcggcagcatgagcgggggctcaggggacgagctggaggatatgacctgctcctcgccggacagcaccggggagccatcccgcgtcatcatcggcagcgccatcgggatcgcggccgcgaccgtgaccgcccccgtcgtcgtcgtcgctggcaccggcggcgtgcctcttcaccttccatccgacaacgtcggcctcggccccatcacactccgccgccgccgccgccgcctcctgctcgatccgctcatccgggtaaccggccttgtcgcccctggatctgttccgcggtggattgggtgccagctagcttgcccgagctctagatgcgtcgccgcgctgggaacataatcgtagtcaccgccgcctggagcacatcgttcgctagcgcaacctccttgtcctccagctgctgcgctgccgtcgagtgtcgcgagcggttgcgtggaagcagggattttgggcttccatggcagatttgggtctgtgaaagcacatcctgccgctgccgccgccaccggcccccgtccccatgctcgcggctcgccgaagggaagaggaagagagagaggggaggatgatttatgtgggccccacatgtcagcgggtcccacccatacttttggtgaatgacaaatgggttctacacatattttttatttctaatggcacctaagcgccacgtcaacgccacgtggaaagaagaccgagtcaatactgctacgtaggcaccacgtcagcgaaaccgctctccaaaatcaccgagggagttaaattgcactggttttaagagttggagggtcaagatatctgatttcgtggtttagggtcacggattagatttcgatcacttttgagggtcaccaagtgaacttattccaatcctagatggggtggagaggcccggatatgaagcccgcctttgtttggagtaagtctattttacttcctttatctcttgctcatgattacattgtctctcttggctgcaaaactctccctggtcttcaaaagccggtgttaaccgactccttccatgatttgggaagcggtttctattaacgtagcaggttaagcacgcttgactcgctaagttagtaggtgggacacacatgcccaaccccctctctcctctcttccccttctctctcttcctctctcctctcttttccatctctctctagtagcttgactatcagtctttcacctctgaggacctctgcatgaaggtgtcaaggactcggggttggccgtgtagtaggcgatgtaccctgaaatggtagcatgcgtggcggcctcctggtcgacctccgagtaaaaacaatgtttcattacatactaaaacgtttcatttcattttataaaatgttgtagagaaatacaacattcagaaaatactaactgcagtaccaacaaccactgtatagaacattaagtcccaatgagtgaaacatcacaaagaaatcatacaaggcacacaatattttccataaaaatcaatatataagttttttaaaataaataaaataaataatttttatgtatgtaataattaatactcaattaatcatgtataaatagtttgttagtttcgcatggcacttaaaaatcatagcccaacaaccctcccggactaggggtgtgttcgattcagcaattgagtgtggattttggaggcacgtgacacgagaccaacaattagtatataataagtggagcattaattattacaagcttaaaaaaattattaatttttaaagaatatgtaaaatttgtatatagaaatacatcgtttagcagttcgaaaaatatgctaatgaaaagcgtgaaattatcgttcatagaactcaccatacggtaaaatcggtttgggtataactcaaccttatagtatatcgcaagtagagtagtagtacatgtcaacacatacacccgcaatcatggaatcatggaagaaactagactacaaatatgttttgggaaacaattttaatcactttgatgtacaccaaaccatttatttcatatcaactgaatggttataaaaagtttttttaaaaagcaacaagatagattcatgtgtaatatgtaactcaacaaacatgtatcttcaaattcgagttctacaagttataacaaaaaaaatcaaactttaattggtatacgtatatttacagataaatttattatatttttacaacttataattattaagtattaaccaatataaattttaaaaatggaattatttgatttttttgaagaaatatttatatataaagtttttatacgaaacatatttaggctgtgttcttttgttttggagggattgggaacccctcccctccacatggaaaacggagcgatagattaacacgtgattaattaagtattagctataaaaaacttaaaaaatagattaatatgattttttaaagcaactctcctattataaacttttttgtaaaatgtgtactgttttaacagtttaaaaagcgtgcacgcagaaaacaaaggagatgggttgggaacccatgggaaagaacacaaccttagttgtttgagaaatatgataatgaaaaacgaggaaattaaaatgcttggagttgttaaaaaatggaactagctagtaatctgtcgatagtttttgaggctcaaaactttcaaatttttaaccatatgatttgtcatcaacagttttgaaatgggtacacacaagtacaaaccactaatcttagcatccaagttgattgaacggtcagaaattggtcaacatgtataatggaaaaataattcaaaagtaaaacacatgctcttgaaaaaaattacaaatactaattttatacaaatgtaactaccctttaactatcatgtaactactatataactagggtataagtactatataactaatatataacaagcgtgtaactactatgtgtagcgcccgttctgtcgtggcgcctagcgggaaaattatctcttaaaaaccctaattgcgaaatttgtttctttgcttggtgtctagtgacagtgccatttcagatctcaaatccccgatctatcgccgagt

SEQ ID NO: 22776 - DNA, 12151 bp, Oryza sativa
  unsure (1)..(12151): unsure at all n locations
ccctataaacccaagctcctccctcctccaatctccctcgttttcgtctctcgcctccactccattgccaccgcctcccgtgctctgtttgccgtcgccgttcatcgttgcgcgtgtcagaggagccggcacgagcaaggacgcggaaggggactctgggcgtgccctcttcttcctcttccccggcccgaggccgaagagatcactcccgtgccgtcggcccatcgtcactgccccccgtcccgcacggtagcgcatctccccgttctccctcctcgttccatctcctccccttagactcgggtagtagcacgagtagcctccccgtagctagccggcgccgccccgactgctgccgtcgctcgccgtgtgctcgccgccgtcgccgcccgagctcggaagcgcctctcgtcgccggcctccctcgatgcgtttcctcctaatccggcacaagggacggattcccgtagccgcgtagatgctctcgccgccaggaatcggcccctcgtgacctcgtcgccgtttccctcttccctccccgccggttgccgccgccgcaatccgccgccgacgcactccctccggcgaatccgagccgttggctcatctcccctcgtctcgtgcaaccacccggtgtgctcgctttcgcctgtatcgccgtggttcgctccgccgctcgctgctgtcgtccgccgtccgttccggccggcgtcgtcgtctacctcccgccggcccgcgtggctgccacgtaggcgccacgtcagcgccacctcggccgcgaccggatcggctgacccggccagccgctccctcccttttcccccccgtgcgcatggtccgcggtgagccgtgaggctgcgcgtgggcccgccgcaccgcatcctccgcgaaccgcgcgcgtgcaccgcgtctccctccccgaaccctagcgcgcgccgcgtgttcgctccgcacggtgagccgagtcgccgacaagcgggtcccacccgggaccacgcaggatggacccggcccaccggctctctctcccctccccgccagcgcgcgcgctttgggccgccttttgggccggccggcccatttagctcggccgagccgcctcttttctctcgggccgcgccctcgccgcccgagggaagtctaattttccctctccttcttttcttttcttttctttttcaaaaaggatttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggccttattttcgccgtttgttgagttgtcccgttttgcgcgtagtttcggagcccgaagacccgcagtgcgaggatttcgaggatcaagctccaaatctcgagcaaggcaagccacctttaaacatcttgagcctatatttgaatttaattatgttgcttgaaaaatattatgcattgataggatcgcacttaatctgtttgtcccgtctgcaaggcagattggcggacctacctagcttgttgcatttgatccttcctctgttaattgttataccatgtttccttgtaaccacccagttgcgcctcggaaatcgtgcactctacacgagtatcgacggtcgccttcaaacttaaaatctaaaaaacatcttgggtaaaacttgggttttacaaaagacttggaaaacccgacacctgggtcggtgcttacgaactaaatgaattttccaaaaccgcggaccgaggaacgtaccgggtgtacggtttcccgctcttgcacttaaggaccgtttccttggaatttcatccgaatataagacaagtatgaccacatgggtggaatgggacacccctggctgagtaactagcttatcaggggagccttgatgccgagagacatgtggattcgccggggtggtgtcggggaggacccttgggcttcctggcacagtatagtctgggacctaacctgttgttggtctgggacccctctcgtcggcatatggtaaacctgtgtcggctttcgaaatgccttgacatgaaagcttggaggtctcccgacgtggctgatccccacgggctgggtgatccgggttagtaatgtcgtgtaggtaaagtgtaccccctctgcagaggttaacaaactgttcgaacagccgtgcccacggtcatgggtggatgtgaggtgattcctagcgtagttttgtttgcctactgtttgtgaaattgctgttgtggaaaggggatcgatgtttggaaaatctgcagctgatgggatcagctaggcccaggtggccgtttgaaagttgttggcccgggtggccgtttgaaagttgttggcccgggtggccgtttgaaagctgttggccgggtgccaatcttgatcaattttaaagactgatacattgcacatactccgaccggacgagacgcactatctcaaccgtgtcgtttgaaaagcactcacttagttgttttcagaaaagagttcaaataaaatcaattgcaaaaacaacagcctttccttgaagcctgcattaaacacttatttcccatggcttgctgagtactcccgtactcacccttgctctatataaataatccccccccagttgctgaagaagatgaagcggatcctgctgatgaggagtttttccaggagcaagccggctacgatgagatttagggtttcggcctagttcccaagtcgcgcctgtgttgtttggcccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgatactggtatcgattaacaggttaatttggagcgtcacgggctagttccggtcggtactagttcggggcgtgacactatgtaactagagtgtaaatgctatataagtagattaagaaacatgaagttgtgctggcttagtggtttgaatgctgccatatgtatgagcaaggccaaggatcgattcctgtccacgacacattatatgctgttttttatcttgttgcacgcacgaatcttgaagcggatctaagggctgaaaatttgacagtagcaagttttctagcaattccgttaaaaaataaagtcgctctctcgttctcatcacggtaggtggcttcgaatttaattggcggtagtagaattatacaaggcgcgatggaggcgtatagaagagatcgaggttggccaacaacaccaacaagaaacgaaacgcgtttcttcatttggttaattttgcgcgttccttccttccttcctcaacacgtagtaggcggtaagcaagttgttgttggctgattctgattgggtgcaccgcacacaagtaaaaaggagtaatctgaaccctcgcgccggcctttccgtcagaggttttcttttcttcttctgcgaatttcctctgacatggagtaatacacctacttgtttcttctccttgcttaccaaaccaatactactacaatatactacaacttgtagtactggagtagtagaaattaaacgcggtggctgctgattctttcttcttctcctctctcgctggcaagcaaactccaattcattcatcaaccgccgtctcttccattctcaactccaatcctcattccatttccatattccgtctgtctgtctccaagtcccatgaagccgtctcccgccgccaacctggacgtccgcgtggagaggcctaggccaccgccggtgcaccctcaccggccgggaagtctcagggcgcgcccctactaccgccgatggacgccctggatcgtcgccgccatcgccctctcctgcgtcgtcgtcttcctcgtctccatgtatgtcaacgattgcccccgccgcaactccggggactgcgccgccggcttcctcggccgcttcgccttccagccgctcaaggagaatcccctcctcggcccttcctccgccacgtacgtcgatcgccttcaatccctccgcccccctttctttctttcttgcttaatttttagataatgatctttcttgttcaataaacgacgtatagctgcttaatgttaatgtacctagctacgtacaccatccattctttactttctagagtagatacaatcaccaattacagatgcagagcaaactcttatctactccaaccaagattttatttttcttctgcttttcatatctgcctgctaatttcaatacatccacttcatttggttggttggctggttgcaattaggaacctgactccaaacatggtagtagtattctgttatgcatctcattatctaaataatttgtttgtaagggtcaaccaatgcttcaattggctatagacaacgaacaatggataaaaaatgagccatttctcaactctgctcatccattctctcgtcagttaccaatgcaatgcattgcatttaagaaagccttctgtttatgtactccacttcaatagggttggtctcaacgtacttcgtgtctactgtgcaatgcaatgaagagtctgcaactgttctttcaattcctttttttatttgcaccatgaacaacctactgtcttttgtttacaaaacattcattacatttctgtaattacttcatccataaaggttagcaactactctaggtgagatttgtaacatacgtttttatttctttaactagagagttaagctccttgcaacttgactttgggtgatatcacaatatgaaactgacagctcaaaaataaaaatttgctttattaaaagaacataaaaaatatgcaagctgccaactggtttcccaattcaaatgtaggattgtctaaacgaaaccattaattagacttggtttggtttttctttgattactactgtattgattcagtctattctttgtactcatggtggcagttggagagttgttgaaccccgaagaaagattgaaaacttcttcttttcaaatctctgattgctcatcttactgcacggtggatattttacgataatattttggatttgcaaagtcaactattggaattggaagtaccttgttcggtgaacatgatccgtggctccatttttattattattaagctggaaagggttaccacttcaaacttagagttttgtcttgtttagattaaggattgtagtccccgcaaaaaaaaagattaaggattgtaggacgagccggtacttttatttttgttggtaagaagcagatgtttgcttagaggtacaatgaactgagtcagtgttatttttccaacacaaaacttgagggaaaaaaagggagatgggggcaaaaggagctaagacaatagtactattttactatgcatattgaattcaagatgataaaaatgctttcatcttactaccaggttactgaagatgggagctctagatgtaactaaggttgtccatggtcaccaaggatggcgtctaattacatgcatctggcttcatgctggagttgttcatttgctcatcaatatgctatgccttctatttatcggcattcgacttgaacaagagtttgggtttggtaagttaactttgcatatttcatctgaactttacgtcccagacaagccaactattcagccatgaccttgcttggataatggctaattagcttcttttgtacaatttgttataaatgtaattctatttgatggatgcacactaatacattgtatataaatcctcagacatttaatgagtaagacgacttcctgttcaagtaaggattgggagtataatatcataccttttactgtcttgcttgcattggtagaatacaagaggagtcgatgccttgaactgtaataggaatgtaggtacaatacatgttaattatgtgcaataacttctgtgaatatgaatcaatgttcattgaagtaatggtgtagtggtaaaatgaatacggaatatgtagtttcacagcgtagacaactttctgaagtctgattttctctatgttatgcagtgaggattggtctggtttatctcatctctggtcttggtgggagcttgatgtctgccctcttcatccgatcaagtatctctgttggtgcctctggtgctttgtttggattgattgggtccatgctttctgaactcataacgaattggtcgctctatgcaaacaaggtctgttttttgattgtagaaacaactactgctacatcaccaattcattagcttttctttccattctaaattcctattgaattatattgtgtgatttttttctcatttgtcaggtggcagcactactaacactagtgtttgtaattgtggtgaatttggctcttgggatacttcccagggtagataactttgcgcacattgggggccttatatccgggttccttcttggatttgttatgtttattcgtccacagtttgcatggattaatcagagaagagtagcacctggacaacaacctgctcctgtgaaacgcaagcacaagacataccaatatatactgtggttagctgctgccattatgctaattgtcgggttagtccactgaccttcctctttgggctctaatgaatagtggcaatgtattttacccatgtttcctcccttgatgaaatctcccaattttgaacttgacagatttacagtggctatagtactgcttctccgaggatataatgcaaacgaccactgctcttggtgtcactatctcagctgtgttcctacgaaaagatggaaatgcaactcatcaccaacatattgcacggtaagacagttcaaatatcattatttgtttacctttttaagtgatagtgccatcagcaaagaatgaatagaaacaagctaaagaaatttgaagtataatgtagacaagaaatgtgttgttcttgctgagtaatagactattgctcctgcataatactacagtttttggtatctaatcgaagctcaactaaattgttggaatctgaattgttgaaatctgaagcatttaattgcatcgaaattgctttggctagattctgaaaatggctatgaaggacatatctcttgacagttcatggtatgaccaaattgttcccctttgcaggtaatgcaacaagcgaatacattaaacttgacatgtgaaggcacaaacgtacaccggagctaccttatagcggatgccacgcaagataagatcaaccaactctgcaaccaactttgcagttagcagaatcttggttccctccctgagttgatctgcttgtaaaaatactactactagtagtatatacatttttcattcttcgtgtacatgaatacatcatgtttgacagacagagaatagaaaagaatttgctgtacatatgaagaaaagaatactacaccgattgaatctatgcagagtgccatttatataatcttcttctttgtgggttctgaattgtcctggagtataagtgatgttccttctctgtagactgtaggagaagttgctttattcgccgggaagaccgaaggagaccatcaaatatattataagaaagagattttttttatataaaaaatatagaaactgtcgaggtaccaaactgcatatccaagaaccacacgctagcgacataaacacagagaggagtatagatgagaagtactcccttcgtcccaaattatagggcgctcctttttaagtaaaattaaactcggaagtttttaactaataattatattaactatatctatattaagtattatgcatgttatatcactagattcatattttgaagtactttcatgtgatgctaatttcatatttgttaggatcattgaatataataaaatactgatcaaagcatgctattaagggcgtgtaaaaaaatatatgccttataatttgggatagatgaagtagctttaataatttgctagtttgtgaagcaaagtccatttgtttcaagtaggcttggtgggcctcgattgataaggcccataacaggcaggccaccatctgtcgtctcctcctcttcccacgtcgcgtgtctcgcctgccctacctgtctccgctcctcctccggcaccgccggcggcggcggcggcggcggcgctgcctagcaagtagaataccaagatacggttcgtgtttcccctaaactccgagccctaatttctcattgcccagcgccgccaatcccttttcagttttcagtaaagaaatcttgcgctgattcatctgcgtatctcacaatctcaatctggacgaaagatttcgccatctgtgcctttgataaatgataatcgtggtcagtggctatgtactgtattgtgcaggcacagaagagcgatgaggagccgcagccccagcaagaggagaaggcatggcagcaggggaagaagccctccaagctcacgacatggctgtgccaaggataaggaaggtgctgctgtaagcctcttcgtcagcaaccttccgcgaagctgcaggtatacaatacaatacaataccaatttctgcatcatttcacttgctcctggttgttcacttgggttctcttccagacctgaggatgtccaagttccatttcaaaagtttggtcctgttcgggatgtttatctgccaaaagactacaacactgggtaagaaattggtttatccttctcatttgatactatggagtatatggttagatgttaacacatgttgagccagccacggctcaaagactctgagaagctttaaatcttctctcgctggtgtgcctttaatagcgaagaatctacaactgtaatcttcttttgagatgtctaacttctgtcatgtctggacaaacccccacaaagaccccactttcctttcactctactttttttgtaaaaaatatagcaccctgtagtctgtactactgtactctgtacagcatacattggtgttaatattgtacgtactagttatgtggcttcttctggcaaaattattgttctggcatgattacccgggttgtgttgtgttgaagtaactacaagcactagacttgttgaagatctctttcacagtcctaactgttcacttgtttggtgtcttggtgaggtagagtattgtgcaaataaagttgttctttggagaggaggtttggtttgttcacaaatttatttcccgaagaggattggattttactggtgtcttccatgagaagatttattgaagagaagttgatttcaagtactttcatgattttctgaaacatttgaggaatttcaagtgaccattttatgaagatgctactagaagaacttggtctcctagctgcttttttttgaagcatgctacatgttttgatgaaaatgttagttattggctatgcttcatgaggaatcatggaacgttcactgaatcatggaactttggggggaactagttgagcacataccatgaatatgcaccctcttctctgctgaacggaaatatatatagtattactctatccaacattttataacaccatatatgtagggagccaagaggatttgcatttgtggagtttgctcactcttctgatgcttctaaagcgcgatatcacatgaaccgtaagatgctttctggacgtgagatcagtgttgcttttgctgtgcagacacggaaaaggcccgaggaaatgcgaagaataattggagccaggtatactgtacccagtactgttttttttagaacacgcaggagatctgcgtatcatttcattaagatagagaagaaaaggtgtacggtattagaggaagactccgacacctgccctccaagggtacaacagaacaccacacccccaaaggttttgaaaatcctttcatttgagatgaccctcgtggctgctctacaggcataattccccacagagaaaggaagagtgccgaacaaactctccaggacagcctaaaggacatgatgagaagcggaagcgcagatcctatactcccaaatataaggatcggcagtatgctgacattggtcgtgatgagtaagttctgcttgtgcgctgcctgctacacgtcacatgcaatatttttatatatattgttttgtttgggttaaatacttattcatcactccataagtcacaaatcctattcaccagtccaccagtcagtcactcagtcacagctcaaaatcacaagacatcgagagtttgtacatcttagttactccttccgttccaaaatatagctacctttagcattcaattttgtcccaaaatatagctacctctcgacctattctctcatctcaaccaatcacagccatctctcatttaatttctccacctacttcctcatcccaaccaatcacaacaatcttcatttattttctccacctacttcctcatctcaaacaatcacaaccatcctttatttaaattttaccgcaaccttagtccctccaaaaaaagtccaaaggtagttctatattttgggacagagggagtactatataacatgtctataacataagtcttgtgtgcacagtagctgattcctcacacacaatggcagattgtttcagatggaaatccaggacatatgcgaacttaatatatttttaaccaatggtgtacttatgaattccaggaccctatcttaaactgtctgtgcattcatgcaacctaaatttagccctgttctattgcagtagcccattttatcatctgtcaaaatatatcaacatggtttgtacataaataattccttcactgccgataggactacatgtcatattaggtgcaggctcattccaagcgagaatgtactatactgtcagtgatatatcaatactgtagccttttgtacagtttattatctcttggaccagtgtaaaaatcactggtgttagtatattctttttttttggtgagaaaaaaatgtcttcaattgttgatctccccagagttgaggtaagtagttgcatatgattccttttttttcttgaaatagtgtgctgcgtgcatgctggttgttgacttgttacttgtaacagatggtagcatgtgcgcgtgtttagtttagaactactggcatgctggtcacgtttcgaatgttcacttgttgtacgtgcgtaaataataacaacaacatttcatgaatacaatccgtgattataacattgtatattgtgctgacaggacgccgcctgcacctgatagtgagcgaccctgggctctgtgcaggtcacccaggccatcccctccaggtgagcggccactaatccagtgtatgggtttcctcatctttgaatattgacaagttgctatgtttccttcagggcaatctcattctcgctcatactcacgttcccattctcttcatctccatgaccatgctagaacacggtatgccagtgtatcttcatgatattccgtgcagtacctttgtccttaacgatcttattcacactgtaggtcatgctctcctgccccaggaaggcaagatgaccagtatgcttccccgcagaggaaggagcaccaaacaaaatcatcaggacagacaaaaggacatgatgatatgcgcagatcctatactcctgaatataatgaatgccaggatgctgacaatggttttgatgagtaagttcttctccttcactgcttctacgtttgtctggtgtaatcttgttatataacttaagtactgttgtatttggatcccacaccgatttatctttttaggcccttctttttcatgttaactacccacagctcaaaataacgatacgtcgaggattcttactccatcttagttggtgtataccatgtggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22777 - DNA, 1470 bp, Oryza sativa
tgatgtctggtgtggcctcatctatttagtttcttgaatttttgatctccctaaagttaagtcgtaatatgttgtatatatagaattccttttccttttttgaacaatgtgataagttcttgctcgtttgtatgcctaaatgatattatgtttgaggttggtaagcttgttactggttacagattggtatcatgcatgcatatttagtatagaattattgatatgctggtcatgagtccgatgtcagtttgttgtacgtgtgtaatagactaatagtaacatttcacattgtgtgttgacaggacacctccggcacctgatggtgagcgatcctctgtgctgggcaggtcaccccggccatcccctccaggtgagctgtcaccagttaggactaacggatttcctatctttgaatattgataagttgctatgtttcctgcaggacggtctcattgtcattcacactcacgttcccgctctcctgaactccgtggccatgctagatcacggtatactagtggatcttcatgatgtgctgcagaatgaacatttttccttaacaatcttattcacattgtaggtcatgctctcctgccacaggaaggcaagataaccagtctacttccccacagagaagggagaagcaccaaacaaaatcatcaggacaggctaaagaacatgatgagaagcgcagatcctatactcctgaatataatgatcgccgggatgctgacaatggttatgatcagtaagttctgttcctgtactgctacatgtgtctggtgtaatatcgttacatataatttgaagttgagtcatagtatgttgcatatagagtcccttttattttccgaatgatgtgatgcgtccttgctcatttgtatgcctaaatgatattctgtttgaggttggttattaacttgttagttgttactggtaacagacggtgccatattcatctgtgtttgaattaagagcgattttacggtccttgaggaggtaccatgaagtaccattttttctattgtaaatttgatacctcatggtacctaggtactgtgaggtaccatgaggtaccaaaatttacactaaaattttggtatctcatggtacctcctcaagtactgtagaattgctcttgaattaatgatatgctggtcatgtctcagatgtccgtttgttgttgatgtgtaatagtaacattgcatgttgtgttgacaggacgccgccggcacctgatggtgagcgatcctgggcactgggcaggtcaccccagccatcccctccaggtgcgcagtcaggacctgtggatgggtttcctcatctttcaatattgacaagttgctatgtttcctgtaggacggtctcattttcattcacactcgcgttcccgctctcctgaactccgtggccgtgctagatctcggtatgccagtggatcttcatgatgtgctgcgtagtgcacatttt

SEQ ID NO: 22778 - DNA, 27134 bp, Oryza sativa
tgagggatggtcgacgatgaacgtttcttgtttgtttcatagtactccgtatgatattatggtgtagaatcatgaaagtggagtgctatgggctttggatagtcgttgtggggtgtacggtgactccatctgtccggagtaaactaacactgtagaggtgaggtggagtgaatactagtaagaagagtaacttttaattagttgttttgttttggatccctctttaagaaattaaattttattactactttgaatcgggtaaatttatctttattgattaacaagtgattcaatgtgaaacataaataataaaataatatggtttggtgaaattttctcaaaaagattaaatttaatggatggggtggttggttggaaggggtgttagactgtcacggtcacagacaaatctaggcggtgatttctttgcttgaggatatctatcactcgttcagctgcttggcaccacagcagcagagaaggcgtacgcgaatgcgacgcggtgaagagagagagatatggcgacgtgggaaacgtcactgcacgcaccggacgacgtcggcggtcaaaaagcagtcactcactcattcatctgggtcaacacgcctcatgctcacgggtcacggctctcatcactctggaaaaagctagtactccgttcctcctaatataaatttgttaatccttctctcttctaatatactacctccgacagagactttgacttttttctatactgtttgaccattcatttaattaaaaaagtttgaaattattatttattttatttgtgacttactttattatctaaagtactttaagcacaacttttcttttttatatttgcaaaaaaaaatttgaataagatgagtggtcaaacagtgtaagcaaaaagtcaaaattccttatattatgggacggagggagtaattgtaactagatagtataacttagtactacctccattccaaaataaacgtatccgtgaatatctgactccaatatttgatcatccgtcttatttaaaaaaatatattttttaaaaaaaatagtcccacataaagtacattcatgttttatcatctaataacaataaaaaatactaatcataaaaaatttaacgaataatcaaacgttagatatgaccaatacaaaactacatttgagacagagggagtattacacactggaacaactattgtcgcttcgccgtattatatgagaatcatatttcgtattaggtttattttttaaaggtgaaagttagtattcccttcatttcaaattgatctacatatatttttttttagctattcctaaatgatctacatatttgtgttcatttattaagtctattcgttatttgtgcattggagtaaatggatattgatgcatgcatccatgcacacaagtatttataacccgcatacaatattttgatttgctattggctaggaaatattggaggtggtgcatgcatcgagtttgttgctagagtaaatatagtatgagagagttattagcttttattggttttagtgtacctatgaaatatgtagatcaatttagaatggagggagtataacactagggtggtgttttgatgggagtgacttgttttagtccatttaaaaaaaattagcccctcccataggaacttttgctttttacttttgtgagagacatcccaaacaacccctagatagccacttgtagtacttctactaccgtactctcctcgttataatattgcaattagtagagtattaatcaaagtacagatacgtgtactgtaatactccctgcagtgcacgcacggcacaggttcctgtttctccgccctagctttccctgccttgtaacggtcccttcctccaccacccaataatcatccttttcttcttcctttcttttcatcaaagcaacctcctcgagatgcgcactcgctcacccacccccgacacaataccaccccttttcaactacagatcctctcaaattattttcagaccatttgaatcatgcaacaaaattatgtccattcctttacagcaaacgatatttttcaaccaatctttcttatgttttcatggaagacaaacatttggttttaagcttttatgttgaaaaccctctatttttttagatgtgccatctcaaacatacctttggctgctggttcctctccttgagaaaatgctctacaaagaactaatctttccggccattaattaattgcactctctttcttcactttgagaggatagaaaagaaaaagacccatgaggcatgcaaaatgagatagaccattagaatatgattgagtattaattattttaaacttaaaaaatagattaatatgcattttagcaactttctatataatatttttaagaaaaaaataccgtttaatagtttggaaagcgcgcgtagtggaaaatgaaggactttttcctctttatcttgtgtaagggtgttcatagtgctttgacatgctgttcggccaatcctcaacacgtcgtggccagctaggtgttgggtgtgaccaaacgatgtctacggagcctagagtgcgcacacattcttttgatacattgaggccaaacgacgtgttgggggggggggcacgatcgcgttgtggaggtcatggcctcaagtaagaggacgcggcggatatggtgcctgccttgttgtcgtcccccgctttaagccgccgagctgtgccgccgctcgttgtcatcacctgctccaagccacggggcctcctcgaccccttagtaacctcggtggtggcctccatgacctgtctggattgaggcgctgtcgaggagagggtagaggccgtactgtcgcttgtcgttgttgccctgaactgttggtgctggttcattgtacttattttacaggtataacttattgtacgtattcattgtgctaaaaaaaagtcaatctatgcaaagtatgttaggttatgttccattcttatctagagttttttttacggatagcgtactcatctaatctaccaaaacgtgcatttggacttggctggaatgagattcaatcattttggagttgacaatcccaatgaaagctgaacttgtgccttgaaaatacaaagcaactcggttttccgaggaaactaaaaaagttgaaaagaaatatatctgaatgtgaaattattttattccggtttactaacacgaaatctagagatacaacctgtaacagcaagcaatcagtaacggactaacggctagctgggaacccggtgcgttcagcacctgtctcagagactgcatctcaccaaaccgccattaatttacactaatcactcctactactcctctactctctatcaggaggtcaataggagagaagaggagcgtcgtcgagtttgaaatctcaactcgcaaacccccacactactttttcttcgtctattatatcccaacacaacacaaggtgaagctactcctaggcgagagaatctgagagagatgagatgagaaaccttcacccaccaatgatgaagatgctcctcgccgccctcgtcgtcgtcgccgccgcctccttcagggcggccgaggcggcgctcccgtcgatggcggtgggcgtcaactacggcgccaacgccgacaaccttcctccgcccaaggacgtggcggccttcctcgccgcgcacaccaccatcgaccgcgtgaagctgttcgacgccaacccggccttcatctccgccttcgccaacacacccatctccctcgccgtctccctccccaactccgaccttctttcctcgcgaacaagcagaccggcctcgacaccgcccgcgcctgggtccgcgccaacctctccccctacgtccccgccaccaacgtcaccctcctcctcgccggcaacgagatcctcctctcccctgaccccaacctcgtcctctccctcctccccgccatgcgccgcctcgcccaggccctccgcctcgagggcctcaccggagtccgcgtcaccaccccgcactacctcggcatcctcgccccctccgacggcatcccatccaacgcccgcttccgcccgggctacgacaccaagctcttccctcccatgctccagttccaccgcgacacgggctcccccttcatggtcaacccctacccctacttcagctacaacaatcagacgctggactacgccctcttccgccccaaccgcggcgtttacgaccccaacaccaagctcaactacacctccatgttcgacgcccagatggacgccatctacaccgccatgaagcgcctcggctacggcgacgtcgacatcgccgtcggggaggccgggtggcccacgcaggcggacccagggcaggtgggcgtcggcgtggaggaggccagggacttcaacgaggggatgctccgcgtcgtcagcagcggcaagggcaccccgctcatgcccaaccgcaagttcgagacctacatcttctccctcttcgacgagaaccagaagcccggacccatcgccgagaagcacttcggcatcctcaacccggatttcacccccatctacgacctcggcctcctccgccaatcctccgatgtaagtaatttttcattccccatcttcatttcttttcttttcatttggttggttttagctagctagtgtaattaattaccctgagatagatgcagattaatagaaaaaaaaacattggtggtacttattttcagtacatatatgcctgtcattgggagattgattagcctgcatcttatgccaaagattgcattatttaatcaccggggattattcatttcttcttcaggggagaaagaaatgaaagaataattagtactaacagatagattcgcatagctgtagcaaaccaatttttagtatttaactcatgtcaggacgttgatagggcaatcgatatgtacacgcacgctttgctgatctaagctggtcctcgcttccgtgcgaccgtgaccatgcggatattggtggtactagctaagtttggttgttcacaccgcattgtcaaaggtgtagccatggggttatggcccaacctgacctctctggaaagacctgtttccggttcaacttttgctccttatcgcatcgatgatctgtttgcccaggctgcttttctcgatgaatccaggggcggtagcccgcccatgtggtgaagccttggacacgtctgcattttttatacatgctattgggacagccgcaggcctctgattaagatctaagatgcacatgcttctatcgatggctgggcatttctcaacttttacatagtactattcactactcacctaccatgtcatcgaataattacaacttctgttcagtaaactaacaggttcaattgtgctctgttctttctgaatgctacactgacttatgggtttagttagtacatttttcttttaggattttgtgatggaccaaataaccaagagaatggtaggagtacaatatagtaaatatgatgacttacactaatttactatccacatagagatactagtgcttttgagatacataggacaacctagtgcatagtactgcatcagcttttgctgaaagcatcaagtcttgttctgtgggctgtgtagcttagcttctgccttctattgctgaatacagactgtttggtatcccttctttgtagtttgctggattttaagaaactaatgtggtctggtgcttctacgaagctaccttgaagcaaaaagggaattaacatgccctctgcctttcgtttcatgctcaattaaaaacaaactcaaaaggtaggacagtcagtccacactggcaacatataaggtgccattgcacatggagcttgctggttggagcagtgtgccagtgtcgtttccaactttgcttcatctggtgtcacctctatctatccatcccatgatatccacgtgtccatgtgtttgttatttttgatcatttgagccttgctatttctctgttctacttgagctatactgtgtgtccgtatggatcagcttcgctgaccgaagtttgatgcagccaataatgctagttagcctttggtgatgcttagtgaaagtagtggactatggagaatatgggggctatctaactggatcaatttagcgagccaagaatcttaggcaaacaatcatcgatttggacgaggaaacaaaccctgtcttggatggtgccaatgcagaatgcagaaaacatgtatttgctgtcaagtgtatcagtagcatactaacatgtacacacaacaatttagtctcagtctattgcaggcaaactaattttgttgaagagtatgttctaaactggatttacaatgctgtttaccctagtccgcagttttgtggagttactgttttcctgtttaggcactgtggtgcttgaattcttttcctttatcaccttacttatttgatgaaaccaatgctttcctacgttgcagtctggagctccaaacccttcgccgaatccatcacctaaccctagtccgaaacccgctccttctggtggagggaagtggtgtgtccctaaggctggtgcgagtgatactgacttgcagaacaacattaactatgcctgtggctatgtggactgtaagccgatacaaagtggtggcgcatgctttgatccgaacaacgtgcagtcccatgctgcatttgtgatgaatgccttctaccaggccaacgggcggcacgactacgattgcgacttcaagggcaccggcgcggtcacctccaatgaccctagtaagttgaaacaactgtttctcgttcatgttctgcacctagcagcattacacattactagactgtcaaatacacttattcagaaagaaagacctgctatgtttttgaacatggtagtagttgatcatttgaactgaaaccgatacatgcttgttcggcaggctacgggagctgcaaatacgtctcctgacgggacgcagcaagccatggcagtgcaggtgcagcggcaccaacctcgagtctacctccaggcttaagtcacggaagcgctggagggttgctaatactgcctggcttgcgcctaatttttctctgctcttgtctgacagcagccatgcttctttcttagaagagctatactattcattactctcgtagcaccggggaatgaacctattaaaattgtgtatccgttatcagtcaattcttgctcatgtttggctataccgcagttttctcattgtgtagtgaaatcatttgtgcttaacttatcattccattcttctattctatgtagaaatataaaatgaaccaccaaaagaattagagcctcccagttttgctgtccttttgtttccatgtttgaatgaaaggggtcgtacagggtaggaggtttgctagtcttttgcatttgttcatttctgttatttttatttttacatctgtggcagtcaaaacttctcccgaactgaaccgaagccttgttatgttttcatctcagcgtttactctacagctcaagctcttctttcactgtatagctagcatcgatctacaggttcagaaatactagaacttgggatgtaccgccgtgccggtacaaaatcaacactgaaactgatagctgcaaactaaacagacatgagacagtcaaattgttcagggttatagcaaggatacgtaggatcgaatacacggaaccaagcctaccatggcggatttgcaaaataagagcacgcatcatggacaagaaaacaactagtatcgacttaaggaaagcataggtttctccctttttcttttaaggttatcattgcaagcttcttgctttagatattttgtattaaccaaagaatcgagctttgggccgtcttgggataacttgatgccgatcgactagaatgcctggcgatgcaagaaacaatgccgggccctatgaaggagagaagtagctgtgcattagctcttccctagtttcagaaagtttcaaaagttccaattgatccgtgctcttccctagttgaactatacgtaaaacggaccgacgtattctcaaaaaagctttcggcagtgacgcatgatttttctccggctataatttcacaagtttgagcgttaggattgttgtgcacaccattaaccttaggagaaacaaatatgatttgtttttcctttgagttacaattccctgagttataccctcagggcgaaagttgatgagtgtgttaaattttagaaaaaaaaacacatgaatttttctctagcacacaactttacgagtagtagcatttcaatcgttgtgcacaaaattcgtgagtattaactttagggaaaaaaattcattatttctcttcttcgccctaaaccctataccctttgccgaaagcttaagaggattaacatttggaagaagagcttaaattttttctctcgccaaaaaaaattaacgaggattagcatttggatcatatattgtgtataaacttcgcgggtattaatcttttgactaaacgtttcatatatttttgccttcagcctattaatggattccatgagttatagccttcggagaaaattaatgtgtattaacctatttgaaaaaaaaacacttgaatttttttccttcggcccaaattattctaggcatgagcattgggattgttgtgcacatgaaattttatctttagtccaaactatcactagtacgaacatcagggtcactacatgtgaaatatgtgattacttacatcagggaaaaaattcatgaaatttagcttctggaaataaacgcatgatttttttttgtctgccccaaattttcactagtagcaccaggttcattgcgtgtgaatttttctagtattaacattacgacaaaaaaattatgaaattttgccttcaggttataaaattgtgagttatagtgttcgagtaaaacccgtgagtattatcctttggaaaaaatgcatattttttttgtttggcccaacattttgctaggaagagtcatggcgtgtgaaatttgtggatattaaaatgaagaaaaaattcatgaaatttcgcctccattctacaaattcatgagttataaccttcggctaaaacccgtgagtattaactttcggaaaaatcacacaatttttttcttcgatccaaattatttctagtattagcatcgagggcatggcatgtgaaatttgtggatactaaaatcaggacaaaaaaatttcatgcaattcagcctccacgctacaaattgacgagttataaagccttcagccaaaatatatggatattaaccttttggagaaagcataaatatttttctccatcccaaaatttcgtgagtattggcattgggaacgtgcacaaaaattgtgaatattagtcttaggaccaagattttcgtgatatttagcattcgacatataattttgtgttttatagtccttgggccaaaactcatgcaaaaatcatgaatatttttctccgccccaaaattttctatcataaatattaaccttaggaccaaatttttcatgatttttagcctttagcttataatttcccgagttatggcgttgcattcggctcgactcaatggatgagctacatctctgtagctcattttttataactactgcgctttttgcaaaaaactttttatatagatgttatttaaaaaaatcaaatctagtcacacgctcatcttgttttgtgtgcctctgataatatcgtctcacgctaccattctagcgtagctttgggcaaaaaaaaatatgaatattaacctttcgggagaaaaaacatactatattaacctttcgggagaaaaaaatacttttgtgggttgaaggttaatactcataaaattttagtccaaatataatatgtattcaaacccaaggctattgatgaaatttttggcccaaggttaatattcatggaattttcgtccaaaggcttatagtcaaaggtttatgtttgaaggctaatgttcatgcacttttggagtcaatgtgagtgtcatgaattctccagaatactactactcgtgtgttttgggctgacgactagcactcatgtgttttagcgctatggttattaatactaatgaaattttaggttaaagctaatactcatgttttttttcatgttgatactccatcttatattcatacctattttttcccagggttaagaataattaaatcatgttgatatcttatattcatgcctatttttttccaaaggttaagaacaattaaatttagggtagatggcaaatatccatgcgttttatgtcctaggtgtataacagaacttttggttgaatcctgacatatgtgcaactctgaatttttaggccgaatactaatacttgcttgtttctcagctatacgctaccattgatgtctttgagcccaaggtagtactcatgaaattttataccaaaggctaattgtcgtgttttttagggtttaatgcttatatatatatatatatagattttggctcaaataggcgtctgcacaggcctttactgggcagatgctcgactttaaaacataattttatggaacaaggccaattaatgtaagcaagacgttaatgtccggaagaatgggcggaaggggtcaatgttttgtccgccctgagtaggcgcggccccagcatcgaagcctcttttcaatcattgatagagttccttctgtccgacgcacgatatgttggatttctcctttgccgattgcgattttctgccacgacgcaggctcttcatcgaaatgtgttgctatgtagtaaaagaatagagtatgaataaatgatatatcaccagacgaaattttaatacattttgccaagggcaaataaagcaacaaagtgtcggtaattttgacaaagcattggactgtataatactccctcagttctaaaacataagcacttctaaaattattgacaaatattatttatcccatcaatcacttattcaaatattcctttcttacccccacccaccatcaccatcactcatgatgaggggcaccaaattcttttccctcgaacttaatttacgataaacaatctaaaaatgcttataattttttaacggatggagaactttacaaaaatgctagaatagaaacattaaaacaagaaatacaaaaacaattcattggttacaatattgcaaaaagaaaaaaaaatacggtttgagttccaaacttcaagcatagagatgacaccggtgaaacattttctatgtcttgtttgtcattaagtactatatgataagcacataactgttacccctaccctatcaggcactgtgatcagcctgaagacataatataaacggaaaatttctcaatggcatagtggtaacatgaaatacacgtaggcattctggagagttgtttcaggcacaataccagttacaatatactgtaatatagtaaagtaaattatttgctgtcatcttatttttgaagaagagcaatagacaaggtctgggtttgtattttactatgctgaccaaagcatctagcgtcttttgttctgtactattttttcaaactaagtattttggtttaatctaaacggctaacatctccgactaaggttctggccccatgccaaatgtgtccggaaaaaagagcaaagcacatctattctttcttagctacacaggtggaaggtccacccaatttggttaaatatggattcaaaagggggcctgaatgtgactggcaactgctcctggaccagagactccgtatttaacccgcagtttgagatacatggagcattttcatcaaagcaacagcactaattgattttactgtcagccaacatcgatcaacagaggttctaggcacatttatcgagccatcaagtgtatcttctagattgtttaaccttctagccccccccccctctttcttaatgatatttggtcggccaatccttcggccgaccagcaaaaatttaaccttctagtggttcggattcagaattggtggcaaaacgtgatggtatcacatggcgagccaacatctagtcagcaaacaaacttggtgtgtaattattgtatgccaacatttcgtggggcctccttcagtttacaacaatatcagagcaacacttaaagaaccaaagtatgctgcaactcaacagtaacaggtaaaatatgtgctttcatttgtataacaacatggtagtagatccagtgtattacctgtatagatattgatcaacaaagtaacggtcaggtgtcctcaaatttttgaccgacagacgaattggcataataaatttagctttgtgcctactccgattaagctgaaaaattgtgaaacagactttgacaatcttatttacagagcttatcaaaacattgagtatcattttcatgtgtagaaataagaatttcccttaccgtctgccatgcagatactcttttcccccttctcgggtatacaatcatcctcttgtttgaaaggcagctcagaagtgaaaaactatgaaggtttacctactacaaagaactttaagacatgtagttgcatatattgttttctatcttaacaaaaaggtgtctcattggttttcctatatagccctaagcaaataagcacatcaaatttacagggtatgatgaaatccatcctaatattgccaagagtagcaggatccagaacatggtagcgtatttgaatagtttacagaacaattcaaatctgtaaaccagcttgtttatgtctttcaacacacaaatcatcagtttgacatggaataattactttcgtatggcacattaaataagccccagccactgtccatcacaacaattcaatgggctaagtgaaaagacacaacaggaaaaagaacaataatatggctgcaagagggttcatttaactcaatcaactctcttgaagccatcttgttatatgtatcactaccatgtgtagatctatcactggacaatgggaaggccaagtgcttacccaaattaatagcaatggaagcaaaagctgcagaacaatccaacagcaacatacactagcgaatttatttgagctctgtttcttggatttcacaaacagcacaacactattaagtgcacagggtaaagaaaaggagagattagataaaacagaatgatgcaagtatagttggaacgatcacttacacagatagagaagcgcattatgtaagtagagagcatcaacaaaagaatatagatgaactgcagagaacgccagcagagacttgttcttgcaacgagttgcacaaggaggggatgccaagctccaagaaaactggatgtcggtgagaatggcagaacagagatgccatgtaaagatttagccaaagaacagtgattttcttgccaggcactatctcaagcagttggtaggcatctagtgaccagattatgcaaaacaataccaccaaaaactgcagggaccttcatacaaacaaagatcaacaatattaaatgtgtcagatgaaagaatagttgaaaaaaaaaacctaaaatgaacaaatgaaagctgttcaagagcaggaaaaggagcgtgctgtgagaggcaggtgcagacagaggttctgcttggatgcccatgggatggaagttgattaagtgattaaataagaatttcaaaaaaggcttttcaagagaacaaatgggatcaatcatgaataatggcaatttctaacgcaattacagacaggacaggcaaggagcgcctcctgacacacgtgtgggagtcatcccttccaggtgccaagtgaaggcatgggggatgggctgacatggcaaaagtggaacaggggagtccagctgggccagtctatacatgagactgatttgtgtaacggctgatatctaaggattagttcaatctaacagctgatatattgttggcgatgcaacatatcttagcattggggttgctttatagcaattactgcaattagttgtttgtacctatatagaaagaaaggataccagagcaagcggaccaatatgcaagtcaattgatagtgtaaggctgcacaactaaacgtatatgtaagccaaagcatgatttagaattcagttaaattgaagatcagttcctagactggctttctttgtttcaatttattttctctttcccatttgtaattattgtatgtgctctttttttggtgaaaattaacagcgggggtttcccctgctgcgattacgtaaatagaagtttcaattgaagataagtgttttgaacacatatacattccttcaaccaccatgagaagtgtgttgttcacgaactagttcatccggcatgagaatgaacattatcggtatacagcctaccttggtgattgacctgcaggtggaataacagccacttcaacatgctcatgagctgcgatggaatccaagacctttcctgactaaagttcaacctaacaaaagtattagataaaaaaattaggtgcatagcctctcaaggcagtttgaaaacatcaaagaaaaatgcacagaatcatgaagaaacgatgtggattttaagtggctgagttcatttgttagacatggtacttatggtatggtgtagtgattttaatgggtcaccttttctataaatacagcaagatatgctatggaaaaaacgaaaatatctgttcgggtatgctatgacagagtatcatgcttccaaatgtgggtacttaaacgtattattagcttctggtgtttctcttgaaagccaacaagcaccagaaagtgtgttttcactcgttaagagaactgccgtactgacagagaaaatactttcagtatggcagtttttataacgagtaaaaatactttgttgattctcagtgtttctcttcaaagccaacaagcaccagaaagtatttttatcattaagccaactgttttctatgacatacttacaaatgagaaaatactttctcattgattcttctacatgaagtacctctatttgaggttcaccaatgcaggagcgtatatttcaccacctcagggaaagagagagctactgattaagaagggtgcaaacacacttcttttaccacctcggggaaaagaaagaactatcgattaagaatgggtgcaaagaaaacacgatgtggtttaaatgggtaggggcttatgctatgaggtgttgttaggtgatactccttttacatgttagtttgagagggtattgctaaatgcaatacatgttaatcaagatgtaagagcggatcagtgaaagcggagaaagggggaacttaagacagattaggcaaagcttaacaggagacttgaaggggtatagtatgtattaatatctacataattcacaactacaaatattaactaactccatattaagatgtcacaaggtgctgtgaaatgaccttagctgtaacatcaggagaaaataggactaacagaaaaagaaattttggcgcataatttcagtgtgctaacagaaattgatgcatttctgctgtgataatagtacataagccaagtataatatgtatgtttggttcatggccttgctttacacctttggcaaaacatattggactgacttttaacatttagtttactgccatactttccggcaaaatcttaacctagatagtgagatatttaaacatgacagcagaactaaatatacacggaaaaactatacatggaaaaaacccatgcactggtagattcacaagaaggccaagtaaataaagacatgatactatggttgattcacaaaaaggccaaataaataaagacatgatactcgttactgtctttcaaaaagaaataggaggttaagaggcctacctgcaccacacatgtgtgcacaaaagtcttcacaagtaacatttttacttccatgcctatggaaatagatgcccatgacctacagaaaagatgagcttccattgatgaaatagacaaagaaaacagactagtcctctagaaaagagaacagaacatattgggagcagatatatttgcatggtacatgaccattatccctttggcctaacaagaaaacataatctagtgtatgtatcttacataaaacataagactacttatactatcaaatttgaattaccaaatcaagcttcaaacaatgtgttgtgcattctagaaacctcagggcctttgggatagattattcccatataacattgtaatagccagctgttgttgatggaaaagatggttggttctaaagttagattcttgcaacaaaataaacagaacagagtgcacatcatgaaggagtgctgcatgatgacctgatcttttcatgctagtagcctgtttgttagacttagctgggaatagtcaaagcaaatgaacgcctaataactaaactatcatgaagtaagcacatcgtttacagaagatgtaaagaagaaacatttatatggtttgttggatatgaaaaggtagcggaggttatcgataacagtaggaatcaaatggctttattattaaacatgtagagaaatacaaaaataactcaagtgtttcaatagatgatagttagccgcgagcacctgtcttgggaagccaaatttggcaaatgccgagaagcttctcggtgtgttaagcaattagtggcatatcagcacactcccaaaggttcccctgcctcaactatctctgtgcttcttgcctcgtagtactgcacaatgaatccatccacacatacgtcaagccagccagattcagttcaacatgacgcatcaaaataggttgtgatgaaacagaggtggtatttcccttgaatacatgccgacatcaaaccctgtattattcccttgagatccattgaaaccctagattatgagacctggaataactaaagattataggatgggaaaacgcccaaatttgaacctctattcaccgtcaaaccctagattgctaaaaccaccgaatcagtctaatattagcctaaggagagaaagacgtacacgaaccctaggcaatcaagaggagtaaaatccagaagaatcaaacagagttggatcttgtagtggagattgtggacaaattaaacacaagagaggcgaagggagcggagggcggaggtagacctcggcaaaggggtttggtttcggtggaggaggcctcgtccacgatccgatgttcgccgccgccgccgccggggtttaggggaaggcggtttctctcgtgtgattggggctccgcgagagaagggaatggagaatgcgctgcgcgggcaacggcggcggcggcggagcgtgtgcctaggtcaggcgaggcggatggaggcggcggcggcggtggtgggggcaagaatagccgctagattgggtttccaactgtagtactttttctctctgcttttttttccctttttctttgaggtgagatgtgtcttgcttgcataataatagtactaataaacagattaactgcactactgcagttaaaaaaatgtagtctttacattttctctcaccacgcgcagcgtggtactcgtatccaacgtttttatccccagtcatacttgtagctcatttctaatttatgagcttggtatgttacaatgttataatgtatgagtatattattactattacgagtaacaggtaaccgggtaaatattaaactgaattattggactaatttcgtaatgagccactattgaaggtacaaaatacatttccataggaaatatagcccaacccggttaaaatatttcatcactttatttgggggtacaccattacaagcattttcccgtgaatagtggaaacccataacatagcacatcgattaacccatcacacacacacacacaccccatatatattggtcaagcaccaacccaaatggccaagcttctttatttttctgcatcacaattcacacgcacacatgatagatggtagatgcaggcaggcatcttagcagttgcaagggttgcacctgcagctggaaccgcagctgcagccatgggcggtctcgccggactctgcggccgcctcaaactgctgcgccttcttctccggcgccacacccagcacgacggtggccttggtgctgctgctcttctcttccaggtcagggtacttctttctgcaacaaaatcaacatcaatcagttaccacaagaattaactctgcaacaacgattactctgcatatttagagaatattaataatgaaaagattgccctataaatcaagaacaagtcagcaaagttacagtgaaaattacccgcaggagcagtttgagccgcagctgcagctagatccacagctgcaagacatcttctctcagtctgtaattaagctcaagcaactgaagatgaaatcaactaaggagaagaagaagagcttttgagatgatgagcgcaatgcatagccttcgggtcctcctcgcttcttataggactggatcgaggccggccggcaaagaagcgtatattaccacggcgttgctacgtgtcccaatgatataggctattaggctgtctggaattagtcaatacaagttatctctcgtccaatggccattatttgacagtgaagctttttgtagagcatttgattttgattttgattttggtttctcacaaattttagtctccatattgatggcgagtgttattggatttactatggctacaacttctactacttggtggcagtttcttacaagtaaattttctaatgtgaattgaggcctaatggaaatagattacacaccgaaattacttgcttgaataatttttctgaacagagttcttcttcacgtctgtgtcaaaatgtgattgctttctgcaaaagcaacaatgcgtagttgacttctcttcccttcttctcattacaccagcaacgttatttaagttagaatatctaatatgaaaatgcaattatacgtcattttatatctaccaatgacttctgcaactgcctagcggcaagaaatgggccttctatgtaccttctcaccgtttctgttgcatcaaaacaattaagttttagataaagaagcattttgttcaatatgccttggcattttttaaggatagtgcagtatgtactgatggaacaattaaaaataacatctgagtatttctattttattcaagtacattctttatgttatcttggtttcctctgtaaccttcaaggctgtacgactacagccaagtattttctgcgtgagggtttacttcagaaaggtatggcccattgataaggtcaataagagtggaaaatacatgaaatttgcatggatgatagtcgatcaattcaaccttgattgttcataaatacgtttttttaaaaaaatgttatttataaatatgctaaactgctgcattcatgacacttacgaacaaccttttccatcatcctatgttatttccactctaaggcatatgccctgtttcaagcagagaggatagatgacagtaagaactgcctgaaaaatgacaactacccagactggtacacaagaaaccttccttgtaacattcatcatgagaaaatttactatccttgagaggtaccgagacaacaataggcttgatgctacgttgccaacttgtctgttttagctgacctgactgagacaacaataaaacatcacatccagcacatcaagaatccagaatgggatctccttttttttatatatgtgcactgaaaatagaaaacattatcgcactacgttacaaatattgtgccaaaatccttagcaacttgctaatcctatcctacgtctgggaactatgatagctaagtattttcacaagtagtattttcactatgatctatatatattagcagagcatatatatgatctacaacaaggagtattttcactatgcgtgtcctactaacataggacatgtaacatgttgatatataaaaaaattaactctaaaaaataatagtaacacatagaacaaggttatctgaaccatgggtggtactcactgcaatttcatttcacttatggaaaaaaatttgaaaatataccatttttctcataatttgcgtttatatacacgggggagaaagatttgcgcaaatatacctctcccgcgtgttgagaacgcgggagcgaaacgaatgcgtggcatggtggtgctggaccgagagctgcagcgtttgcgcggaacggtggcgtggtaccggctcggtcgcgcagaccgagagtgcggaaccgagccggtcctgcgcggtggcggcgcacgtccgggaccgagccgacgtccgctcgatcgcgcggaacggagccgcgggatcgccgcggtcgcgcggaatggatcatgcgggaccggccgcgctcccgcttgccctatgcacgggaccggataaagttgctaatcggttttacacatatcagtcaaaactttgcagctaaacatatattttgcagcggtttagtacgtaaccgcaagagcaagctactgaaactgggagtttgaaaacgataaagcaagccagtaacgcagatgattacgagacatttactgcttttctgcccaacacaaacaaaattgatgatgcaaccacggggctcagtagagagatctcacggtatggccagttacaggtccgtcgtcttcgagctctttgaggacgtagaaactggccagctgcaagtattaacattaccgtgattacaagtaatatacctaccctgagtttccagttagcaacaggcatgctcagttttatcccaactggctcggtcccgccgatccattccgcgcgaccgcggcgatcccgcggctccgttccgcgcgatcgagcggacgtcggctcggtcccggacgtgcgctgccaccgcgccggaccggctcggttccgtactctcggtctacgtgaccgagccggtcccgcgtcaccgttccgcgcaaccgctgcagctctcggtcccgccccaccacgccgtgcatttgtttcgctcccacgttcccaacgcacgggagaggtgtatttgcgcaaatcctcctaatcctttatatataaacataaattatgagaaaaaatggtatatttttaattttttttcttcacttatgtattgcaaaaatcagggacatgctcatatcagagacgtcagtggggaagaaagcatgatatttgagagtaacatcctactgaattcaactaggaagtcccagcgcttcatatgcatcaagggagaatgaaagctacaggtatattatataaatgtacagtaagttcggatgatcgattgattgcaactcggtgggcattttcccgaagtcacaattgactaactgaggactagaacgggaggccaaatgtcgccacttctgaaaggaacattttgttcagaacttcaagatgaaatgagcatggcgatgatgtgcaaatacgtaatggacttaccaatgttcagatccactcaggaaaaactacagctatgacctccagaaaaagaacaatgagatgttcagagacaatccaacaatgaaataaaagaacaatgaattgttcagagacaatccaacaaaaaaaaaaagcatcgcccaccgtggggctcgaacccacgaccacaaggttaagagccttgcgctctaccgactgagctagacgggctcacatgctgaagagcttctgcttgcctattcattgtgaagtcaagttctgacgaaatttcaagcaaaatgatgtgtctttgtttgccaacatctacagatgagaacaactattgtttacctatccatgttggttcgtgggagttcttctctgtagctattattacagcacaagctccaattccctttgtagggagaaaaaaatgctcgagcttagtcaagataaagtcagcagcagctgagtgtcaaaatggagttccaaggcattatacactgttgatgttgaaatcataagaactttttcggccccaaagcctagatgcatcatcacagatgcaatggaatagcatgaaacaactgaagcctgctaccctggaaacactaattttatgactagttgttcacgatctgttgtggattttacatccccagcctaagtaataacaagaaaaagcaaaacaaaagcaacacatttgtacgaactgccgagagggaaattttccaaaacatttccccactgcatcagcatctcaaggaaaaattctaccataattttgctcaacttaatttaatctaccacaattttgctcaactcaataccctgaggatctgaggcatccataaggtctctcagaccaactctcagatctggtactccctcttgcaagatggcacatattggaaacattggaacgccctgcactctcttcttcagttcttcatacatttcatcggctccctcttcatctattttgtttgcaacaatcaatgatgggcgctttgtcaggccttcttggtaatgctccagctccacgaccaaatcccgcagttgctcccatggcgggacaccctttcgaccattgagcgtggctgccaggtcaagtacgtaagccagaacttttgtgcgctctatgtgcctcaagaaagcatggccaaggccacggttctcgtgggcacctttgatcagaccgggtatatcagccactttcactgagaagtagtcctcataagttaagctaccaatattgggccttagggtggtgaatgcatagtcagctatctctgggcgagccctagagagagcgctcagcaatgtgctctttccagcattaggcataccaacaagcccaacatcagcaatgctcttcagttccaagataagataggtctcagttccaggatgtccagtactcaagctagccatctcctcttccttatgtgctttggacagccacatctccttgaggatacaagcattccctagtccaccttcccctcctcttgctatgatcaaccgctgcccaggctttgtcatttcagcaacactataccgaacatcttcttcctcctccttttcctccgttacctcctccatgtccaactcttcttcatcgtcctcccaaaattcatcatcctcatcatcaaattgatcattttcatctacccccacctggtgtggatagctagtgccatcataatcttcggtgcgcacaaactcagtcatgtaatatggttcctttccccgatgatttctgtttcctctttcacaatcattttcagcagtgttcttcttggaagaaatatgttgactggatcggctgctatccagacctttcatcatcttgctgccaatacgactggagctgaatggtgagtgttcaacagcatctgggatatcccagggatctagagctctggttggcttatttacagaaagagaaggttgctccccttcaactagatgaataacagtgcctactggtacctgcgcaatctgtcacaaacaatagaagaaagagatgtgtcaccagttttcttttgatagagaatcgcatatatatatatatatatacatatactggtggtaaccttgtcagaacctcttgtcccgatctgattctttgaaactccattggctcctcggcttgctttctgaaaatagagcagtgtacaggcatcaagtgaggtaagcaactaagcatgaattttctccagacatatatctcaacagaattgctccatatcatatgaaactactccataacaacaacgaaatatttaggctctgaagctagccaaaacaaattagtacttgatacaatttcaccaacaacagttgaacaaaagaatttccaaaggaaacacatgataatcagggtggataaataatcttggtcagccttttattgtaacaacctcattgtgtcttttatatatgcaggcatatatcaggatccttcatattctttcgtgatgatttttttttaaaaaaatctttaggatcatgattgggtagggttagccccttttagttcaacaagttcagattctcagcaacggcacagtgtttttaggaacacagatcctaaatctagcacaatatgatgttttcaaacagcaggaaaccaggaaggtgcagaaaaagtatgcatctctggacaaaacggacaatatgatggttttaaacatataccatgtgatgttgcaaaccactgaaatcccagacagaccttgaacactcaagaatgacatcaccacctcttcctccattaccacctgcatatttcacataaggaagatctgatctggctccattgtttaagaaagaaaatcctgactgactgactgtcaaattagaacaaatagcatgaattatctttggccaacttaaatagtacaagcctagaaatattctgatatagtcatgtgtgaagcctcattgacagggcataactaaaaagaaatccctttatcaaggaaacaacagaaacaactaggcattattacactacaaacaaatacacgaaaaagattactgctagcaccatgtgacaattccacaggctgtgcagcaggggagtcgttaaaaagtgctcaccatcaggtttgccttggcgatctgacctggagcgccgaagactgatgcagccattgccaccatcaccacccttggcacgcaaacggaacctatccaccatgccccttgactgcaaatttcagtatggatgtttcttactatcaccgtgtgatgacatggatttcttgaaacctcaaagaatgggtgcctttcagtatatttctattgtcaagcttttacataatgcaagtttgttattccccacaagtgtaattgggaggattaagaaagttaaaatccagtggaaatcaaagcatctctatggcatgtgtgtaagaaaatagtaattctgacaaaaaggacagcttgcttatgagaaattgttaagggggtaaaatggtatacgggtggtttcttattatgctgttgctgccttggatgatgttcagctgcagtgataaataatcagttcaatccgttgttctcagtgtttgaatgcagcatatactgaaacatttcgtacaaatacacaactcgtcgccgagaacacaaggtaagacacatatatattttaaatagtcctgcactcattactcaaaggagggagggatttgccatgatagcaagcaccgagcctagcctagagataacagattccagaaattacctgcaaaggcgccgtctttggcttcctgccttccggctcggtggcgtagtagcatccgatcccagtagccgcgggaggcttgggcagcgagatgcggcggaggagagcatgctgccgcctccacatcttggctgtggaacggaagtcgtggacggagtagcggaggcggcggcggcggcggtggcgacggcaggggagtggagaggaggaagacgagcggcctggcgtactgtgagattcggcccacgggctctccttctcattgggccatatcccacaggaaaacaagaaaagtagacttcaatttaagcccctgtttgtttcagcttaataatattattgtaatctagattattaaatcagattactttaaactggattataataagctaacataaaataagctacgagttgtttgtttctctggattattagaggcatctaagggtagtgggtctttagccactcaataatctggaaaaagcttctctagaggtgattattggattatagtaatctagcttatagattaaaataatctagcataataatctacttgtttgtttcagcttacacctaataatcctaagctaaatcaaacagggtcttatatggcctctcatcccctagctgagattgctaattggcgcgcgctagatccgtatctggcgcgtgtggccctccaccggccacgtgtcttttttagtgatttttttctctgttttctgcgtgatttttttggcgcgattttttccatattttttttactagacttcactgccgagcaagatgccggcggcgctgaagccgtaccgcgacaacgagctccgtaacctgcgcaacgacgaccagcagggcccgtaccaggagcacgaccacgtctaccgctacaacgtctacaacgacctcggcgagcccgactccgacaaccctcgccccgtcctcggtggttccgctggcgaggggagggagaacagagagagagaatgagagattggggagagagagaggggtggggcccaccaattttttattaaaagaattgctgactgtattgtcacgtaggactaaaaccagcatggattgaggcggggggttagttgtccggtttgcacagttgggatgaaaaatatccggttttgaggtttaggggggataattcgttcgaccgcgatagttcggggggtaattcgtacattttcattattattttcattattattattattattattattattattattattattattattattattattattattattattattattattattattattattaagtatgaatccccccaactatctcgatcgaccgaattacccccctccccccaaacccgaaaaccagacattgctcaccccgaactttcaataccggacgaattacccccctcgacccaatccagagtggttttgccctacgtggcgtacgtgtggcaatccagtcagtattttctttttttaaaaatagtgggccccacctgtcatacccctctctctctccaccacccattagattcttcacatcctgatctctctctcaggcacaggcgtgcccggcggcgcacagggtgggcggtggacggtggcgcgcgtgaggcaggcggtgagcagcgacgcggggacgagtggcgcgctggctggggaaagggttcgacgcggcacaccggcggctacgacggggtgagggggctgtgcgaccggtgaccaaggaggtgaaggcggtgaccagggcgactgcagtggacggggccgccagcgtccacctctctctctctctcttgggcgcaggtgcgcatggcggcgcagcggggcgggcggtagacggcggggcggacagaggcgcacgggggtgcgagacgtggaggcgggagtggcgaacaccaaaagctggagcagcgtcgggaggaggacggggaggaggaggaagagggtgatgccggcggtg

SEQ ID NO: 22779 - DNA, 8701 bp, Oryza sativa
  unsure (1)..(8701): unsure at all n locations
ctcgtgaactcctcgtaccgactctgctcctcgtcctcgtaccagcgacacggaggacggtgcatgagatggtcgcggagggcctcggcatgacgcagctcatctccatcatccaccccaactccacctccggctccaggtcgccctccaccacgatgtcggcggcagagggtgcgccgttgtggcagctgctgtggccggtggattgtttgccgctcccacctcggggtcccgcacccctgcgcgacggcgcncgccgtccacctcccgcccctccgcgccatcatgcgcacctgcgcctgagagagagagacgggtgaagaggcatgataggtgggtctcaccaatttttttaaatgaaaatgctgatggaattgacacgcgtacgctgtgttggacaaaactgctctgaattgggtcgagggggtgtaattcatccagtattaaaagttcaaggtgagtaatgtctggttttcaggttcaagggggtaatacggtcgaccacgatagttcaggggtataattcgtacttttttccttattattattatatgttcatgttggcactaaagtggatgccacgttagctgggttaactggccaacaggtcacttaggacaaaaccaagatgcatatcactaaaggaagtaaattgatctcgttttgatacctgagggaggatgtgtaaactagcatgcagagctaaatgcccattgggtaggaaaagaagaggcaagaggaaaacaaatgaagaaaataatgatgaagatccctcaacaatccgttccttgcctcacaatctcgcataaaaaaaaagaaaataaaagccaacaattaaagatcgaagcagaagcatcaagctaagtgcaggatgaagagcaaggcaaggataaactttgttttaaanaaatagactttctacagtgcttgtgatatattagagccattgattgctctaaatccaacacattaagatagaaggtaccagcgcaaaggtacttaagatttaggctatgtataaaattcatgcgggtggagattgggaataaaatcgacagcgcgggattcaattgcacaagctctgcctctttggcgagccctctccaccactgggcaagtgcgggttttacgttcaaaacaaatctacactctagttacacctgtaattaaagtgaaaaggtttttctcctaaatattgttgaatgtgctagctattggtaaactcaattattaagccatgagaatcagaaagatttttttttttcaactactaatactgtgttgttagaattggaggatgtcacatagtactgctttccaaatctcttgttagggtgtgttcaggactctttgccgacctctattatattgttttccgtgtgcatacattcttgagcttgaaaaattttctatattaaagttgttttttaaaagatcgtattaatatattttttaactttttttagatttaattaattaatcatatatatatatatatatatatatatatatatatatatatatatatatatatatatatatatatatgaaaatgattctatacacctgggaggatgtacacctgctctcatccaccgtcgatatgtgattagcttcgatggatcctgatatcggattaacgagcggacccgtttaactttttgacgagaaaaaaaattacgtaccccttaattaagccacggaaaccggaatgacctgagctcgcacaattcctcgttcccaccagtgcatcggatccgaaaatcaggtcactgggagagaccgcgatataccagaactcggagaaggcggcggcgattcatcgtcgattccgcaacagcagcgagatgcatcgtcgatccatggctgcgttgcaggtgatggcgtgatgcatcggcgtggcgacctgcacgcgcggcgcggcggcggtgtcgaccgatcggcaacatcgtgcggcggaattgcaggtcatcgtcctcggcgcgacgggacgggactagtcgacggtgcgatgcagcaatagttgaactaacccaggcggcatcaatcactcgtcgatctcgcgcaaagtcttttcgatggcgacaatgcattcggcgatagccatacgagatcgatcagatcctgtgtacaatgtggttagtactacttaattatttcttatgtcgtgtatatcacatcaatattttcttcttctttgcccaggcagtcgcatggtgcatatgcacaccttggagaggctagtgatgctagtcgtcgctagagtccgcagtacggtgtgcttgcatatatatatatatatatatatatatatatatatatatatatgcgctaataagctactgcgtggatcagtaagccgttgaatctgacatgatgagtagtagtttgttaatccaacgggataggtgattcgacaatattgatgtgtatgaagatttccatggttcaaagatatgcatttgcccggtcggtcgaaagaaaggccgaccaaattttattaagaaggggtatgtacaacgtacttaccattttgctagggtggcaagctgatgtgcagatatcctaagtgactattttttaaaaaaacttaaattgcacccactaacaaggttttaataccaacatagtcaggtttcattatcttgtactcaatcacagccaacaaccaatatttatgtacccacggtataatttactcaagaagagggtagaagaaagcaaatgaaggaaatgatgacaaggaaaaagatggaccctgcaatgagcccttccttgcatcacaattaatctgaccgaaaaacaaagaaaagaaaaaaagagctaaaaacaaattaaaagattgaagcagaagaagcaagctaagcacatgatgaagagcaaggcaaggcagggataatctttattttaaaaaaggaaagaaaaaatgtctgctggtagctatatatacgcgtacgcgcgggcactgactacttcatcaaccaatctgccctccagtgtgtgttagtgtcgaccactcacatatggccattgttctggatgcgttcgcgtcatacgtcggcgacctgctcaagcaggtggccaaggacgaggtcaacctcctcttcggcgtcttcggtgagatcgccaccctccacgacaagctgcgcatcctcaaggactacctcgctgacgccgatcgccgacgtatcaccgaccagagtgtccaagggtgggtgacgaagctcaagcacgccatgtacgacgccaccgacatcctcgacctctgccacctcaaggccatgcagcgccagcgcggtggtggcagctcatcctcctccaaccctgtgggctgcctggactcgctgctcttcttgctccgcaatccactcttcgcccacgacattggaagccgcatcaaggcgctcaacaccaggctcgacgccatctgcaagagcgctgccgctttcagcttcctcaagctggaggcctacgaggacatggcagcgccccgacggtccagcgccaccgaccgcaggacggacccggtgctggggaaggagagatcgggtgttgttggggagaaaatcgaggaggacaccagcgcgctggtgcaaaggctcaccaacggcaacacggctatgacaacgatcatggtggttgccgtggtgggcaccggcgggatcggcaagacgacgctggctaagaaagtgttcaacgacgagaccatcaagaaagcattccacaagaagatatggctgagcgtgacggaagaccagaaccaggtggagctcctgagggaggccatcaagtccgccggcggcgccagtggcgccggcgatgctcgagacagcaacagcaagtcccttcttgtcgacgccatcaggaacaagaggttcttctttgtgttagacgacatgtggagtgacagggcatggtggaacctgctcagggagcccttcagccatggcgccgtcggcagccgtgtcctcatacccactcgacatgacgacgttgcccgagggatgcaagccgtccgccccttccaccacgtccacaaactgtatcctcgagatgcctggtcactcctcaagaaacaggtccgtcgtgttattctcccatacaacaacgtacatgtatgttacttgcataaagtggtttttatccactcaagtggacatacactcatttcgtgcatgtcacctaactaaaaacctacccaaaattttgaaaaagaataattgataagatacatcaatatttgtgtgatatatacaccttacaaacatgtaagtccatatttgactagcttatgcaatacataaaaaataacaaatatcaactgtgaatatatagtaagctaaaataatctgacttgttcaggtagcgtcaagtgatatggaggagcttgaaattgacgacatgctcaaggacatcggaatggaaataatagacaaatgtgacggattacctcttgctgtaaaagtaatgggaggactgttgcgcaggagggagaaacagagagccgattgggaacaagttctgcaagattttatatggtcagtacctcctggtgaactaaatgatgcggtatacctgagctatcaagatttgccttcttgtttgaagcagtgctttctgcactactccctcctcccaaaaaatgtagaattctacgatgtcacggtcattggcatgtggataagtgaaggatttcttcacggggacactgatgatttagaaaaattaggagaaaggtactatcaagagttaatttacagaaacctaatagagccagatgtagaatacgctgatcaatgtgttagcaccatgcatgatgtcattcgttcatttgctcaagatatctctagagatgaagcacttgtagtttcaacttcagatgaaagaggcaaaggtgcacttagatcacaaaagtttcttaggctgtctgtagaaaccaatgattttcaaccgaacgatgaacttgagtggaaactcatacaaggccagggatcacttagaacactaatagtgattggcgagctcaagattgaccatggggattcgttgattaattttacaagcctaaggactctgcacatagaagacacaaattgtagtgcatccttggttgaatccttgcaccaactcaagcacttgaggtatctgttcctagaatgcagcgacatagctagactactacagaacatcagcaaactcaaattattgcagtaccttgagattatatctgaaaatttggtcagacttcctaacagcattgtaaagctagggcagcttaggcatcttgaccttctaggcataagcataagtggcataccccgacagttctgtcgactgacaaatttgaggtatttgtatgggtttcctgtacaagcagatggtgactggtgtagtttacaagagctgggtcctcttgctaagctacggagacttgcactaagaaagctagagaatgtacccgttacctccttggctagagaggctaggcttggtgagaagttgcatcttcgctacttgagattagagtgtagcagtagacttggtgaagatgggttagtagaagatgagaaaggtgtctctgaggaagaacagcggcgaatcgaggaggtgttggatgagcttaccccacccttgtgcctagaaaatattgatatcacaggctattttggacagcggctaccaaggtggatgatgtcaggagcagcaggtgcatatatgaggttgttgattgtgacgatggatgacctggtctgctgcacccagctccctgacggcctctgccagctcccatgcctcaacttctttcaggtcacccgtgcccctgcaatcaagcatgttagccctaaatttgttactatgcagccatcatcgagccaattccgccatgcccatgcattcccaaagttgaaggagatgaggctgatcgacatggtggagtttgaggagtgggagtgggatcatcaactgaataatgtcccggccatgcctgaattggaggagcttatgctcgaaaactgcaagctgagatgccttcctcctggcctttcctcacaagcgacggctttgacaagcatgggtctatgtgacatcaaatatctcaactttgtagagagctttgcttctcttgtcaagcttgagctgcaagataaccctgacctagagagggtcacttcaatgcctaggttgcagaagctcatcatcataggctgcccgaagatgaggacattggagggtgtgcctgagctacggaagctagcgctggaggattgcgacatggaacaactcccgagatacctacagcaaggtgtgagtcctatgcatctggtgttggactgcagcttagagctgctcacatccatagcccttggagaatctggtcctgagtggggcaagttgagccatgtccagcatgtcaaggcctatgctgaccaaggagacgataaaaggaagtggcatgtgttatacacaagagaaccctacagtttcgagacaaatatcggtgacagcccttcttccaattctggaggtaaatcagcccagctgcttcttctgatttctgtccataatactcttttttccttatttttacccatgtttgttccatctttcaactgcatgatgcacctccctactgtttccatttcgcttaatggacagcttcagaggatgagtaggagacaaatacttcgacggctcaaggcacccaaggggtaactggcagccatccactgtcgaagacattgctaaagacagcagtcagtacatactataaattgttgcggtccactactgtcagcaaatctcctagtctaacattcattatttatataatgcctagtctaacattcataaggaaaactatgcagctctgtacatgagatgggactgtgagtttgtgatttgtatttttgatttgttaagcttacttatatagctacatattctactagctcctgcaatgcactgaaagaaacaaatatattactatttgagccaacattgtttgatttgaggactgcagtgacttaacacaatgttaattttgtacttagcttctcacctgaatacaacctggtctatattggctattatattgagagaaggttaggaaagacctaagaaggtaaccttattgcctatcaaaaacagctgcaattcaaacctgtgactagaacaaaacatatgacacccaaacatcagtagtgaattgaatcttagagattacgagtggtatgcaggttaacacaggggcgcatcaggtaccagttcttttccattgttactactgcgattaattcggcatgtctatagatacatcgagcacagaaagggccactgaatcaacacaccatgggcatgcaacacggactgccattcaataacagttcaagatgaagctccaacagaaaggtgggtttggaggcttactactagttgtaagccacctaaagattttcaccctattagttgctggttggattcaggagattttgtttgctatgtccttgatgacctcatccatgtcaagtttcttcatttctgtgaaaggtcgtggcatgttctgcacacaaattggagtgtgttcagtcacacataaatcatgatacagcctaattcctgggaaatacggtaataattatatagaatggtctcttggattcagtgttcaaactggaatgcaacacagttgattttaataagtacataggtgaattaatgtatcgtcactgaaaagaactgccaatgcaagttaaagaaaaccaaaggatagctagcttgcaaacaacagatggagaaagctaagaaaaatcccttatgattcaggtaccaagaagtagtaaacaaagattaccagcagcgatatgaacacttcaccaccttcctcacgaatctccaagcaaccacgtcgtggctgagaattaagaggaaaacaatgatgacaacaaaggaagccagtgagataccaaatagctagcttagggttgattgtcgcaaaaaaacaattacttggatttaacaccatgaagataccttttcagggttgattaccacggataccccaggaacagaactttccagatcctcctttaccttcgcagctctaatcttgaactgtctgcattgagtgctggagaatcgtacaaagaggcaaggataaaaggaaattcaataagaattgctaccaataattcatttaatgcaataggacttttttagatatgtcaagataaaggaatgatgtacaagttatctagaataattcagctaagcaaggagaacaatttgtccaatgtgaaaaaacaaactataagtctgttcaataacagatctattgcaccatatgggagtatggtcaatcatcattgttatatgtaaatactccacaaaagaaggtcgatttacatactgattaagtgattagagatacattaaggaattcttttcggtgataattcataaaaacaaaacgccagttattgcagttacagtaactacaactacttgaacgtacgaaatacagcagattgtgctgatgttagcattttatttaactcaagtatcaaggaaggaagcagagtatatgaccaatgaaaaggaaacctagatagcaaagcaatggatcgaacttcacagaaaatcacagaaaactataatccgcaagaagaagtaaaccactacagccagaatactataatctcca

SEQ ID NO: 22780 - DNA, 788 bp, Oryza sativa
gggggccatgagcctgtgactagcactcttgcagattcaaacaaggaaatgtcagttcgtctcatggaaaaacgaagggagatacaatcttcataccggggattgactaggctaaagatcatacaaacgatagctagatatcctccaaaaagtactcgagaccaatacagttgctactaatcagttgctaatgcacagttagatgcacgtccaagagagaagcagctcaaaataacagacgacgtggaaataatttaattcctcacagtatcataaaagttgacagagctttagtttcacctcagttgaagcaaatgcatactgatgcgacaaaactgcagctcacgacaacttatcaaagggtcatctgttaatgctgtgaataacacttatgcacacagaacaacttgtgcacaacgaataaccttttttttttaatcctgaaatcgccttcgcatccataaaactcttcacaacttgaaactacatcaaagatcattgctggaaggtctggccgcatagccgcatatccagaggacgttcccgatatccgacggatattcattctcgtttaaaaaaaatcatccatatttgcttccgtatcccatactatccgtccttcactatccgctttaaaaaatgcatccaaaaatcagaaacaatccaaacagtttacatgttggctgagaagcacaacagcaattgctagcaaacaatgcgcacatgcaaataataaacgtgggcagagaccaaataataggcgctgcaagcaccacaataattaaatt

SEQ ID NO: 22781 - DNA, 752 bp, Oryza sativa
  unsure (1)..(752): unsure at all n locations
cagctttcaaacggccacccgggccaacaactttcaaacggccacccgggccaacaactttcaaacggccacctgggcctagctgatcccatcagctgcagattttccaaacatcgatcccctttccacaacagcaatttcacaaacagtaggcaaacaaaactacgctaggaatcacctcacatccacccatgaccgtgggcacgactgttcgaacagtttgttaacctctgcagagggggtacactttacctacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagactatactgtgccaggaagcccaagggtcctccccgacaccaccccggcgaatccacatgtctctcggcatcaaggctcccctgataagctagttactcagccaggggtgtcccattccacccatgtggtcatacttgacttatgttcggatgaaattccaaggaatcggtccttaagtgcgagagcgggaaaccgtacacccggtacgttccccggtccgcggttttggaaattcatttagttcgcaagcaccgacccaggtgtcggtttccaagccttttgtaaacccaagttttacccaagatgtttttagattttaagttttgaggcgancgtcgatactcg

SEQ ID NO: 22782 - DNA, 175 bp, Oryza sativa
tcaatgtcatgcgtatcatcaacgagccgactgctgcagctattgcctatggtcttgataagaaggccaccagcgttggtgagaagaatgtcctcatctttgaccttggaggtggtacctttgatgtctccctccttccattgagaagggtatctttgaggtcaaggccacagct

SEQ ID NO: 22783 - DNA, 456 bp, Oryza sativa
agatgggatatttatggattggctagggaaaggcttccgtactgggcagtattggtgtcttgtgggaaaagcgtatagtctaacagaggtttaactgaactattcaaacagccgtgctcacggtcaagggtgaaaaaaaaggtggcactagaaaaaaatgaccaagcacagggagtcaatgcaggtgcttacccacagcgacggggcttatcagcagtgaaagaagctgccacaagattttgtcgacgagcaggaggaaaatggcatcgactggagctccaatgatgttggtgatgctagaaacgaaacgatgatgaagccggcttgatctcacagattggcagctcgtgctcgcgtcgatgatagtagcacttttgctggagcttcccgtggcaacagaagtcatcgtcaattgctttttgcgccggcgaagaatggtgacaaggaaactgtagt

SEQ ID NO: 22784 - DNA, 400 bp, Oryza sativa
atgttagtctaagcatcagggccattagcataatgatatcaaaacgctgtgagctgctcgttcggctatggcgtaagcctagtccgtaggcaggacttttcaagtctcgtaaggttttttcaatctggattcgcttcgaatagatattaacaagttgtttgggtgttcgaatttcaacaggtaagttaggtgctagaatccatggctcctttgccgacgctgagtagattttaggtgacgggtggtgacaatgagtacgtgtcgagcgctgattttttcggcctttagagcgagatttatacaatagaatttggcatgagattggattgcttttagtcagcctcttatagcctaaagtctttgagtgactagatgacatatcatgtaagttgctgatagg

SEQ ID NO: 22785 - DNA, 24373 bp, Oryza sativa
  unsure (1)..(24373): unsure at all n locations
cattagactcgggagaatagggaggcgtcctctcatgtatgatgccatgttcctctcaggtttgccagaagcatttcatagctgtcagccacagagtgaccctgatctgccctgccaggcgaggcgagcgatctgccaggcgaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagatataagcaagcaactaagcaacccaccacgttgatagcctagaacgacattgcagctctggaggtagcggaaaaatacatgtaaatgttggcagaaaatatgtgcaaaattgaagctgttcaacacaacaacagggcagtggatcggcccctgacaaaatgcaaaattccatggacagtgaacttactgttctgtcagtctgcaaagcataaacttatcttttcctttaatttccttgatgcataatcgatttttaaataaaattttccatggtgacatatagcaccatgatgtaaatttcaactcattttcaaatctaaatgctatagggtatcgcctgacgttctctcacttatgtgctctatttcaatccgatagtaacaggttttaccccaaatttcaaaattgaataattaattagactgcaggcattcgatttatctaaagagagtaacaaagaagctaggtgtccccaacaacagaccacccactgtggttttatgcatggtaggagaaggaaacacatcaccatatatgtatatggggcatagataatgatgataggcattaggcaacgaaagatgcagtcatgcagcctatcatgggagacagattttttttttttttggggggggggatgggagacagagttgagcattattgggacgaaacgatttttttttttgtgatatggtgcagatgaagttggtagggtgtgagtaatagtgaaatacttgaggaatagcgctctcaaaataaaaagacctaagggttttaataaacacatgttatcatgatctcacatgattattggagcattatcatccaagaaacgacatataatatattttatattatttactaactcgccattagtcactttttcttactacatagcacctactcgatcttttcttcgacaacctttctagaagctgtcaactttggaactgctctctcaactacaataggtatgattataccgatgtgattggcaatcagactgccgagtgctgattaatggccagatttttaattaggaaaaggatgtccacaaccaaataattgattgataagcgacatcaagttaagtagaaaagagaaatgaatttcaacctattaaggagtaactttcgacgactaaaaaaatctaagagtatgtttggataatgggaaagagaaatgaatttcaacctattaaggagtaactttaaatactagatatccattttctctcacattttcttatcctaatactttattcatttccacgtcccaatttcacctatgatttcttattatctaaaccaaaccataagagctttttcagctaattcttaggagggaattgaggaattattctcaaaattctcttgaatcccctgggaaataaattaacagggcaaaattggttatatagaattgaaagtaaggcctaatactgcaggtccgtaatcagtattgatgcggttttctaatagaaactgcactagctggcagtgctaaaattggttgatgacaggattacccaatttcggaaaccaaattcaaattgaaaattaaattttagaccagcagaaaacctagtatttgaaatttaaattataagtattaattctgccttccaaccggtaaatatcttcacagggtaaatttatcatttcttactaaagtatcaggagataccatagttttaagtgtaaaacttgaaatcttcacatactatatctctaaaggtatcaaaattcgtaatgtgaaattttagtatttgacttcttaagaattgtaaaatttctcaaaattaaaacaaaggacaaatttgtttagcacaagatcatgaataagaaaataaccatccaaacaagcttatcagttctgacaaatggatgcatggttactccatggcagggctacatccttctagcagttcaagcgtacaccacctcgctgcacccgccgccgtgcagcccggcggccacggcggcgagcgccaccaccacctgcgagccggtgcgcggcgcgaacctgagcctgctgctgctggggctgtacctgatcccgatcggcgacggcgcggcgagggcgtgcctgccggcgctgggcggggaccagttcgacctgggcgacccggacgagcagcggcaggagacgagcttctacaactggtacaccttcgccgtctccaccggcggcttcgtcggcctcgtcttcatcgtgtgggtgcagaacagcaaggggtggggcgtcggcttcgccgtctccgccgccttcgtcgcgctcggcttgctcgtctgggccgccgccttcccgctctaccggaaccagctgccgatggggagccccatcacaagagtattgcaggtgtgtatatgaaatcgaattatcgatggttgtgtttgatataacctcttttgagatttctgaatgttgcagtaattaaatgttttgtgtaatttgtattgaaggttgtgtgaagttatatttgtggatgtttagatgatacgagactgacaaacagggtccttgattaaggctacaaaattttgctaaaattgtataggcagagctaaatttcgtctaagattgcactgcaaattccccaatgttaatacaaacatgttgaagtcttctgtgtattccccccaaaaaatagattgcagtgtaaattgaagctatatttttgtaagtttagtttgtttcaaacaaaatatatgtgtaagttaagaagaacccataaataaaatagtttaaagcggatgacgaatagcaaaactgttcttttggtttaattctttttcgattggagctgtgtccatgacactataataaagctatgtatctcaggtttttgtagcggcattcaagaaaagaaacgtccggttgccggagaatcccagcgaattgaagcaaattaaccaagatgacgatgccaatgcccacgaagttctccccaaaacagatggatttcggtatgttgtccaaactctgaacattggcaagatttagactttgtctgtcggtaatgttggtgcagaggtgtataattatgatggtgcatcttctctcaccagattaagatttcgggttcaaatggtaaatgtatcttctatatcgacataatggcacaaagccagatgtctcaggatgaaaacatgatagacattcaattaaataaaatatggcaacccacttctataatattccatttacaaggcatgaaacagactttttgtgtcgatagcgttggattataagtaaattgcattctttctctcaacagttgaagtttataggttaaataagtttgtccattcaacttaataagtagcatcaagattttcattggcttgcaggtgcttggagaaagcggcagtggaaactggcaatgacgctgggccatggtctctgtgcagcgtgacccaggtggaggagaccaagatcgtgctgcgcatggcgcccatcttcgtggccgctgttctcagctacatcccggtgccgctgctcctcagcctcaccgtgcagcagggcaacaccatggacaccaggctcggcgcagtccacatctcgccggcgacgctgttcctcatcccgaccgtcttccagatggtcatcctcatcatctacgaccgcgccatcgtgccgccgctgcgcaggctcacgggctacgtcggtggagtcacccacctccagcggatcggcatcgggttcgtcgctactatcgttgccaccgcaatcgccgcggtggtggagacgaggaggaagatgaccgccgaggagagcgggctagaggacgccaccactgggatcccgctgtccgtgttctggctgacgccgcagttcttcctcattggcattgtcgacgtcacctccttcgtcgggctcctcgagttcttctgcagcgaggcgtccatggggatgaagtccatcggcagctccatcttctactgtatcctcggtgtatcagcatggctcggcagccttctcatccaggtcacgaaccgtgtcacccagcgaaccaacggcggagggtggctggatggggccaatttgaacaagggcaagctcgaccggttctatgtcgtcctctgcatcatcgaggtggtggcgctggtgatctacgtgttcttcgcgaggaggtatgtatataggaatgaccagagggttgtggcccaagagcagaggaagggtgacacggggaatggtatggctgtgatctaaacttgaaatgaaatgagtcgtgtttatatttacatggatgtaacgatatatatggtagtaatagtaaataatttggtggtacgaggagaaatggaggaacttcattgtgaaatttaataagacactatccaggagaaagaaaatcaatgtagatttccagagacggtggaaaaaaaaggaatgcagacgtgccgtgctaaagatagagcatggtgtgggtcgcacaaggaggtccaaaacggtttaccaaatctcttctttttattattaatatctttcttaaggtgatcggtttaactattcgttcattcgaacacgattgtttttatatgacaagaaaaattatcatgtcctgttttttgtgtttttgaatttgcctaatttcgaaaatttacattcggatttattcgtctcaaataggttaatgaaaagttcataaatcaaacaaagtttaaattgactaaataaatcaattatgccatccatttatttttttttatcgtttgttaattggagttatttggtttttatttgagatttggaagtagagctcaaattcatgaattctgccaaatcctacaaatcccaaatccagaaagtttcccaaaaaaaatcctatccttttcttttcttcctttatcttttcctatttcctctcttcctttgttttttttttcttttccttccggattcctcttgttgcctcctcctgatctcttctctctctctctctccatctgtcctttctcagggtgcatcagtcaaagtaacacagcccatgtcctcacaccacacatatactctatctgttccgaaaaaaaatgaatctaatactgaatatgaatatgacatagtctactacaataaatctgtaaaaagatatattcatattcatagcactaaaatgtgtcacatcctatactaagttgattttttatgggacggacggagtatgtgcaccagcctagcttgggccgataccaccctgcaaccaattttcagtcctccgcgcgtgcggcatcgtcataacttgaaccaccgcgctttcttcatctgtttttttgccacaaatcgccatgaagggaaggccatgaagtcccttccatctattctcactgatcccttcatattccccatcaatttttgccacaaacaacaaaaattaagtctccgtcaagagttgtagcttgtatccgtttttccaactcccagttacctctcaatctccctcctcctcctccctcagcaatgacagtctgttcgcacaactctgcttcagtgaaggccagatcgccacttctaatctactagctaatctctttcttgatctccaatgcaaaaattgaatcactttgatgagtttgatccgtttttcctatcactactgctcctccaactcctcgctgctcagctccctgtcctcccctatgaaaagcgtcagtagtactctcctcattctctcttttcactgaattacgaatctatgccgcgataaaagctgggacatccacaagctcaactccatttttaatggtcatgctgttaacaaaactagaaaggtagcccgcgcattcgcgcggatatgtgtcgtaggctatgttaatttgaacatatgctatatacaatttctccataaattgtttccatcagcattgcttttataattttctaacctagctattagttagctttatagcaaataatatttaattaatccctacaaataattatttataattaatcttcttcatcatctaaaaagaaggtagacttattttatgttagaaacatgtatatcaaataaagtgtcatgtcaaaagtaaggcgttttttaattgaatataggttatcattgtttatcgacgggtgaattggtctgatatgaggcttccctaaatgcacgtgtttatatagtctaatataattatatagtttaagagacaatccatatgcgaatgttatgtgtagagtatgtgggaggctccaggcaacctagagtgaatacagttggatgaagaaatatagttgcgctatatatatttttttgaatgtgatgcatcatgaatacacacttgttttttaagatgagatagatctaacggatgaaaataatgtgttcatcggtttaaaaggcctaggagtaagtgcggggtaatatatggcgcctttatataaaaaaaagcaatcatctaatcgacttaaataaagtttaggacactttggcagaagatcggttggcttgtttggattatttgagcatattaattgcaaaaagtatcatgaattaatcggattcttttatctaagtaaaagcaccaatttttagacaattagatttgagatagttatatttcttatatatgtatatctagtttaactctatttgaaaaaacaatgcacatacaatcagtgttttttgattttttttattcttttatggcaatttggatgattatccctatgaactgttttctatgtactcgcttgaaatattcgtgtttgggctattttttgcgaactgaatgtctaatttagtcatgtagggttgcaaaataatatatgatggtgcaacttatgttgttgagttatttcatagtttttaatggaaatttgaataaaatgtaaaaaggaagggatgttgtgcatcattaaaaaagattgatgtataattacgaaatatatgtcgataatgttttttatattccatcactatttggataacctgcaaagtgcacggtggaatgtgcccaaatgtcatatttttatataacaaaatataggcacatggatcttgaattgtgctttaattataaataaagcaacaattatattagaaacttatatgcgtagtttaaaattatggtattttcaatatttgtttatctctttattttagtagctgaaaatagagaggagattggagaggaacgaataacatagaactcgagctagagatgggttggcagtgtaatagtgttgtgcacatatggttggagagggaggtggaggggacattgtttttctaatgtttctaaataatgtaggtgagaatttgttgttttctcattctaaaaatctttaacagatgatatatatgtggtggattaagattttttttatagagaaagaagatctaatagttaaaaataatgggtcattgatttaagtgaaaaccgacagatagatgttttattttttcgttgaattatattttatctaacttttaaaatgtgatacattatgacttaatagcgttatagagcacgctaagttgatttttattatgtaaaacgattctaagactacgtaatatagaatttcagtttttttaatgttttattgttattgagtgaggagattttgatttttatagaggtagatttaatgagttcatcggttttaattatctatatgtgacaatccaattgttaaattacaggtcaccaatttaattgaaaattgttggtttaatatttcttctttataataacttttagaattaaaattgttagttaggaaatatgaaggtgagagaaaggattaattattggagacagaggaggtgtacgtacgtatgtgcgtggggtggtgagaagggtgggccagtggtgagaggagagttgggccgatggaagagaggagaggaatgtgggttgtagtttttgttattcaaaaaaataaaatccaatagttgaaaatagaggtccaccgatttactataataccacgtggtaatttaggagtgtttataggtatataacgtgatagtataggtgcctttgtaggttaatggacttttactatagatttttttaaatggtaattaaaaaaacatacaaagtgtagaagtctagtacctaaaaattattatttaccatggttgaatctatagttttttaaagacaccatcgatctaattttaatgggtccgcaaaattgttgattatttaggatgcttgttgtttagcgagtaaaagaaaatagtgcacacccgcatttgttgaagacctaatgctaattgcattaatccctagttgattacaggttagcctatttggataaccaaattaggctgagttctttacctcacaatcctaacttatctcttgttttccgtgttcacacttttcaaactatataataaacggtgtgcttttttttataaaaattttctatacgaaagttactttaaaatatcatattagtctatttttttaaaaaaactaatagttaattaatcatgcgctaatgcacacatcgttttatgtgccggagaggaggggttcccaacccctcttcccgaacacagcctaaagcaagcagcacgcatgttgaaagcctagctatttaatgttttgatttgtcggcacatcgttgtggagttatcgtattacttcgtaaaaattatgagcactacttaagtttatgtatgacagtatgaggttgttagctagtacattccagagagggccgggggaagtacctacactacacagagacagagaggagaaacgcacatgtgtgtatgtgcggcaggaggatacgtcgtgtgcttttgttttgtttggaaatatattcatttggtccaatatatccggagaagtagaggaagagagtacatatttaattaggtgggccggtgtggaacaggaaaatgaggagaatcgtggagtctcttttttttaaaggtaaattaaatctaatatattaaaaatagtgggtccaccggtttattagattgccacttgtcaatttaagagcgtttggaggaagccacgtggcggcttgagagcatttttagaaagtttaatggacttttagtatataaagatagatagattttgcaggttcaaatgattcagcaggtaacagaagataaactatgttggaaattcacaaacaatggtatctgcagtacaaagagtgcttataaggaggtttacaaaaaagaaaattcaaatgctcattaggttaactctcaatcactttctatcttgaaacaaatctggaagaacaggtacgtccctcccaaagttaaaacttttgcttggagactcaacatggacgccctttccttcttcccaaaggctaaatcagaggattcaaaacatttcagcagcctgctgctgatgttgtcaaatagaaacagatttccacctccttttttctttttatattagtaaattaacttggataatctcagaagcaaagctcaatactgatatttttccacctaatgttcctatggctcttcttattgcttacatcattaacaatggctcttccaattccaccttaattcgaactttgtgttataaaagttagtcgatatagcggaacgacgactaaccttcccgatcgcttcagtcattgatcacccaagatatgccagatgacgacacaggaacacacgatatttgttaatgaggttcagccgaaacctacatccccggggctctgattataggcgctcctccccaataaatatagctcctagccgctacgagaatatggccacgccgccatcatctccctgcgtgtctgcgctacattgtagtcgccatagttacattgtggtgctcccctctctatttaacagagatgctaggttgcagagtccgactctaactccagctcctaacacctattataactccaagtccaactgtaaccaaataggactagtatattcgacacatattctaacaaactccaccttggcgaatatacgccacccagaagtcgtagaatcaccatgctgatctacctgtcctccagacttgggttgttttcttttgcagcttcaccaggagccgctcgatgagtctgcgccagacacaccgctttcaagagactccgctatccctgtaatttcttccacttgattccacctgcaacagtactccaccttctctcatatcaccatagtcgtcttgccaagcgaattgaatttcttcctaactatcacataatagactccccgaataccatgttcacatccaccttccgtcttaaaatttgacttgatctaatccatggccagataaccgatgtcatcaccaaatagataaatcaaactcattagacacgaagagaaccctttcttccttgtcatcttatgaactgagctaacaaatccaacattcacgcttttcgtatccgtagactaaattcctaataatttgagaaaattcaccgttgtcttgaatcacccgaagaaattcctcttcagtgacgcagattttcatatattcccatcatgtcgatctgcatatcttggatatatcctgtactgctaaacagtatcgttgaccccatcaacgatatttgactcgctgttgcccgggattttcttcagttctagcctcactccatatatctcaacacctcatcgagtcctagatatatcatttcttcgccagatatgacgttcacctcaatccgactggctttgcccctaggtctaaccagccatttccggtccgaccgtacggccatcctcgtcggatcgaaaaccacacacttttcatgcacgaactcctaccaccgaactgcccgtcgacgtgcgagaccgcctgctgcctccgtgcaccctctttgctggtgatggtacttgtcagtcttcaacttgtgaaagtctcaaagatccttgctagacgagtcggacaggaaatcatccaacctatccaattttcttccgagtcagacccaatgttgatctccaatttccatcctactgcaacttggttccacggtgcaactcctgcgtctccgagtcgacctcttttacatgcaccagacctccatgtaccgccacctgccctttgcatgttgatgtttccaatcagagcaacacacaaagtgtgaatgcattgatttcacgtgacatccatgcccttttcacgagcccatgtacatgtatttgccacctgcatgcattaggcatctgtgcgttggtttctcgtgcatatatgtgcgcatagaacagcacccagtgccatccgaaaatgctttgcatctgccgtccgacggaacgaaaaatatcggacgcttccatcctaccgcgcagaaacagtcaacgctgaaacatatcggcatccatccatccagacttatccatccagctaataactcatctctcctctagccttctcgtattctcctttttctctctgcttcaactaccaacactgcgccatttttatcaaatgaaaatactatgagacggcaggaagatgagcgacggagtaagagtcggggcatggacgccaggggagtcgcgagaaaaggcgacgcgtcgccggcggccacacgcggcatcgccggccgggcatgccggcgcgtggttggaagaaggcgctggatctcgacgacagccactcgcagtggcagagcggcatggtaggggcataggctgacgtgggatagggtggaggcagtggacctcgccggcggcggcggcggcggcgacggcgacgtgggatggggaggaggtgttggatctgatgtggttggcccaggccctggccggagtccgcccacctcgcgctttcacctccctctgccgtgttggtggttgtggtggccggagtagaagaagatagaggtcggttaattttgtcacagttttttagcgaggttgcatcctattgttttttctgttgcactttattgcatcatggtgtttcattctattttgattcaatgttgcatgtattgattcttcgtgtttgccattggtatgtgtttgaatgttgtatttgccctcgtccgcgtctaacaccgtcaccttatttgtctctcccatgccggtcacttgtttccggtggccggaatagaagaagatagatgtatgtttttttttaggaatttttagtgatgttgcagcttatttattttttttgttgcactttattttactaaggtgtttcatttcgttttgacttgatgttgcatgaattgatttcttggtgttgcaattagtattgtttgaatattgtatttgattgaaacaattttgcttaagggttgaaatatttttatctgatagtgaaacatctgaaacattttcattgaaacaatttttaccgaggagtgaaacattcattcttcaataatacagtgcaacaccgtccgacgatttgctacagatcggacgtccgatccatagcaacctccagtgctatccgtccgtgcctccgcacgcaccatagtcgcagccctcgtgttcaccgtccacgacctcgtcgtcctagccctgcacgtctgctgggccgcgccacgctcgccggcttcgaccttgcgtcactggcatacctgccgccgcggatccgcgttcgctgcgtgcgtcgggtgcgccgtccatggcgctaccccttcgatctctccggtcgccttcggccacgcccggcctcgtcttccgttcacgttccgctatcgccggtctgatcgcgagcgacgtcgttgcccccacaacatcctcgttgtcgccaacgatctcatcgccacgactgacgatctcctgtcgatgcacgatcctcactcgtgtttcctcctctacatgtcttcttgatccaatgctgaaaccttccgctctgataccacttattataaaagctagtcgatatagcggaacgacgagtaaccttcccgatcacttcagtcattgatcaccgaagacacgccagatgacgacacaggaacacacgatatttgttaacgaggttcagccgaagcctacatccccggggctctaattatgggcgctcctccccaatcaatatagctcttagccgctacgagtctatggccacgccgtcatcatctccctgcgtatctacgagacattgtagtcgccatggttacattgtggtgcccccctctctatttaagagagttgtcaggttgcagagtccgactctaactccagcccctaacacctattataactctaagtccaactgtaaccaaataggactagtatattcgacacatattctaacactttggatatcatgtggcagctttggaaagctagaaatgatcttatgtttcagggaaatgtcaaggagccaactcaagtttgcatggaagcataagcaatgattaaaacttatacaaacttcctttcaaatgatttgatgcaggaggatctttatgaggaagatacaaacacaagaatagtgaatttgcctaatggaattagatgctaacactgcctggagtgataataaaacaggaattggcgttttctttcacacacctttcctctcataatgccatttttattagagctacaaccacaatggctcaatcacctttgctgggggagcttctagcatttgaactggcgatgtagactgccagattattggacttacagggagttcactttcttacagatagtgccatcatcgcgaaactttcaagaagaaaggcattggagcttaaggctaatttggagccaattggatcctaagggagctgaacaaattagctgataatgttagagtacatggtagttagagtcatattttgataagattgatttgtgtggacttcttccatatctgtactccttccttatctactccccatgtactcctaaatatactggccccctgagcctcaatacaattgatccacgttacacagtattcctatccgtatactacccaacatcttatcagagtgggcgacctagggccgccgctgatcgcttccgctgccatcgcccccgggagggttctgatctctcggggacggctaccgttttttttttctttcctattcgtcgagtcttcgtagcctgcatcctcaagtagtgcaatctccgggctgctgcgcggtgtgttcgtcgtcattcgagtcaagcatcagcagctagcaaaccatcggctaccttcacgcagatcggatgtggggtcgtcatcactggctgtacctccatgctgcatgccaccacgactacctccgttcgcccggtcggccctgttgttcctggcctgctgagcatcggcatcctcggcggcagagcatgggggctgctgcacaagcctccgcgtcagccaccgtcggccccggacgcgctgccccctgcgagcctgcgactcctgaggacgccgccactcgtcggtctctagcttctgccctctctacgctcgtacatggccctcatcgccggaactcctgactacccggcctctatgcgtggagcacttgccgtgatctgtcatcaagctgcccgctctaatctgtttgtctccctctgttatgatcttgcacatggctagcaagtgagcagatagagacaagatgggtgcagagtcattcagcatcttgaccgggttatgctactactgttacgtggcactggaggattctggataggaaacgtaatacccaagtcatgatccgttacatatttcatagatataagttatcccctataaccagtcagataaccataccgtgtgggtatggggtacccataatctccacagtagccctgagaccttcacagtcgaaaagataatcttctctcgaaccagattactccaaagccgtgtgcttcaatcatctttgccatggtctcccgagtacatttaccaaatcaaaagactatggagggctaaaaaataattaaatgtaaacttaggtacatcgactagattaacctaataggtgtagcccccgactatatggctagttgaacaaagcaagcatatagtcaaggaataaataatccaaccaactgagtggttttcgataattatagtcaaccaagtgacttgatattaatatatagcatatgcggtgtgaatccccgaataacatgatccgagtgatataccgactgctttgtaaaatatgatgcgagcaacctaaagttgtctacatctttgaaaatttacatagcaaaaaacaactataaaaaagcatgtattgggcacacaccatgcacacactgctttaacaaatgtgcttaagtccctaaaagacacatagtttcaccacacttagaaatatatggcatatgtggtgtaaaatccgagtaaataaactcataaaggatttaccaaccgcctggaaaacgaccaaaatatataatcagcctaagccataatattggtcaataagaatgcacacttacgtggcaaaaagcaacgatattgtatccaatcaattgctttataaatccaaacagcgtcctgacttataaaaaagtcagtaaggcagctatataaagctttactgtttggcaccttttaaaatgcattgtaccaactcctaaaaagttgagtaacagcggtataaaaggattttaaggtattgggtacttgatcacgcgcacttttgcctatgcaaaaactgcctaagtccctaaaagaacgtgacaggccacacttgaaaatatgggctgtagacatattaggcctaggcctaaaatatgtcaaccgataccctgaaaatatgacgtgtatagcacgcctatgaatatgctcccgagtgacaaatatcccgggtgatgtagatcaagtgtagctcatatgagcggcttctgatcagagtaattatccctcgctggttgtaccaaagtagatatgaaaatttggttccgactggcgcaaatactcagctgatggtcctcgtgggaaataataaatagtccagtcgttgagcataggaaataaggtcatggccataaatttctcttatgcatatctgtttggtattttccaagttatgaataggattgccatcatgattatcagacccaagtaggcgattgtcaatagaaccacagcattagtactcatgctggtccatctagtctgcttatgtaatccaagcactgacacgtgtcagctataatgcatgccaacatgcaagaacgatgctaggacttgatcaacttgtttttaattggttgcataaaacctcatatgcttgtaggaggatggctccttttgattggtcggccaggttgtcattgcatgcagaaaatgcttgactatcctgatgccaaggcagcacattacgtgcgatgtgagtaaattgagacagatgatgtgcagatgacagcatgggtgccaagtgaacactcagccgggccagtcgtaatcgcactccttgtatgaggtcggtcgggttttcaaccatataaaggacacattgagattgacccacaacagctcgtagttgatgaaatataagcagcattcatggtggtgtaggcgtgtaaatcctcatgtatgccaatgtcgaagattaatgctaaaggtgatgcagtcggcgtagacgcgaagccgatgaggcatggcaggatgttgatcatgatgatatcgttgatccagtcaatgatagcgatgaggtctcccattattagttgcgtagtaggccaaccgtgaagtcgaaagaacaagtcggcaatgaaagtcggtgatggcataagcaaccgaaggcgaagacgtagtcagcccttagcaacgacggagatgtcagggctgatgaagtagaggtgctagtgatgatgtcagtgacaataatccttcaaattgttgagaagatgtcgaagctcgaatagttttctggacgatagcgcgtgcataactgagattgatgcaacgcctcttgatttatgacaatagcagtagaacttgttgttatagccgttgcagatgctccacttggaggaaagtagatgctgttgttcaactcgtcgaaattgagctgattggttgataactttgaactaccggacatgtaaattaaatttcaaacttgatacttgagaaatttgaagtagaccgtggcgacgacggagaagcgaaaattgccggtgaaataattggagttgatgaagtagaaagcttgctcggaagcgaagacgaagataatgactcattggctggttaattgattgcttcatgttgacataacatctgtcgaattttgagtcttgtatttgtgtagcccccgactctttggttagttgagaaataactgaacatagagtcgagaactgtagcttgtcgtctagtagccattgcttgagtgaagatacgtgttgaagatatccgagtagaattcttgaaaattgcagaaccacttgttgtagtagaatagcacggtgtcgaatctggtggtgcatgccgagatgtcgaggcccttggagatgtcgtggttggtgaaatagcttgcgaagtagaggcaatagaatttgccggtgccgaagataatgaagatgaagtcgccccataatggtgataaagttgcacaaccatgatgacgtgaagataagtcggcagcaacagaagcaaaccggtagcgaagacgcgtagttgtgaagataaaaacaccagtcagtgatggaagaagtagaatgatgacgaaaacgaagacgtcctggatcgacggcaaaataggccagacgtgaaagtgaagacaccatgggcggcggcgaaggtaaaccgacgatgatgatgacgcgtagccgtggaggtgaacaagccagtcggggtcaaacaaggcggccagcaatgaagacgatgacatccatcagtagtggcagctgcataaaccagccatagaggtgaggggtcggggacggacgaggcggccggtcggtgaagacgtagatgcctaataacggtggtgtgaccaaccaaccgtgtaagcggaaacaccagtcagaggcgatgaggctgccggtcggtgaagaagtagacacccaataacagtggggtaaccatccaaccgtgtaggtggaaacaccagtcggcagtgacgaggtggccggtgatgaagacgtagacgcctaacaacggtggtgtgaccaaccaaccgtataggtgaaaacaccagtcggtggcagacaaggcgtccggtcggtggaagcgtagacgcccaacaacggcagcataataggtcagccgtgcaggcggagacaccagtcggcggaagcaaatgcaagctggcagtgaagacatagacacccaacaacggcggcataataggccagccgtgtaggcgggacaccagtcggcggcaatgaatgcaagccggcgatgaagacgtagacgcccaacaacagcggcataataggcagccgtgcaggcggagacaccactcggctgcggcgaaggcaagccggtggtgaaaacgtaaatgcctaacaacggcggtataataggctagccgtgcaggcagagacaccagtcggcgggggcgaaggcaagctggcggtgaagacgtagacgcctaacaacggtggtgtgaccaaccaaccatataggcgaagacaacagtcggcggcgacgacggcaagccggtggtgatgttctgactgatccattcctggagcataggagataagcataaagctatgaattccttttatgcatatctggatctggatcctgcagaacaaaacatataggatgagtagtatctgatgtaaatacagtacttgagaaaaattcaagtatttcaaaatgtttataaatatgtatttctgcttttgtcaattttatgtccccgagcggatgactccttacattcaaacactctgcccgactagtcatagcccctgcgcaccgggagtcgacctaggcacttcccaaacatgcatacgagtgacatgagttcgtcattaatggaacaaagtttcacggatcagagtatactactcgggtacttttgcaattgttaagagcagaaaataaattatcttatctctatgcttttgtttcttccgagtaatacttagcaccttgcgttactcggtccatccaacgagcccccgggtggtaggaatcggcccaaaggcatctatccatcgacaaaccaaacaaaaagcataggaagatagaactccataacttgataggcacttttgtactcagattatatcgcaagcaatcaagataaatattatgaaaattgttgaaaaaaatatgatataacatctgtagccccccgactcactagtcaacggcgaaccagttgatgtagtgaggcagagtaaaaggaaaatatcatataaagaataaaataaatgatgacttagcttttagtattcccgttgatgacagcagaggtagcggatgtaggaacaaagtcatccatcaatggcaataaaagcaccaaccgtgcaagcagctgaggctaccggcggtgtaggtaaataaatgcctatcaacggtggtgtgaccaaccaactgtgtaagcgaagacaccaattggcggtgacgaaggcaggccagtggtgaggtcgtagaagccccacaacggcggcataataggccaaccgtggaggcggagacaccagtcggcggcggcaaaggcaagccggtcgttgaagtcgtagacgcgtaccaacagcggcataataggccagccgtgtaggcgaaagcaccagtcgccgtcggcgaaggcaagcaggtcggtgaagtcatagacgtcctacaacggcggcataataggccagccgtgtaggtggagacaccagtcggcggcgacggaggcaggctagcggtgaagacgtagacgcccaacaacggcggcgtaataggccaaccgtgcaggcggaaacaccagttggcggcgaacgaggcggccggtcggtgaagacattatcgccatcattaacggcagcggcgcacactaaccgtggaggagtggacaccagtcggcggcggcgaaggcaagcaagtcggtgaagatgtggacgcccatgaacggtggtgtgaccaaccaacggtttaggtgaggacaccaatcggcggtgacggaggcaagccggcgatgaagtcgtagacgcccaacaacggcggcataataggccagccgtgtaggcggagacaccagtcggcggcggcgaaggcaagccggcagtgaagacgtggacgctcaagaacggtggtgtgaccaaccaaccgtataggcgaggacaccagtcggcggcgacggaggaagaccggcggtgaagtcgtagacgcccaacgacggcggcataataagccggccgtgtaggcagagacaccaatcggcggcggtgaaggtaaacccgtcggtgaaaacatggatgcccatgaacggtggggtgaccaaccaaccgtataggtgaggacaccagtcggcggtgacggaggcaagcccggcggtgaagtcgtagacgcccaacaatggcggcataataggcaaaccgtgaaggcggagacaccagtcggcggcggagaaggcatgccgatcggtgaagatgatgtcgccatcagtaacggcgtcgcaggccaaccatgaggaagggaccagttggcaccgcagcattacatgtaaatagcaaaaagtaccaagagattaatctgatatttagagatcaatccaataaacaacaataagttactaatggcgaagtcggaaattcaattgttgagctcgccgagattgatctccttatctggactgactcagagacggagaaaattggcaattggttttgtactgtgcacacataatcgagcaatctgcaactcggcatgcatacaggacaacacaacaaaccaatttggttagtgataacaagtatgtggaaagaagcgtgcatattttcatgtaaacgtgactatctctgaactggttggtcagatgggctctcatagagacgtggtggcgatagggaaaaacatgctgacacccgtatatgcaaccaaaaaatcagaaaaggtaaatatatgttagggaataatctaaacacaaacaaaaattgcgaggaagctaggaacggcagcacagccaaatcccatcgcccagcagcgaacatagatctctattgccatcttgtgcatgagaacaaccatcgctccagcatgcataaaagacaaacagcaaagtttgatcaatctgttagtaggaaaaaaaataaatgttccatatatggatcaatgatgcacagcaggtcgatcggatcaacacgtcgcatggttcctgacgtgggtgcggccagcccatgacccggtctctaagcaggacttggatcgtgaatgattcaaaaacttagccagctccgtccaggagtacatgcaaacaaccagcaaaatcattagtaaatcaaatgattagttccgatccatgcatacatatatactagatattggtctctgtgttgcatgatgcatgcgtgtgcatgtccctggatggccctcctgatgccgtcattggaagtagccggcagagctcatcaaacaccagttcatgcatgcaaacaaaaatcgaacaacagatcaatctagattacaaatccatctaataatactgtattgaaatggcaaactggtctatgtcaaagattgaagtcttcgaacttggtggggttgatctaggttgattccatcgcactttttgatgggtaattcgacgcacctctacctggcgcgccaacagtcgaaacatgaattcggcaataataaaagggggtagcgcatgagatctaaaagtggatggatgcggagacaaggatttagacaggttcagaccatctcaatgagaggtactgccctactcctgtttggggatttgaatccgccgggtgtagtattgatttgacgaccaggtgtgttcatgccccctatagggcttcctgcccaccttatataggatgggagtaggattaccagatagaaacattaaccaatacggtattggtttccaaaatctactttacaatattaccaaaccagaactttaggccgttccataatatacaaggaaacgtaatacccaagtcatgatccgttacatatctcatagatataagttatcccctataaccagtcagataaccatgccgtgtgggtatggggtacccataatctccacacatcagcagctagcaaaccatcggctacctccacgtagatcggatctggggtcgtcatcactggctgtacctccatgccgcatgccgcaacgaccacctccgttcgcctggtcagccctgtccttcctggcctgctgagcatcggtgtcctcggcggcggagcatgggggctgctgcacaagcctccgcgtcagccaccgtcggccccgaacgcgctgccccctgcgagcctgtgactcctgaggacgccgccactcatcggtctctagcttctgccctctctgtgctcgtacatggccctcatcgtcggaacttccgactacccggcctctatgcgtggagcacttgcgcgtgattgccgtgatctgtcatcaagctgcccgctctaatctgtttgtctccctctgttatgatcttgcacgtggctagcaagtgagcagatagagacaagatgggtgcagagtcattcaacatattgaccgggtcatgctactactattatgtggcactggaggattctggattgctactgctgctgctgcatgtatctgttttttttctgatcagagatcggtttgcgtcgcccactgcctcatcgacatctacgcgtctctgacatcggtattgactctgcttcgacttcatcattcagcccgcgcattttcggcttgatcacccgttcagctgcccagctaccatgacttcttgaaccgatcgttattgagcacgcatcgcccccttgggcttgagtgctgccgccccgggtccacatacactggttgttggaaagctaacagacaccctccttaagatggcctcactaccggtagagttctcccactgcatcgacattgagccgcaccatgtgtcgcccctctcgtcgtcttccttgccgntcgcacatcgacaacctcgttgtctgcactggtcatcttcagccgtcgggttcttctgcatctacttcgagcattgncgccgcgattccaagctgccactgtcgccgctctagactatggtccagctacctctacatggctaccgatatcgccgtccaagccattggtcccgctactccgccttcttcttcatccagcacgtctcatcgcaagcgtcgctgtatcttccttgactacacttcgctcttctccagcaactgcgtgctactccggcaattctcgtcccgtaggacttctttgctagtctcttctgacattggtgtatgattcatggtggacccctgcctcgcccgcgcggtattggcaacaccagcacacgcgttcgtcccgagttgtcccggggtctggcaaaccctgtgtcacgtctcgtccttcacggttcgactacattggctcttcggcgtcatctacctcaacgactgccaggatcgcgtcactgtcatcgtctccagcgcgtcctcgcttaccttggtccacgacaccctcccgtgcgtccacgaccactctacggcgccccatgcgcgccctacggctcggctacctcaacatcagcttcccgacttcggctatatcgaccacggctactctacgcacggcttcattgaccatggctccctcgcaccctttgctttggctacatcgactacgacacagagggctatcatcgtgttgagtactcttgaaggttttttctccagtccaagtgtccacgctgctcacgcttggactgtgggaggatgttagagtatatggtagttagagtcatattatggtaggattgatttgtgtgggttccttccatatctgtaatccttccttatctcctccccatgtactcttatatatatcggctccctgaggttcaatacaattggtccagttacacagtattcctctacctatactatccaacagataagttagcaaaagaagccaaatctcacataatgcctagggctg

SEQ ID NO: 22786 - DNA, 386 bp, Oryza sativa
  unsure (1)..(386): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnccactgatgcttcagaatcagcttttagtgctgggggacgtgttcttgatctatttcgtactaaacttaaacccaaaatggtagaagcactagtttgtaccaaggattggattgctggatgtagaagaggtgatcaattgtgtcatttctcatttatatttttgtaaaaggcattcttggttttttattaatagtctaatatagctttcttctaaattttttagatcctaataaaatgggagttggttctattcttaatgatcttgaggttgcggagaccttggttgctagtatgaca

SEQ ID NO: 22787 - DNA, 1498 bp, Oryza sativa
  unsure (1)..(1498): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactgatgcttcagaatcagcttttagtgctgggggacgtgttcttgatctatttcgtactaaacttaaacccaaaatggtagaagcactagtttgtaccaaggattggattgctggatgtagaagaggtgatcaattgtgtcatttctcatttatatttttgtaaaaggcattcttggttttttattaatagtctaatatagctttcttctaaattttttagatcctaataaaatgggagttggttctattcttaatgatcttgaggttgcggagaccttggttgctagtatgacacttgacgagattgatgatatggtatgacattttattgcatatatttggttgcatacattttgtagtcctattgtcaaaagaattgtatattgattgctcataattataggaaaagcaacagagcagtgatgatggagaatgagaattgagaagttatcaagtgaagtgtgaagggcatgttggtgtgtggctgtgtgcagtgctcactgctgtgtgttttgtgctgtacgcctgtactactactgctgcatgccagtatgcagtatgctgcgtgtagcactgcagcgtgctctactgctctatgcttgctgtatgcctgtatggcttgtctcatgccgatgacttttatttttatattttaagcaacgcagtgaccagtgaactattaaactgaacacttatattatatttttatggatcatggatgtaccttggattattttaactagtgaactattcaactgaacacttatagttatactattactattgaactgaacgcaatgaactaataatgttttgctatcgtattggggctaattgtactgccgccctcttattgtatggattgaatacaaacttgacatccgacaactttttgtctgtttctgaaccgagtccgcaccgactccacaccgaatccgacgtccgaaataatccgctccgcatccgcatccgcacgtcatccgcacccgctccgcatccgcttataaaaatatggtttaggatatggtatagctattatccgtctaaatccacttcgttttcacccctaagtgctagtgggtggtggaggctcatgccatcgtcatcctgtggcaccaactccagatctacgcccgccggtgtctcccacctcctcaaatctcacgtagtctgccgccacaagcatcattgctacctgtgagctcgaaagttgccatgagcacagacctggtccaagcttccacgccacctccgttggctcctctaaagcatatttttacaaaaaaaaaataatgttttaacacgagcatcacagaattgtctggtttccaaaatatcgagtaaaaaagaaaggaagg

SEQ ID NO: 22788 - DNA, 829 bp, Oryza sativa
aggttgcgccggggcgtggccggctgaaggtaggggacgacctgataggtgggccccacctcttagtgttccaaagggaggaggagggggcatgggccggcccaacgaagaggaggccgagcgcggtaggcgaatgggccgacgacccaagaagaaaaagaaggaaaagaaaaggaagaaaaaggaaaaagactttccccgggattaaatattgcacttgctcatttttatttggttaaaattatttatagggctctgaaaattccacaaaaaatcttgttaatgcattagggcatggggaactcaagaaaaattccaccacgccatttccgattattaattgcatttattaattagggattagctctaggttaatttaaacaatttcttgaggcaatttatttaacaatttttcaagaaagaagaaggggaaaacttcagggcgtgacagcggctgtgcgtgaggacgcgcgggggatggctcgacacggctcggctcggcacaaagccggccggccggccatggcagggtggccgcggcgcgcggccatcggcaacgaccggcggcgcgggagaagaaaggagggggagggggttctcaccgcgggttggccggcgtgggaggaagacgacggcgaacgacggcggctagcggtgaacggcggggtgcgcgggatggacgaggcggtcctcgacctcgcgaggccgatggtggcgacggagtggcgtggcggtgggactagcggcggatggaggcggtagtaggcgacggcatgtggggagagcggtacggtgatggcgcacggcaagcgtgcggccgccgagataa

SEQ ID NO: 22789 - DNA, 9622 bp, Oryza sativa
agctggtcctgacacgacgatttgcttcgagcttctgccgcgcggcgccgtcaccgcgcggtccgagggccccgtgccaccgcatgcagaggccatcgcctcctcctcctcctccttgagccactggaggtcggcgtgcacggcggctcgcagggcagcggggcatccactgcggcgggccgccaccaccacgacggcatgcgccatccccgcagcgccgacgaaagaggaaggagatggagaggggaagacgagggatggaggggaatgggagggagatcgaaggggaacacgtggacgcctccggtcgcgcgccgccgtgcatgccgaccgtcggcgcacccccacgcggcgccgcacaccgcccactgtccccgtgccatcctgtgcgcttgcgctcgagataaagaaagagagagatagaggcagtatgaagaggaggagagaagaagagtggttgggctgacaagtgggtcccatgtcttttttatttgttttggctgactagactgccacgtatgcgtccacgtaggaccaaaaccgccctggatcgacttaggggggtaattcgtccggtttataaagtttagggttaaaaataactggtattggagtttaacggggtaaatcggacgaccgcaattgttcaggggtaattcatactttttcctatttattattaatttggtggtcatgttattgtcagccgccatattatttttacagctctattgtgtttgacccacattatagctcagcaattagattaaaaaaccatccaagtgtgttaacaaatttgaaaaacaacaccaaggtatttcatgggcctcacatgttatttaattttttttgacttggatgtcacgtcagtgaaaacaaccatatgtaaacatgagttgatggttttgctatgatggggatgaagatttttggtattgcaatttaggtgagggacgtggagtggacttattcctattatatacaaaagcttaataagggctgctggggtcattttctccacatcaggtttgctcgagtagagcatttcgctgccaccaccggtgccggctgctccttcaatgcccaccgctgccagtgaactcgaggtatgtggttcgagtgtccattgtagaatgctagtatgtggtgcggccgtgtggtccctcttctttgctggttacgatgtgagatcgctttgggctcttggtgtctggttgttgcacaccgtgtttgtagttatgcttcaatggaccaacagaggaactttcgctgtttctgtgaaatgatgtttctcagctcagaataatgtatgtttgccatgttagtaatactgtgggtcccagcatcacgtagtagtaacttttgatacactccacagtgtttaatacctactatggtaaatcaggtagatgcgccacaaacaaaaatcattgataccaagcatcaacagtgcacaaataatatattttacttgcttgttgccggtagtaagtatactatctggtagcttttactacgtaccacaatgtataactgctgggtacgaaagaatagtgtttattaccagcttttccactacatcgtggatgtgttaacaccaaaatttgataagattctttagcggattcggttaaggaatgagcgcaatcagctgatgaaaacttattgttggtatttcttaacgacattactagaaatataattcccagcaatggcgcataaatcttctgctttattatggttatagagttcatctgcaagcacacggatataccattgtagcatttcacccgagagaattccaagggtatcgtatttattttatcctgtgggaagatcatgtagagagaactcgactaataatttatatattacttgtgataatcatattctaagcaggggatgagataatctaaggatagagtgacacacaagcattaactactcattctcataatatattatctaagctaagtggatagaaaagagaaaaataatctaatcctatacttctaatatacatagtatacatacattctagttaactgatatactagccaataccctctatccgatgccctcctggtacttcgagaagccacccctgactaccgagttccttacgacagcccgtcatgatcatacaaccggggctaaatacggaggaatacactccccagggaattaacttaggattatataccggcggcgcggaggaatacccgtactgagctatcaccatcagcagcccacctctcatccgtaatatataaccccaaataatgatatcccctaatctagacaccacgtctaaactaccagatattactctaatatcatcgtcatgacatagagtaattacataagcaaacattatacccgcaccaaagcatctcccagataagctagccgtatattcagtataacatgaacataataatgtaatgtaggtacttatatactcggaaagtatttcaataccataaatgtatttagaagagtattctaataaaagtacaaagcttacaaaagagaagagaaaagctactagagccatacccgaactcttccgaagacttttggactcctgatttctactctattcctattccaccagctagatactactaatctaaatttgagagaaatgagagagctattgcttgaggtgtgtgagtgaagtgagaaggtgaagtccttttataggcaggtatgacggttgtaaccgttgtgaaatatctgaagtacaccgcaacagctatcaggacaatatatggaccgtccctgccaaaccccacatccaacggtggagagggaggatcggccgaacctcctggttcggtcgaaccaggggccggcccaacctggcacaaaatcagcaggtggcctcctccgttgcttcacttcatagacttgcaaattttggcccaattcatcatgtcaattctgagttcttggcctattcacacataagtctgattctcgacatcgtccgattgatttatcatttgagttgatgttgattctcctccactttgtggttattctctgcaaaaggttagtatacctaataccagtggaatattattattctaacatatttatggattacaagcatcactagttctcctctattttggtaatattgatggtcgaaactgatcgataacgaccgtcaacacttatccagaagagaccaagttcgaggaggaatcgtgaagaccacggaatgatagtttaattccatctattaattaggcaagatatagtaattttccttttatgtttagaaaatatttatcgagtgtctgatcagcacttgtaattttccttttatcattagaaaagtgtgtttaatgtccgatcgggactcttaacggcctatgggtataaatatgtgtacccggggtcattgtaatctatctccaaagatcaacacaatctactttcggcatatcgccacccttttattttcgatgagttcttgtttcaagttgggctgcatcaacttcgatctccgatgagggataaggcttgttatggcggcttgcattgtcgggattagtgcttcaattgcttgaacactctaattttatccatgtaagacgtcgagttattatatacattattgttggaggcatgtcacgagggccttcgaccggacctgccgaaaccatccaaccgacgaggaaacaagccaggggcgtcgggttcgaccaaggcaaaggcatatggcgaaagccatgtggtgaagcatgtgggcgaagaccaaagccccgtatccaaacttcgcaatcgagaggatcacatgggcgaaaggcacatggcgaaggttatgtggcgaagcacgacggcttcgcccaagctggaatctatgcaaaggaggaggactagatggctgctaggcccatggggccccgttcgccatgactaggccagcctaattggcacattagagcccataagtgtaatagacactgtgtgcccttactaatatccctataataagggtatccatgtaaattcccctgtacaatctaaaccatagaaggtgtaagcctgtactaaggctataaatagccccctagggcaatgtaacgggggatcccaaatttttttttcaagtcaatatattgttttactgttcaaaacatccaaccaatttccttgttcttcgacgtgacgcagttgtcattcgacaacaattatatataatctagattgatagcgttttcttcttgcatcgaccgatctccatttagggttttgtcgatattggctagattactttttttggcttagattatataatgtttgcaccaccctgaaaattagtcaaaggcttgattgtccagatattatatttcttttcatacttagtgttgcatcagttaagattgatctactaagtcgtgcttagaaccataatctctagcttgcttcttaattgccaataagggttttatcgggtttcagccgatgagttatctggacgttgtatcggcttatatggattacatccaagttggattgagccgattgcagcaaaggtttcattgattatctaattgtttggatttaatgacatcggacctccagccaatgtatgttttaaccttcggattagatcagtgcttattccatcatatcgttattagccgattggtttatactggtttacattgttctgttgttacattatcattagccaactgtttctatatcatcatttactcaagcattagaatatacattggatatatagccaattatttcaaaaccctatcgacatcggctttttgatttgcaatctatataacttgtcagttgcaggatcaaattgactggcacgcccgcatctcatcaatattttggacctgcactggagctaagcagatctcctaggccgttgcgttcgtcgacttaattcgagccaacatagatctggcaccatcggccaagcgtgaatttttcgtcaacaggattcccatcattttgcatacttttggtgtaacgtcccgcctctcccaggctaggcctgcttgcatctgatagctttcataggtcataaactgccctcacagaccaacacaagtcttttctgcacactttgtcctcactcgtgtgcacccgggaagaatttcccggtcggtcacccataggtcatagactgccctcacagaccaacacaagtcttttctacacactttatcctcgctcgtgtgcacttggaaaatttcttttctgcacactttgtcctcactcgtgtgcacccgggaagaatttcccggtcggttacccatcccaaattgctccaggagccaacatagatcctctcccaggccgggcccgcttacatctgatagctttcataggtcatagactgccctcacagaccaacacaagtcttttctgcacactttgtcctcactcgtgtgcacacgggaagaatttctctaggccaagcacgcttaaccctagagttctttggaaatcgacttccggaaaagaagttgcaacttgttgatatgagtattctattaatcctattaagccttgggctgggatgttacatcctcacccccttaagagagatcgacttacaaattgttgatatgagtattctattaatcctattaagccctgggctgggatgttacatcctcagccccttaagagagattgacgcccccgtcgacgacgggggggatgggatgttacatcctcacccccttaagagagatcgacgccccggtcgatcaacccgatgggggggctgggatgttacatcctcacccccttaagagagatcgacgcccccatcgatcatcgacgcccccgtcgatcaaccccggccaggaacgttctcttggccacgtccgtgtgtccagtgccaacgtatgtatcatgctgtctgaccactccgggtccacaccagccatgcgcaccatgcccactttgtcctcactcgtgtgcacccgggaagaatttggcaccatgcccactttgtcctcactcgtgtgcacccgggaagtgaagttctttataaattggcttccggaaaagaaattgcaacttgttgatatgagtattttattaattctattaagccgtaggctgggatgttacatttggtttccaactaccagtgtaagttgagaaataattagcgatattggcttattagatatttctctgtcgctgacagtacaagtgtacagcagcaactgaacaaagaattactacatgtaaggtaacatttgacagatctttgctttgttccaagtctaatttttataagtgatatgttattgtacaaccctcgggtgtgtccaatttttgttttttacgtaatggtgttatcaacacaccgttgacagcccttaaatatcattgggaattttttatgtctactactcggattgcagtggtgcacatggatggcttgcgtggttctagccgtcagaggctgtccttggtctcatcagcctcagccaatcagtcatcaatttgctttatgagcccttaatgctcctgctttactcacctgcatcttttgtatttttgtgtttcaattctggtataactctcatttcctaacaacttcatctcttggaaatctgacctgtgcgcacatttccaatttatttttttacccaacagaattttagttgagttaaaatggtctcttacgtaccataagcattgcccagtgatgatggttaattgccaatgcaatcaagatcattagtgcattgcattcaaattacaaacttgaagtcgttccaaaatccatgtagtcttattgaaacatatgacttacttcagctcctggatcttaaaactgttggaattaatgaatggggcttagcccactccgaaaataattcttttgaaaattaccaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctgggcagggcaggcggcgcgcgtgcacgacgtacgcgtcgaatggtccgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacattccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaggttgaaaatcaacttgacagaaagataaaaaggcttaggtctgatcgtggtggagagtttttctcgaacgagtttgacttattctgtgaggaacatggcatcatacatgagaggacgcctccctattct

SEQ ID NO: 22790 - DNA, 3533 bp, Oryza sativa
ctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaaatacaaggctcggcttgttgctaagggctatactcagaaagaaggcgaagatttctttgacacttactcacctgttgctagattgaccacaattcgtgtgctactttctctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaacattgaggtgataaatgaggttaaatcattcttgtctcaaaattttgatatgaaagatttgggagtagctgatgttatcttaaacattaagctaattagaggtgagaatgggattacactcttgcagtctcattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaataattctaaggataatatgaaatcgtctagacatgtgaaaagacgattgaagtctgtcaggaaattaagaaactccggagttacaacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattagtaaactagaggagagtaccaatatatataccctctccaagtgaagatgcatatactctcgtgagctgcaaggcaggttggctatgcctcaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctattactagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgcgctcgctcgcctggcctggcctggcctggcctgggcagggcagggcaggcggcgcgcgtgcacgacgtacgcgtcgaatggtctcgaatcgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaagtctacggaacctctgcctttgacgttctgcaccgggagaaggcggcaataaggtttttgggaagcgcttcgcgcgactgctccctgttcgttcgcgacggctcgccttcctcttcgctcgcgtgtttcgtgccttcgtagaca

SEQ ID NO: 22791 - DNA, 1990 bp, Oryza sativa
  unsure (1)..(1990): unsure at all n locations
gtagacacctgcgaaaagtttcgaccaagcagccggtcttttggtcacctcggtacgtgttcaatatgttgcgcatatttgatctgttcatgttatactgtgtagtttacatgtgtagatctaatgatgcgttcatgctactttcatctgtaatgtcatgatttatttatggaatagattaaatcattatatgtctataatctcaacaatatcatgcatggtcatatcgatccaaatagtttttgaagagatattccaacttagtggctggtattttttgttttcgtaaaggatgaaagtgacaaccctgctgtctgcactacatacgaatcaaactgaaagttgacgcctgacaagcaactccagatccgacaactcccatttcccataaggccacacttttcttttcagcgagccactattatgacacacacaaaaagtaaaagaacatgtaaaactagtactacacacgcagtcaataaattgaatatccattgttagctctcagtaatttgctgcttaaaatattgtgaaccagaactgatactaagcatcatttaccgggttggcgacgatagtaatgccggtttggacttaggaactgaaagtgatatcaatttgttcggtagtgtaattcttttatggacaagacggtaggcatgaaaaactagggcaatgtttagcaaatggggaagggaaatgatttcccacccatctttaaatcctaaccattcattccctctcttccatttaatcctaacctttcattcatttcccaatcccaatcccaccccccatttcccattatccaaacacatcctagtagtgtcaaattgtgctagaggacaaccatattggatatattttattggagtttaaaaatctcttgcttcttcattagtatcacaatcatccaacacatctattagtttttctacttgaaatactagtaaaagtctaactacaacaatattatattattttttacaacttgtccattaatatatttaaaactaatatttagattatattctgttttgcaagaattatatatttatggcacacagccacatcttttcgcttatgcttatacttatcagccaaaatttgaatttgcatccttaaattttcatctaagtttatttttgagcttttgcttttagatcgctaagaacacgtataaaagttttacgtaaaaaatatttttcttttgcaaatatggtgtgtttgcctattcgccgaaataatgaaacgatgagctggaaaagtgcttaaactattgtaattatgtattatattaacataataaaaaattaatggtgatcaaactaaaaccgcatcttaaattaaaaatggacatactatgatctcgataggcgcgaagagaaggacggtgtagaagcgcttaaggtaggagtcggcgagaaaggcggccggaatggagaacatctgcagcgcggcgaagtagttgctcgccgtcgtcgacgcctgcgccacgcccatgtgcatggtgccccgcaggtagctcaccatgttcatcatgttggcgatgttgggcgcgttggtcaacagcaccatcgctattcagattcatgaaaggggtacgcatgcaatgcatatatctcgttgtcagttaattaagttgaaaaaaaaactgagctttcttgacagtatatacttgcatgcgttgtactgttttaattttgagcactgaaattttctttcagcaccgtgtaattaaaattcgagatgatgcatgacggatagaattgaaacttgggggagtttgtatttaatttgctgttgtaagcaagaaaaggttttggttgcttcgatagagaacatagatattccaagattgatggacccagcaagcaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22792 - DNA, 6663 bp, Oryza sativa
ctgtttgaatagttcagttaaacctctgttagactatacgcttttcccacaagacaccaatactgcccagtacggaagcctttccctagccaatccataaatatcccatctcccacagttgggtggaatctctccaccaagcatcacgccaggcacaggtcctcatctacccgagccccaccgtatggactccaacacattcccactgcaggtgattgccatatactccaccatacctttggacacctacgttttagctagttactcatccaggggattcccagtacgtctgtgtggtcgtattgtgatgaaggatgtaggtcccgatcttctgataggtattgataaacaatcgatttgggcggagtcgcgacacaactcgatacggcttctgaacgaacatgctactgagccccgcaatcgcagcacctagtctcgtctagttatcaaccgtgccaaaacccggttgacctcgccaagaaggctaatccctgcatgcaaattgaagaacacatgcaagaacaagatagattgcaaccaaattgcatttggatgattaagcactcaaatttggggttccacaaaccgatctagcggcgaaactgttcttgacagaataatctaagcaaaaccgaactctaaacgatgacggctactgaattaatatgattagggacgtcctagggttgccctagggcgcacatcccattgggctaagcccacgacacaattacaaggcccaaaacccgagtcagattcggactggatgagatacatggcttgttttgcagattcccggcagctcgataggaattttgacgtgggaccaaaaccatatgaaagtagactccataagctttccaaaaagtactcatgggccccgaaattctttctagatcagcggctaggtccgtttgaagttgatgctgtcaggaggcccgaatccgaatccaaaacgtatagaactttatctcttgtcttctatggaccaaaagtgacatgatgagatggaaatggacatggagaaggtcttgatatggtccccaatcaacttctttgatcatccatgaattcgttacgctcggtctcttttccttcaccctagcaagtacctctgcaaacaaaaacacaggaaactcattgtgtagcaacgtttgttcaaatatataacatgtaaatctaatgtagaacatatgcacctttggttgattaatacataaggtagtcatggttatatccgagctagttgtgtcctcatcatcctctccttcttgattggaaaccgtcctcggtttcaccttgtcatagagcgtattgaacttatatttatgtatcacaacatccggtgagaaacatttcttgatggccatgtagttggatcctgaaatctttgtagtcgaaaaaccacaacactccccttcttgcaaaccaacctgtaactcatttaaacaactagaggaactagatagataattacttaaatgcatggggtcctctagataatacatttcatcatgaaaaggaggtatagtcaaattcaaacaaatatatactcgatacacattatattcttctttactatcataattgccaataatatgaaaaatcacatcagaagggcatggcaattcaaatctagcaaataatttcttctctaaatagttgagtggacaaagatcatcaaattgaatatgaccccaagtatttaaagaagatagcaatttaagctcttcattctcgctagcaatgtgaataacatgttgaaactcaacacatagtggttctagtatagaattaacatgttcattcactagttatggcatggatataagtgaaacatcgcacaactcttctttatcactagaaacatcaagcaaattgttttgtgacaaaggtatttcaacaattgttttcactatgggttgctctaacgtagcataagtagtggacatagttggcacatcataaatatggataccttgaatagctatagcaccattatcattaccttctttctcatcttcctcttcgtctttcttctcttcctcattaccttggttgttctcaaatgcctgcaaaatattagtatccaaagcaataggcacaacaatacgttcattttgtaataactcagactatgttgaaggcatcgtaatattagtatctttcctggtatctctgaaaatctcaacgattctatttttcgtcctttcaatactatctttgaaaatttcctcgattccattcttcatcctttcaagattatcttcgaaaatttcagtaaaactcatgggtaccaattttattttctgaccattatgtctaaatgtgtatgtattagcaacaaaattatgcgatccattattatcatatacccatggttgaccaaacaacaaagaacatgcttgcatagggacaagatcaaaattggcagtatcatggtaatttccaatcgaaaagtttagcttcacaattctatttactttgaacttaccacaagagttgaaccattccatgtaatatggatgaggatgcggttgtgtaggcaactcaagtttctcaaccaaatctgaactcaccaagttattgcaactctcactatcgattatagtacgacatgctctatctttaaccacaaactttgttttaaataattcgtgatactgccattgctctgctttctccatttgagaacttagcacttgttgcaccaaagtactgtcatcacgtgcaccttgttggtatcgctgatttcgagcgccactcatacctgtcattgcaaacataaaaataacaacaaacaatgaaggttatccctaataatctactacgcgatgtagtggtgcccctcaacaactcagccaaatgaagcaccttaccaagctcttacaagtgtcttaccagcaatgctaaggacggtacaactggtggcgggttcatgacaccttgaaggacgtgatgtggcgattgcaaggatcaaagcggtgctgaccagaagtatatatgtgtagcttgggaggcacaatatatagtagcaaagagacgcaattgtgctaatgagaaaatgaaaagttgaataatagttcaaagtactagtcaatgtgctggcctagcctagactcaactctagctcaagcaagcaactgacaacactaaggactatatatgaatcaatgcacaactctgcactctgaaaacatactcaaaggatgaatgattttttttatttcttggtgcggctttttttaagcacctttctgtcttttttttcttttttttgtgcggctttttctttctttttctttgcacctttctaccttttcttttttattatttttttactattttttttcaacaagaactgaccacttaccttgaacagggactcaaatgcaaagtgcaaaactaaaattagatcacctcaaaaatggaatgctcacatcacgtacgttccgtttttataaaaatatctcaaatccactaaaggaattttctttttcttttccactaaggtgtctcggcagggcttctgatgtggagatattacttgatttctcgcagtagcaacagtgtgggactcgatcttgaggtggacccggaaaaggactcaggtcggtctattacatggaaaccgatctgttactatttttttttcttcacggcaacatcaaaggccgacactcaaaccctaaatgcgactttgtgcaacttcgcaactgaccaacgaaaatttgtgaaaactataaaaacggaaactctgtgatgagtagaatcgatttttcaaggtcccggcaacaaccgtcaagatgcaaaactagatccaaaactgacgtacaactcacaacttgatataccctagacccaaagtaatgaacatatgcaatactcaaaactaaaaaattaaatctaaaactaaaccaacacttgacacgacgatgcaatttagaattcaacaaagcaaaatctaatagaacaatgcaactgctcaaattgtctaggtaaagaataaacatttttgtgtggcaattttctagtcatgggaagaaaactacctaacgggcaaccacgctctgataccaactaatgagggatgtagtcccgaacttccgataggtattgataaacggtcgatttgggcggagttgcgacacaactcgatccggcttctggacgaacacgctactgcgccccgcaatcgcagcaccacgtctcctctagttatcaaccgtgccgaaacccggttaacctcgccgagaaggctaatccctgcatgcgaatcgaagaacacaagcaagaacaagatatattgcaaccaaattgcatatgaatgattaagcactcgaatttggggttccacaaaccgatctagcggcgaaactgttcttgacagaataatctaagcaaaaccgaactctaaacgatgacggctactgaattagtatgattagggacgtcctagggttgccctagggtgcacacccccttgggctaagctcacgacacaattttaaggcccaaaacccgagtcagattcggactggatgagatacgtgtcttgttttgcagattcccggcagctcggtaggaattttgacgtgggaccaaaaccatatgaaagtagactccataagctttccaacaagtaatcatgggccccgaaattccttctagatctgcggttaggtccgtttgaaattgatgctgtcaggaggcccgaatccgaatctaaaatgtgtagaactttatctcttgtcttctatgcactaaaagtgatgtgatgaaatgaaagtggacttggagaaggtcttgatatggtccccaatcaacttctttgatcatccatgaattcgttacgctcagtctgttttccttcgcccaagcaagtacctctgcaaataaaaacacagaaaactcattgtgtagcaacgtttgttcaaatacataacatgtaaatctaatgtagaatatatgcaccattggttgattaatacataagatagtcatggttatatccgagctagttgtgtcctcatcatattgtaccatgcccggatgtaaaacacaaaagaatcagcccttgtgcatagctacgaaaccaaaccacacaggagaggattcgcaccacaagttttatccataagactttttattttcaaaagcaccgagtcaggttttagaaacctttcacaacccaagtttttccaacttgataatcaagcataatcatgtgttaaatggagacacttgcgtcggggtactgctatggtggagtgacaaggtcaagtttgataatatcctatagaaagtaatgcaactactactaaaaaaggcaaataggtgccaacacaacaaaaaccgacacatataatgccatccccgcccatgcacccacccccacgcgccacatattaaaaaaccgacacctttatatctaaataggtgccggtttttaaataaaacctacgcctaaaacctgtgtcagataaaggtgcctgttctagacccaaaaccggaacctttaatcttctccccacacataggtgccggttttaagacaaaggtgccgattctcaacccaaaaccggcacctttgtttcaatagtgctttttatatccaacggtgggtcctacataaaggtactagttcttggttcgacaagataaaggtgttggttctcgacccaaaaccggcacctttaatattctccctcccatactagccattggtgggccccacacataggtgtcggttattgtatgacaaaacgaaggtgctggtttttgtctagaactggcacatttgttccaatagagcttttcatgccacacaaagtgttagaaccggcacctatgtcctttacttaaataccctcacttatcccttcactctctctcccttatccattcactctctccttctctctctgtgcggcggcagcggcgacggcggtggcaacgaatctcacccttgcaccctccccctcctcaccctcggcggcgtagcgccctctaggtcgttgttggctgaggcggagctccaccattcgtttcccagttccatttctcgattgttcatggcggctagtttgggagctttggattttgatcacctatcatactccatagatggaaaggagtggttcttgcttgaagagctgcagggacaaatcgccaagctagcggatttggacatggctgatgacaagcggtatacaggtatgcattcttctcccatctcttggcagtaaatcatttccctatcacctacgctgcactccacctgtttgttgtattgcatcttaggacaaagagcagcctagggaaaaatgaacaatggtgatctgcagatttttatctgtagattaattgaagatgcacatgagaaatgcttgattaggcctggggttatggtgctgaattgctgattgaaaaaacggtgatattggtggtatcgttttggtatcagttgacattccagaaaggttgcaagcttatttctattatgttgacttaatactcgcaggcagatgttgtttttgtgtgctaagtgatattgacacggggctaaactctgagaaaatgtagaaactagaaatatttttttaggatataaatagaaaaattaagcttaatacttaactgaatcaagttttctggagaaaa

SEQ ID NO: 22793 - DNA, 4583 bp, Oryza sativa
ccctatcacctacgctgcactccacctgtttgttgtattgcatcttaggacaaagagcagcctagggaaaaatgaacaatggtgatctgcagatttttatctgtagattaattgaagatgcacatgagaaatgcttgattaggcctggtgttatggtgctgaattgctgattgaaaaaacggtgatattgttggtatcgttttggtatcagttgacattccagaaaggttgcaagcttatttctattatgttgacttaatactcgcaggcagatgttgtttttgtgtgctaagtgatattgacaggtgctaagctctgagaaattgttagaaactagaaatatttttataggattaaactagaaatattaagcttaatactcaactgaattcagtttttctgcagaaaatatttttctggtgaatgacctaaattaattatatgcctttttttgcttaattgttgattacatattcatgctaaactaattactgctctttctgttacatttgaagcatcctctgacaagtattaagtagtgcctgcgttcatttgctgatttattggattattcagatttgatctttaattatgcatctttagttattgagatccataaatttgtttgcttcattcttttaggtggtcgaccatctacagttgacttccaaataggtgaatactcgacatgaatgtgtttatgtacaaaaagtatttggcaatgtgttctcctgtagtttagataggctagcagtagatgttgctgttttgtttgtcatcagacctcttgattaccttcgtgcacatagatatcatcagtttatttaaaaggaaactgaatctggattcagtagtacactgggatttggtggctactgaactgttgaacactaatcatgaatgtttatgcatgaaaagtattatgtcgtttgtagattcttatggatggccagaggatataattagaagaccatgtctttgggaaaaaaacatagggcgagcttttataggctgaatgtggaactaattctgtgagtagatgaggttatgtgataattgagtgtactatttgatgctctttgtttgcattttcttttatgctttccaattttgtgcagataaattactggcaagatattgaaatgcctaaggatggtacaaaactaaaactaagagtaagaactttgggtgccaatacaacactgtcagcctttggtcatgaaaacatttgagaatcaacttagacattaccatgtatgtcattattagtaccatcaacatcctaattaactcatcttaattagctggcactacaatacctatatttttctgaaatatgttatttctgttctacagaagcaaattattgctgatagtgtgtgctttcatttgctgtatagtatatcatctgttgcccttattttacttatatctacacatggccatgctgcttcatgtttattttctgcaaatgccatcacctaagattttgaagcacacagctgacaaagtggacatgctacgagtgcaatagaacaaaatgcggtacacaagtatactgattgcagcactaggagtgcaataatttttagacttacaatctttcgatttaggtattttaaacttagcatattttgagttaagatatatatgccaatgtttaggatttaaagataggaaattttggtcttacgaatttttagacttaggtttatagggttttatttgttttgaatgtgaatgtgaatatgaatgtgaatgaaggaggattgtgaatatggatgtagggctgtagggatgaatttgggtttgtatggaattcgggttgtatggatgaattttctgtaatttttttttacccaaaatataggtgtcggttttttattgccaaccggcacctattaggaccatataggtgccggttttgacctcaaaaccggcaccagttctagaactggcaccgatgacaagtatcatccgtgctgtctccgttgtgccggttcagaaaactggcacttattagggtttctggaccggcaccttttaccttttctgtagtagttatttaggttggtccatccatcatatgctagtagattgatggccgatcaaattaacggtgtacactaggcatgcaatcttgcaaacaatacatttataaagtaggagtaatatgatcgaagagtggattgcattagctattggtcttcaaaccttcgagaaaaaccagcgtccatgcatctcctaaacgtccgacacgtgattaaaaaaagtgaaagccatccaaaatcggttgaagagatatgaattttggaaggttaatggattttctagaatttggaaaaggatttattaaattggaaagaaatatttccatgaaaatattccttggttgtgaggctcagagggaggaaagtggacttggtggagatgaggctaggctggtgggcttcagccaaaagttttgagtgaaggagatagtacagacttttatacggaaatcaatttcttgggcttcgcccgaggaacaaagagatatggacttttgcaaagttttcaagccaagtgggcccacggagaggagtcaagagacttggccccactgctgggttccaccccttatctttctttccctttttcttttattttccttcttccttatcttttctctgcttcttccttctcttttcttctctcctctgcttcttttgcacgcgtgcccgagagaggggaaggtgccagtggctgcacgaactgagcagtgtagagggcaggagtcatgacagctttgggaagaggaggggaggaagggagcattgccgggggagcaagaggaggttgggtgcgccggtggctctggccgggttgcggcgccaagaggaggtcggcacggcgcttcggctagggaggcggatgggtgcagttcgggggctcaaatgggcagcgctctgctcatggctggcaagcatcgggcggctaaggccaagaagaggtggcgatagtaggcatggtggtacagcttgtattctaagggaggaagatggtgggaacaggcgcttttgtagcgagctcggccaagtgaggccagctgccctgttcggctgatgccatgggcagattggcacacgagtggtagggtcggtgcggcatgggtgagctcggcttacacctttcggtgtgcacaagtgacacagacgaactcgtcgctgtgccatggcgcactggagcgcattcagtggacaacatcggttgcttggcgtggacgccgagctttgctgagagacgaaagcagcaaggttcggtccaggcatcaaacaaaatgagcagtggagtaagcgtgcatttttttaaggggaagcagcacgagactgtgacttttcattaaatatagcagcagaataatacctagggacaagaaaaggaaaaaaactctatgtgtgcatattttggctttgcttgctgcattgtggaaaataaaagcgggcacttatgcctgtctgttgtcattttgcccgagggttgtagacaattttgagcttgcaaaaggactgtcactgcactatgaactttggctatttgtttggaatttttgaacgagtacagcttgaagaaaaagagttacaaaggaaagaaaaaatgagggatgatttaggacgcgattcggattccagaattcgaacatggggattttgtttgggagaggatgattggaggaaaaactcgccttttgctggttccattgtgcccgattaaattcgacgggagaaacgactgtcggttttgatatgcaactgcataggaaatatttgtcagcggtaggattccaaaaacaaatattgttcgaatctctggattggaagggaaattattggagagatattttgaggctttggacaatatttgaattcaaatttggaatttcaattcacaagtatttgactgaggtcttgatatttgagatgtatgaaattgtaaagagtagaccggacaaccaaagacgagggtttgaatatatttttgagaaggattgagaggagagcttgaacctcaaaatacgaatcctgagagtttaatttagaaggaaaagatttggctaagactttgagtttacaaggaatgaaatacttgatatctttgacacacaaacctatatacactcaaagaacaaaacttttgaacatggttatttaataaaatagatttttcgaccaggcaaaaatcggggcgttatgttagaaatatagtcatatatcgacatattataatctaaaatattaagacaataatcatgacatgaacaatgttaggtgatctagtgataaaattaaacataaccaggagcatgcttaaaatagaataagcatcatcatcatgtagagaacgcaacgcacggcacggcacgccttgcccacgccctcgcctcggcccgccggctcggctcggcgcgctcgcgcacgcatgtggcttttcgatccccaccttaaccggtcaatagggagcctccaataactccctatttaagttgaggtactccacttttaattccttgggtggtattactatccttcacatttattatgggc

SEQ ID NO: 22794 - DNA, 3508 bp, Oryza sativa
  unsure (1)..(3508): unsure at all n locations
tatgcactgtgttatcacgttggcatatagaaggaagaccaatgccactaaaaagagggtttgattcaactaattacatttagtcctgttagcataagttagatctaaaaaaaactgcgaagaagcaagggttcatcatcactcatctagaataacatccacccaacatgcatacacattgtattacgcttccgaatgacccaaacctatgtaaaccacctgtctacattatatttgtgtgattggaacatgaggttggaaccatcaccctagccgaactatcaagagtgagtgtcgtactttcctgctagaagagcatcctgctttgacattaacctaacctgctagaagtctggttaggagggaagctctctcatatcttatccataggctagtctaacctttacaaccatacctagaggtctgatcctaaccacctagaccaacaagtgcgcgttgcagtacgggatgtgcacaaaagcattgcacacggaatcagtattgcacacgaaaaaagcagcgtgcatatctatcgcatggagaaaggacaagcccacaggctcttgcacggatagcacatgctagacatcgggctccgtaactatcactaaatttaacaatttgactcttttcgaaaactaatttcgcaaataaactgtggacaacacttattttaaaaatgatccttttgttcaacgccaaatcgtatggcgctaaacttacacatgtcagcgccaaatagcacgacgctgaatgcacgttggcacgccgactcaacctcccatccacggtggcacaacattcagtgctagttgacgtggcgctgaggtgtctaagttcaacgccatacgatttggcactgaacaaaaggattattttttaaataagttttggccacggttcatttccgaaattagttttcagaaagagtcaaattgtcaaaatttgtgacgtaactattcgctttgctttaaatcatgactttcccatttatatatgtatccttctcttggtttataattttgattgtaaacttacaaggtctcactgcagcacacggggtgtcatctaacaaaaccaaaaccttgagtcaatgatagtgatatgattttgtggagtgagagaagatgcacaaaaactgcacaaaaactattttgtggagaagatattactggcggcatcattgacaacaaattctaatggtagtttcttgtcgacatattttcatggataatctaaaattaaaaccgaaacataaaactaaaaccaattgaaacatggatgacgtcaaaattatagcggaaacatcttcaatatttttatagtagtagagataagctcattactacatcgattccctaatagctactattgttgtctatagacatttcacttatattataacataacgtaaaaagacaaacagttataacatatttttaagaatttatatatacttctctgagaaaacgcacaagcggttaaaaattaaccttaataaaactagtgtcaattaatcaagttaacccttaattacattttctttcttgttcctcctataaatatatttttaaataatgaaagcttttattgaactcagccaatacaccaggataatacaaaagcactaagcacacttttggatgttgcataactaggacacacaccatttataagaaaataaattacaggaagtattatggccatcaatcttaaaactagatcgctacccatccccttgggtaaaaaattccgtaactgcctgctctaagaatagacacaccgtagtaaccaaatcttgcgaacccggtttttgtagtataacccaagtgcgcagccaatagataattaaatagactacccgcacaggagaagaaataattttttttgtcaaaaaccatatcatttatgcataaccagtgcgaccaacaaatagcagccgcccctaacagagaaacatacggctgtaaatatttttgaacacctgaaagccatttagtaaacctgtgtgaaatattatgtggtgcagtaattcttgacgcaacataagtgatcgaccaaactaagttagcaaaatgacattcaaagcatgtgtgtttaattgtctccatgttatgacaaaataacatttttgattgctttgccagttacgtttaggtagattgtccttggttagcataactccacgatgaaggtaccaaacaaaaatcttgactttgagtggcaccttcaatttctagaggtgtcaatttatattctggacatcactatggaccactgccaagtagtgagtttttactgtaaacttcccactatgggttaaattccataggaactcatgccaagtagtgagtttttactgtaaacttcccactatgggttaaattccataggaacttatgccaagtagtgagtttttactgtaaacttcccactatgggttaaattccataggaactcatgtngcgcctggcttagttcaaaattagcaatccgaggtaataagttattccaagctactaattcttgaccaattgaatcccttcaccataaaaagattcgagcgccagattgaaagacctctagaatagtactttatttatgtctaaaaatattgtaaggctcgggtactgttcttgaagagttgcatctccaaaccatttgtctttccagaatctaatttgagagccatctttaattgtaaaggattcgaaacggaaaaaaaaagtcttttttcacctttattaggctagcaaaaaacataagttcctagttttccactgaacttgagaaagaggttgtgaacccaaatacttattatgtattagctgttgccaaactccatccatagtaagcaacctatatagccacttactaaacaaagctatatttttaagttccagatcatgaattcctaaaccccatggtcttttgagcggcaaagaatgtcccatctggcgaggcaatacttttgtttttgaccattactcagccaatagaacctagagcgataatagttaagctttttcgtaccccttagctattggaaagaaagacatgcactagtttatattataaagaggagtctcttctttctataaacctaatgcccactaaacatctaaagctcaacatgcaagcatagtatttattagcactcctaaaacatataaacaagtatgccacgtcaacccattaagcacataaaactcaacatgcaagcctatagtaattatatttacactttattttattttattctaaaattaaacatacacatgctaaatcatcattctcaaattattttcataatatttcaatcccaatcatttcatcatttttccaatatctaacctatatcccgcagcaaagcgcgggttatcgtctagttataaatataactgcagttatattttattatagagaggaattatgtatatatatatatatatatatatatatatatatatatatatatatatatatatatatatatatatatatatat

SEQ ID NO: 22795 - DNA, 2353 bp, Oryza sativa
aagtttctgcctaccaaattaacaaagtatacatgttctcttctttcccaaacacaggaagctatgttcatgtaaaaaaaagtgttaaccacatagtacatgcaaacacacataaaccatatacatgcaaaaatagaggcacatgctcagtacggtgtttacaccatggattaatcaaagaatttctgggttatgcaagtaaaattagcctgtatattctctaatgtctaactatattgtagacggtgatttgttattgttacaagattaggaggaattcttttttttttcaaaagagactagtaggaagtgggaactaatggcttcgtctcaaccgttgataaaaaaaagagaccgtagagattctatcaaatccacccggtggagttggagtgaactccatgggatccagacccctgcaggacctcctgtacagtttttccgtcaagaaaaattttttttacttacaattaaattgtggacagttacgtctcatttattacacagtaatgtacaaatagaagcatttttttgtcaaacgaaaatttcctttcaaatcacgcacagagatcatcgtacttcacctcagtaacaattaaacgtactgccatttgttatctcgcgggacagttcaatttttatttagtgtcacctcaatgtcctttcacattctcacgcactctgcatatgtcctggtcacctactcacctgccctatttctccattggacacagcctcctcatttttcttcagcggcttgatcacgccatcaccaccggcatcagcaatccttaccaaagggtgccatataggtatttctattattctatacttatttgaaaagaaatagcggtgttggtgagataaagaattcctcagtacgtctatcactcccttacttccttttcaagcagagaaaggatatgtggttttgtgagaagaaagatggtgtgaaggtccagggcatacagccatacatgtcagtaataaatatatgtataaataacagattacgtatgaaaaataatagcaatagtgggaagtgataattttatttaactaaaatccctttacaacgcacacgcaatatactactattgttaaaatttcacaatgtgtaggagacaataagtagatcctaagagcatataaaaaccaaataatatgcaatagtttgggtagagaggagagaatgaatacatagctaaggctgtatttaaatccaggggtgaaaatttatgccgtatcacatcggatatacggacatacatttgaagtattaaacatagtctaataacaaaacaaattacagaatctgcctataaactgcgagacgaatttattaagtctaattaatccgttattagcaaatatttactataccaccacattatcaaatcatggagcaattatacttaaaagattcgtctcgcaatttacacgcaatttgtataattagttattttctatatttaatcctttatatatgtgtccaaatattcgatgtgatagggtaaaataatcaatgatatttttatttattgctggcaggtgtagtactgtactaccttgtgtaaggactacatttattgcgaactataaggtttagagtacatgcagaatgttctaccacatggagaatgttctactacaacacccaccctttatatattacaagcgtccatcaatcgccactagccagacagaaatttatatatatggctgcaactgcaaatacagtcagtcagctcagatcacgtagaacatttccaggtttcagatagaggaagagagacagacagaggtgatgagcagctcatcagggctagtggattggagggggaggccggtggacacccggaagcatggaggtgtaagagcatccattttcatccatggtgagctaagcatgattatgtactactgtttttttagtactatgtctctcctttgcagctttgctcgtcactgagttgttggcttgatggcttctgttcatggctagcttctaccagtgttctcagattcgattgtataaaaattttgggaccaaaatgaatgaaattaaaaaaatgtgagaaattaattattaccaaatttaaaccaaaattcagcaaacataaagtatgggcgaaatttagtctcgatccttaccgaaatggacgaattttggaccatttggttagaatcccttaaccttggttcctactattacgttctataataagtttattttttaatatgaatttggattaacttattttaagataaaggaagtagaatacacacatttactggtcaacaaagataagcttgtttttttcaccttgggtccacatctaccttgaaatat

SEQ ID NO: 22796 - DNA, 8629 bp, Oryza sativa
  unsure (1)..(8629): unsure at all n locations
acgttctataataagtttattttttaatatgaatttggattaacttattttaagataaaggaagtagaatacacacatttactggtcaacaaagataagcttgtttttttcaccttgggtccacatctaccttgaaatatagtgctagtataaattttaactcgctataggataaagacaatcaaactttttctaacaaacgcaatataaacttaggcgctcacaacatgcgcacaaaatagaccggtatatattgatattacccggtccgtacaaaactagttgttgacgggtacatcacctacgactgaaaacataattaactataaatacgagcgccattatgaagtctgcaacttgaattcagattcggatgagttgcttccaccataaggaaattaatcggttaagctatgctcaatttgcaagataaccaaacttttttttcttacaagcaagccaagtttattccaatcccgaattttgacgtatctaaacctctgtgctacaattcaaaattcagttctggaccgaattaaaacttaatacaactcatgtatcagaacgctctcagatgctgaagttgataacgaatcatggatatgatcagatgttaatgcatgcagcgatggtgctcctgaccaacgcgcccaacatcgccaacgtcttgaacatggtgagctacctccgggccaccatgcacatgggtgtcgcggaggcgacgacgacggtgaccaacttgttcgccgcgttgcaggtgttctccatcccggcggccctcctagctgactcatacgtcaaacgattctacaccgtcatcctcttggctcccatcgagatcatagtatgttaattattcgttttttctctttttgcatatatcacgtttgatgttttttaagatgatattgtctattattttaactcaaggcgcaattataatgtgcgtaaatttcacaaaactacatatattttgatcaatctatcacaaaacagagttagcataaattatttgatgaaactacagatttaagacattgtgtcacaaaataacatcttttgtaactttggaaaagcaatactgatatgaattctaaactctaaaatttgtagttatttgataacattgtcagtaaatctatagatttatgatacgatgcaacaaatatatagttttgtgatatatttaatgtaaattctgtaattttgtgatacatatatactcttaaatatatattttgtgatagtttgctggaatatttgtagttttgcaagttctactcttataatattatgaacagtttcttgcaaaactttagaaaattagtctcagatatagtatttatcacgtcaatcaaggatgtccaccctaggtgactgtgacaagtgaacactacaacagaaatcttaattgatgccggttgggaaacccccttaggttccaaccgacaccacgaaggcggcactgacgaacacaacataaacatctaagaacacacatcaacattaagaacacaagatgaacacacatgaacacaagatgaacacacaagaacaagcatgaacatccactgctgtgccgccgccgctgcatccgctaccaagccaccgttgtcgctttcgctcccattcgcctccaccaggccgtcgccaagtccggccagatttggtggaggggaggctccgctgctgcctccactgtcggctgccaccgctaggtggggaggccgctctcggtaagccgccgccacccaccacctccccacccaccggatctggcggaggggagttcgccgttgtgtcgtcgtcgggccaccgcctcctctcgccggaccatcagatctagtggcggggaggaccgccaccgcctcctcgccgggagggcgccaccgccatggcgttgcgaggaggaggctgccgccgagagacgtgaggagagcgccgccgagcgtgtgaaaggaggaggggaggagaagagggcaccgtagccatgagagaggagggggaagaagaagataaggttggggaggagaaggagcagaaagagatgggaagataacattgtggaggaggagagatagcgtgtgtggacggctacaaatatcttccgcatctccatgtggcttggctcggtttataagatgtcggtttttttaaaaccaacacctatactgaattataggaaccgacacttttagtataggtgactgtttttctcaaaaaccagcatctatagtctcttaaaggtgttggtttttttctgttttcagtccgtggagatgggaaaaacactataggtgctggttttaactattccggcacctatagtgcagatttgtatgtgcctctttgtagtagtggaagtactataaatatttagtgcaatcgaccatattggtatcgggtagtaccatctgtcaatctaacaccagtcattcatcaagcctattaatcaattatttgtcgtgtgagtactatagtctatttatttaatatgcatgcactccctctctctctctctctcattctaggagcagttgtgagtttccgtgtctaactttaaccgtccgtcttatttgaaaaatttatgaaaaaattaaaaaaaaagccactcataaagtactattcatgttttgtcatctaataacaacaaaaatactaatcataaaaaatttcaaataagatgaatagtcaaatgtttgacacagaagccaacaattacacttaaaattggcggaggaagtttgtaaagaacttcagattaaatcacttgttcttgtctttatttttttttcaaagtggctctccaagctaggtccccaactggcactgggattctggcactgatgagttgagttcatatatcactactataaaaaagtctttaggtgccagttgccaaacccacatggatgcctggtttggcaaccggcacctagtaggcggcaccttcgagttttctcaaaggtgccggtttaggaagtgacacctttgaggtcctaggaattaaaaaagaggctggcttaacgcctcagctcgattcgagcccatgcatcaagcaatagcccttcaccccaactagattttatcacactcttaattacatttagtcgaagaaaatggaagaactcttagaacacaagaacatcaatgagacaagcaaggagaggggaggggagggtgcttgtaccaagctgcctacacttctaccaaatctagtggagggaagggcgccggacctccaccttcttcccttccgccatatttggtagagaggagggtgccgccaccggcggcgagccaccaggccgccgtcaccttctcttccgttggatctggcggaggggatggcgcaaccgcctcccctcccaccatcgggtggtgtggtggagagagagagggagcgagagagagagctgagagaggaagagagagggggagaggggaggaagcggagtgaacaagagagcggaggataagggagagagagagtgagggggtaataaaaagggagagagagagagacggaatgagaactcgtggaattcggttccattggtttcatccggttttcttgctagatgtatccgacactaatggatattaacgatatcggttattcttaaaaaaccgacactaatactatatgtatccgtttttatttagaaccgacacctatctctccacaaaggtgctggttctagccgattgtatccaatggatgcacattttaggtgggaaaagtaccatagatgccggttttagcatttccggcacctatagtgctgacctgtgtgtccatttttgtagtagtgtatgccggatgtgagagatggcattgatagggttatggaagtaataaaaaaaagaaattgttggctcgacgcatcagctcgaatctagccgatcaatcgaactccacccctccctctccccaagaaccacatcaacattcaagaacatcacaagttaataacatatccataccccatctagaagaatcaaaacaaaccaacaaaaaagacaaccacagaatcaacaacacatcattatccacatctacagtatcaaataaggcatcacataattaagaacaccactgctcaatgctgaaggtcaaggctaccgttgtcgttgccaccatcgtcaagcgtggaactggtgcattctggacgggtggtggctagatatatacgtcccacccaagttcgtgttagtcggatccagctgcccgagcttgatgacgggggccatgggaatggttgcgcaagaggaagagggtgctgctgccactcaccagtggggaaagagcgctcaccactggttgggagatagccatcactgctctacggtggagcaggccaccggtgaggagaggacgccgcgccattgaacgatggatgcggatggcaatggaggaggccactgctgtgagtggaccgtgctggtgaggagacagtgaggggagaagacccaggaaagcgactgagagcacaaagatagagaggatattgagacttataatttcatcaaggagttcatttttcttttttaagactccccgtggtctcatctagtcgaagatgaaacttgtctcggctcttgtggctctggcaactttttttgttccagtataaaaggtaccaataattattattgtgtatcggctcacctaaataactaacactttagcgtttagtgccgattcatgtaataaagactgacactgatgtggttttttcttctcccgttttctgcacgggtctactggagctggaaaccggtgtcagtgccagtttttgtcaaccgacactaataaggcgacacaaatgtgatgttatgtggtagggcttgtaagtttgatttgctttgtcatgtgtcaacttttaggactcctttagattataagatttctggcagcttttttaatactattcaataaattatacgcaatatcaataggcaaagtcttgtcttaataagttcctttttaaacacgtccaacaattatctacggaaagagggagagtactgttttatagaacattgcaagtaacatgtatcaacaaatatgcacccaaaacttaacacaagattgtctagacaagagaaatgtgaaaaaaatacaaatgcggtctttaacaatatataatttatcgaaataaccaagtgcaccaactgctccttgctttttaggggaaaaaatattttaacgatcgaggaggtaccaaatttttgtagaaaaacacttatctctcccgttagcttctcaagtatcactcgaatgttcagcaataatcaagtactaacacgcacaatccaacaagcttctcagttctcacacatagctggttacttcgtcgccgcagggttacatcgttctggcgcttcaagcgtacaccccctcgctgcacccgccgccgtgcaacccggcggccacaacggcagcggcgagcaccacctgcgagccggtgcgcggcgcaaacctgagcctgctgctgctgggcctgtacctggtcccgatcggcgacggtgcgatgaaggcgtgcctgccggctctgggcggggaccagttcgacccggccgacccggacgagcagcggcaggaggtgagcttctacaactggtacaccttcgccgcgtccaccggcggtttagtcggcctcgtcttcatcgtgtgggtggagaacagcaagggctggggcatcggcttcgccatctgcgccgccttcgtcttgctcgggttgctggtctgggccgccgccttcccgctctaccggaaccggctgccgacggggagccccatcacaagaatattgcaggtattctcgtcgtttgagctaaaagttttcagtcgttgtagtaaactataaacttcgctaaattcttgtgataaatttaagctatatgtatgtagaactttagaggattgaataacaattaataaagcctaatgcggatgacaaattggaaaaagaacaattaataaagcctaatactgatatgcttcctgcttactctgtcatccatgcatgacactacgattcctgcttactctgtcatccatgcatgacactacgacagagagtaagcaggaagcatatcactatataacatagctgttctttttcctatttaatcgatcaagctgtgtactctaggtttttgtagcggcattcaggaaaagaaacgtccgcttgccggaggaccccagcgaattgaaacaaatcaaccaggatgatgataacaatgccctcgaagttctccccagaacagatggatttgggtatgtcggccaaactctgaacattgctagtttatcagagtattcctttaatttgttagtaatgctatagtataagtgaattaggcacattctttcaccatcttaatatttcgggttaaannnnnnnnnnnnnnnnnnnnnnnatgccataaaaagacagatggtatccaatctatatatcctatatcctatatagttggaaccaaaaaatctagcctttggatcctctcatgctttgatctcaaccatccaatatcatgtgtatttacaacttgcttattttagttatctatcttctatctatctatctatctatctattattatatactaaaagtccatgaaacttcctacaaacgctcttaagccgccacgtgggagtcctacaaacactcctaaaacgccatgtgtcactttaataaacaactggacccactatttttaattaccattagaattgttttttccacctccctctcctatccctacaggcccacattcaagcatccctgcacgtacgtacaaacatacaaacgtacgtaagaatctacctacacactatttgctaaaggaaaacaataaaaaactattcatcagaaaaaataaaaaaagaacatacatgtatgcacatttgtacccacggttggaaaagaagcgatcaattgttacccctttattttcttcggttgttcactacttaaaattttataaagtatatgatgtatcttatctataaaaaaaataacatccatattacctatattttaattacagaaatttgtcatgcagaactatagtcttaataattactttctttgtgttttaataacgaacaacctaaataagctcctaagacaccaagaaacactttaatttaataaattagagaaaatcatataaattatgaagacaaaaacaaaaaaaacattgattttaacttaaatatgatcgaccaattattttccactattacatttatcttagcaatatttatgtatgtacactattgtttctagataccccgatgagcgtaattataatccattaaacttcctacaaacgctcctaacctaccatatggtatcctataaacactttcgagtcgtcacgtggcactctaataaaatatagaaattcgctcatcgattttcatttaaataatgaacccattattttaaattgttagatctatcttaagaaaaatctccctctgtccatgcctatgtgcggcattatcatgaatgtacgtaacctaatcttcctctattcctttcttttttatatttccatgataactaaaattattgttttttatttttgagccaaaaaatatccataaatagacattaacctactagatagcaagctcttcctccgtactctctttatagatcactaaacatcatacgaatatttctaattaactacatagcactcttaaattagagaaaataaaaaaacaaaatattcgaccatcgattcctacttaaatcggttcactactacaaaactgatttttcatggcgtcaaactttctttttctctaacggccataagtgaaaaccgccagcgaaattttaacaatggatgaagtgcttaggactgccagcaaaaataggtcttcgctagcggccggtttaagaggaccgctaaagtagaagtctttttgcaagcggacctctttagttattaaatcgaattttcgttggcggttgctagcaaaaagtacatagagagcaccgctcgcaaaaagaaaacaattgcgttattaaaaacccccacgggcccaccggccaccacccacaacccaccacccaccggccaccgcccaccgcctccctttcctttcctctccggtgctgggagatggtggtgcgggggcgcgcgggcgacgttaaggcgccaagaaggctgattcggcgacatgcaccaaggtacccattaaaaatgtagcatatagaaaataattagctggtgcattttagcaacgggatacaataataagttgtaaaatatctagctaattttactacataccagaaagaactatcaagttctaactattgttggcaaacaataatataggcacaagtgccattattttcacatagggatttctaactttttaattgtatgaataattattttcatcacaactacacaaatgatttttgcgaacattcttttcacatgtggctcaaatgtgcagcctcctatgtggtgagcctcttgcctcagactcatgggtgttctttgaaaataatttttgcaatccttttgcacataactattttagtggagtgcttgaaacacaatgtagcgttcaagcttttacacataaaaa

SEQ ID NO: 22797 - DNA, 14308 bp, Oryza sativa
tatctcgacgaacgcacgcttgccgtgcgccatcgcagtaccgctctcaccacatgccgccgcttactacagcctccatccgttgctagccgccgctagtcccaccgccacgccactcggtcgccaccatcggccccgggaggtcaaggaccgcctggtccatcccgcgcaccctgccgttcaccgctagccgccgtcgttcgccgtcgtcttcctcccacgccggccaacccgcggtgagaagcccctccccctcctttcttctcccgtgtgtgccgatgccttggcagcgccgccgccttcgcgacggccgccgccgtctcccacgccgccggtcgtcgccgatggccgcgcgccgccgtcaccccgccatgccggccggccggctttgtgccgagccgaaacgtgcctcgccgtgcccacgccgtccgatcggcctcccggctgatctggaccgtcggtcccgtggaccggcggtggattacccaggtggtccctgtccacggtagaccggccgccctttgtgccactgacatgcggggcccgcctaccgagccgtcccccctcgctgccgtcagccctggggatttattgcgcaataattaattaaggcattttctttattaggaaaaacacagagaatcttctaaaattcataactaattcatccaagctccgtttaagtccattcatgtctcagtaaattcataaaaatccctagaatccaataaaaatggttttgcttcctgtttcagtagtcttatagtgtgttttgcttgtgtgctttgtttgtcgcgtagattttggcccgtttcatcaatccacggttcctcgaagatgttgctttggtctcatcagtgcgagagcaaggtaagtcatgcattacatttgatcatattgtacccaatttacaaacattctgtatttctattaaatgttgcatccttttacaacatcatatgggatgggtcctattactcagccatttattgtttaccctatgccattgataacttgggtatcaaaatgactagatgttggtttaggaaatgcttagccatgcttagttcaactagtacacaactggggatcacattattacatagactttgactattagcatagctttggattggtgccaccgcaatggtgttagttaattaaaatacactgaatggtgggccgtgggtgcatggttttgctggtcgcacccatggcagttaaggaccggttcacgggaaaccctgggagacttaccattcttaccacaagcgggagtgggtaactgcttgatctaaagtatagctcgaccctttcctaggcaccggtggcgagggtgggcgtgatggagttgggtcggccagggtgtccggttgtccagctgctggattcaccgcgacgcacgaggggacttcccactgccttttgaggggtgggggtgaaaccttagcgtggtgtggatggttagcggtgggttatgcaaagggtcttgtcacgatttccccctttgcagtatcatggtgatactttggggcatggcgacatgtgtagaatcgtgtcttgtgggtacagttgtacacctttagccagagtaaaactattcgaatagtcgtgcccgcggttatgggcgatcaactagattcaccgtgattagtctcacccctagtttagcttaatgaactggtgtacttcaggtggttggttgggtatgttgtaacgtggtgtagcgtttgacagtgagtggttaatatttactaattactataattgtttttactactttcaactactgcttttaaatgctagttttatgcaaaagaacctttagcctcctttggttatatcctgcatcgtacctccttttctggtatgacttgctgagtacagtgggtagtactcagtcttactctcttttcccccacaccagagctgaagatcttcctagtgggagctgtcttgttgaagttggtttcgtcgctgctgacaaggattgcctgtggagtggagtcgccccgctgcagaagtcaagcttccaagtttagctcgcttttatcttttctgctgcatttgtaatcttttatatttttgtaagacgtggatctgtatgtcaacaattgtcgtttgtgtaccctggctggtcctagataggggtttaatgcatattcagcttggaaattctagttcgtgaatttatgggtgtgacagccgcccaccacccgtccgcagccgcgtgccagagcccgtctgcagccgcttgtccgagagagagagggactgggccaccggggagagagagggcgctgaggagagagagaggaaccagggggagagagagagggggagggggagatatgacaactgggcccaaggagtccttttgctgactggattaacacgttagcgccacgtgtgcaagcttaaatcaaaaccactcagaatagtgtcgaggggggtaaaagtttagggtgagcaacgtttgatttttgggttcaggggggtatttcggtcgaccatgatagttcaggggagtaattcgtactttttcctgataaataatacatagatgtatttacttcatataggaaaaattttagtaatttatttaattgattctattccctccatccacaaaagttagaaaaatttcacatttgagttttttttccaaataagttgttcctatttgtagtctttatgcattcaagacttaaatgagtagataaattaaatgtttgattagaacccaaggagtcatttaaatactcattggttgcatgcttacatttactccttgattttgtagcatccaagatgatttaatttttctttggtcttggtgacaaaagtaataggtataacttttgtggatggagggagtatgttttaatgggctaataaatacataagttatatgccatagagattagcggtggttatttttaattatatgtagggtgtatattgttgaggatttgtcaatttttttttaattatatgtagggtgtatattgttgaggatttgtcaattttttttcattgttatgtacatgtatttttttttgtttgatttgaatattgtcacgaggatgcatttttttattttatttcatgagattgccgacctaattttagttatttgtgtttataaagtgacatacacagacctaatcctatatacttataaatcctatatacttatatagttcatccccactaagtgtagttaatgctatttctctcttctctcaataagccatatcaccccaattatttctagcctttggatgatagatctatggtccaaattgtctcttctttcttctctcttaaaaacatgcaatctcaattatttttaggctcaaaattatatcaaattgttttagttttgataatcaaattacatcttatttatacacattatgcaacttaattttccgtagacggaaccacatattggatcactccagtgcggcacgaagccgctgacgctgagtaggctcctatgccgctagcacggtggaggttccgtagcgcgtcatgagcaccgggcaaagggacggttgagcgactcaagtgaaccgccctacctgacctttttgggcacaaagagctcctcctaattcactaatttgtaggaagataatggacttttgtatttgaaaaaagtttcagaagatatgtctaaagtagatggtgattgatagagcaattcttgctcataagttccagtattagtactgtgccgaacataaagcttgtggctggtagtaaaacatcgatttttcttttaagatagagttcgatcctcaactatttctcacgatatcttcttacgaacaccaaaagttgtagagctggtcgtctttcatatcgagccattgaagccttttcgtgccatatgtcgcttagacttgaccttttctcccgccccctaaaatcttcggctcctcgtttttattcaattatgaaattactcattttgggtcgaaaccggtgaaattaaggggcattacttgaatgcgactgcaggaatttctttccttagtagtttagttagcactttgcctctttgactctgagcagagaagtattaagccgtgggaaaaatcgaaatgaaataaataaagaataaagcaaaaaaaagtcgaagatagaagagcccagatttcaaatgaagaaatagaaactcgaaaaagatccttctgattctcaaagcccttggctgaaggcctgattgaatagcaatctcgtctggaactccgcgacggggtagtcatctagtttgtatagtagttagttgccgttcttctttatcgcttgatagcatatgggttcattgggtcttggatattatatgttacacacaataatctcgccaatattcttgactcaattattggtggatagcggtttgccggtttataggcagaattgatataagtgtctgagtgtgacgtagaattgatacataaggtaaaccctatatgggtcgattaaactggattttatactttatactaagattagttagatctaaactctaaacatgggagaggaaatgaccgacaaagaagcaccctattcttcttaattaagacatattgataccattttcaagaacacatccgatgccttctttttataatgtgttcactttaaatattaaaaatataattatgtcaaaatatttttcatgacatatctaataaacattatttggacatgttgatagtttagaacgacggtaatgttatttaggaacgctaattacaattaaagtgtttagttttgcaatattgtaggtcgctaaatattaaagatataatcatgtcaaaatatttttcataacacatttaattaaaattcttttgtttcataaaaagataatattattacattgatatgccgatattttagaacataggtcttatttttgggaaagcgctaatcataattagattattttatttcgtgatgttatagatctagtctaattatgcattagattattttatttcgtgatgttttttttcatgtcgtataatgggtcaaaatcaatggtagatgttttcttcttttcttggaatttcatatattttctttatttcttaaagcactatggggtagcagcattcattgaaaatttaatggactattagtatatactaatattttgtagaaacgatgatctatgatttgtgaaagtggtatttacatttatgccacaatacatattactccctccgtttcacaatgtaaaactttgtagcattgtccacatttatataaatgttaataaatctaggcacatttctacatatgtctagattttataaacatttatatataaatgtgggcaatgctagaaaatcttacattgtgaaacagagtgagtaattgttattatgggatatttttaagtatacatttttttggaggatgggaggttaaagttaaaaggcgaatattacgcggtgacaaatatttgaaaccagagaggttggaagcaggcttgtggctagttgcctaaaatcttatcacagtttaaatcctacattttgctttggttaatatttaatctaaataccgactttagaaactgaaccctggtaggtcacctgacaacatcgagattaattcctactccagaatagttgtaatgcacaaagaacattttctgcgtctaaaagaagcaaaccacattcttacgaacatagacaattttcaaacaattatacaacatatgacatacacatatgtgttccgtgttaataagttacgaggtcccaagtagcttctggatatcattctgcatagggtaccaaaggagtatcagctcacaaagaagaaaaacaaataaatacgaatggcgcttgatagagggtcaaacctcaatctttaatggagaagtcgtcggggcatatcgctcaacaaccttgccatctttaccaacgagaaacttcgtgaagttccatttgatgccatcaccaaggaatccacctttctgtgatttcaagaacttgtatagcggtgcggcctccttcccgttaacatcaatctaagcattcacaatgcatcaagtatgtatattggaatatagaagtatttgttttgacatatatggaaatataacagtatctgttctgaagtaacttcaagttttgagggaaccagttagttcacacaactcaataataacttgataagttacagtcttggtttgcaatgtagggttattcttaaaatcacttgcctcttatatcttccgtatgacatagtgaattaattgaatgttttacagaagagagtaatttattacatacaaatctttttcacaaagaaagcattcctggaaatatgaaattgatctaaaaatattatctagaaaggcattacaattggtctagaattgagaggggggaaatccacattcatctgtacagagcaatgaacattgaaaacccattaatctaaacaaagctatgaacattaagtagacaccttatttttgcacttaaaatagtaccaagttgtaggaaaaaaatcaataacatagtacagcaagagactgttttacggaaagatggaaggactaggtgaagcccaccaaccttgtcaaaaataggaaattctgctttgaatctggtacaaactgtttgctcaatctcttcattgctgccaggctcttgaccagcaaattggttgcacggaaatgcgagtatctcaaggcctgaatgccatttataaacaacagagtgataatgaatgtacaaaagctacttttgagataaactgaatcaggattaaacttcaaaacagtggcaatgagcatacctttttctttgtatttctcgtacaagacattcaactccttgtaattggaatttgttaagccactacaaaagagtaaaggtgaagtaatgaaacataaatgttcatatagcccacactagaggagaaaacatgacgacatagcatttgtcattacgcaacactctgcctaacacaaatgtattggtgagaagaccaacaatggaacaagtgtgttggacttcaatgacttttatgttcgacagaatatgcgaggtctaaatcccaataaacgagcatatatgtcacaagcacacatataccaatcattgaaaaagaattagtaatttgacaagttcagctcaacttaatgaattaattcttagataaacttcaattttccaattcatgagaatccgagagcaatacgttaggtctacctaaaaactaaataaatgaaatctgatctgataagtaccattttgaggccacattaacaataagaagaaccttcccctcatactcgctcagcttcacatcatttccctttatatcctttggaagaaccaaacatcagctgacaggccgaatcaaagaaacagaatacggagtaacataaagagttaagtaggaaagcgttaatcactaagtatgttcaactgaaatttcgcacagtaatgttaaaccaattactactaataacatcggtaggatgtgaaagtccctatcagaactgacgccatctatccacactgtgctatgttcagagaaaaggtaaacttcccatctaaccttaatatagaataaagttcatctttacggtgacaacaacagaattaacctgaaatccaacgtcccatcatggcgacatgatccaattccgccaagaattacaaatattcccaacaaaaggagcaatctagggttcctggccaaagataaaaacaatcaccccccacaactaaaagcaacatctcactagactacatcgcatcgagccccaatcacggaaagaacctcctcatccaccctctttcaagaaaccacgagacagtatcaaaaaagagaaaagcgagacgccgtagcatggctaccttgacggagatgtcgtggacggaggtgggcaggtcgtcggccatgctgggcgcagcaggtggcggcgcgcggagggagaggagggagacgagggcgacggcgagcgcgaggacggcgagtgaggaggtccagatccggttgccgccgccgctgctgctacttgtagttgtagccgccatgggcggaggtcgcagggccgtcgcgattgcggagatgattagagcgagtgtgaacgcgtgggggtgcacgggcttcagttggttgactgacaagagccactcagctgggaagccggaacaaaatgtcttcgttttattgatttggaatttgtaatgaaaggcgttgatttggaatttgaaatgaaaggccgacgcagtgacagcagcgagccgctgaagcttttttttttttggggtgggggtggggggggggggttatgtgtaggtccctgtaattcgagtgagattgtcatggcgcaaaagcagatatggtccggtattcccttgttccccgtattggttatgttctgggagcaattgggatgtggaaattagtcattttataaggtggatttatacaaaagcttccttttagtatatcacaaattaagtcaaacataattaattgttcctacaggttaggcttgtggaaatgacgagtgatagcattcaatcagtaaagattctacgacttgggtgtggagacaagttataaagtccaaaacattcaatcagcttctatatatttgctttagtccatgtttttgtcctttttcttttcagaaaagctggaatactcccggttgaagaaaagcaaaactttctgggccatttatatcttctcgtacaaaagtcaaaatcacgttccaccttgagtctcttatgaaacctcaattttatatttcttttaatcatcagtaacatatcaaatagatagctacgtgtgtgcaaaattttattgttggatatattagaatcacctactagtaactgactagtcttcaactgaccaccgactagcgtctaggtgaatactggttaggaatatatttacgagtgtatgcatatgatgtgtatactcttgtcttttcccataatcgtgaaataaatatattggcatgttaaacgggaatggatttaatccctcaaagagatatcacctcctgtgacttcaatttaaaattttatttaagcctaattaatctgtcattagcaaatatttactatagcaccacatggtcaaatcatagagcaattagatttaaaagattcgtgaacaatttacacgcaatatgtgtaattagttttttatcgtttatatttaatacttcatgcatatgtccaaacattcgaagtcacttcaaatatattttaatcatttaaattttaaaatatattagaatattttaaaatacctaattaatcacttcaaagatattcaccttgagtctcttatgaaacctcaattttatatttcttttaatcatcagtaacatatcaaatagatagctacgtgtgtgcaaaattttattggtggatatattagaatcacctactagtaactgactagtcttcaactgaccaccgactagcgtctaggtgaatactggttaggaatatatttacgagtgtatgcatatgatgtgtatactcttgtcttttcccataatcgtgaaataaatatattgggggggggcagcgaagtcacttcagctgtgaccacgtgccgatagagtaccgtcggtagtgaagcattggtgcgttaaccgtgggacgtcaggagtaggcggcagatgtaaaacctagcccagtattgccgggccggcaacaacgacgttttaggaatcgtttttcctcttgggggcgttgtcgagccgcgccctctctcttgggtgggctgtagggtgaaaacctttgtcttggttctccttgagatgtcgacagacggcggcgtcagtgctcatcatcgcttttctctcaagaggaatcgtttttccttttgggggcgttgtcgagccgcgccctctctcttgggtgggctgtcgggtgaaaacctttgtcttggttctccttgatatgtcgacagacggcggcgtcagtgctcatcatcacttttctccctcgagatgttgtctaggaggccccctaaccaaaacctcatgaacaactatgtgtgctcttgctagacggatgtcctcttgtagcggcgccgtaatcaatgcaagctggccatgtcgacgggccttgcgggggagagctgttccatcttctttctcaccctctcccctccaactccaaaggcgtgcatagagttgaacgtgatgctcgctgctagaattcagcgtcgcgtgtggtcatggtgccgctccactcatgtttcatctccctcgcccaaccacctcgcatgtgcgccactgaaccctgcttcctggaggagagacaagcctccgcctccaccactatgcacttctagctgcttctgatttgtcaatcatgtctgtatgttgttatgtcattctccattcctcactaatttgattgctcacaccatatctcaatattataattaggtccttcactgctcgagatattaaacagcaacatcaaccataactatatctaatgactgcggatttccgaatcgttcagagctacatacacacatatgtgtgtgtgtgtctatatatatatatatatatatatatatatatatatatatatatatatatatatatatatatatatatatatataaacacacactctctctctctgatggccatttacaggagatgtggaatgatggagaagtgccgatctgctcgtgctgcctatattccacacaagaaaccaaatcactatatgtaattccctatggctttggttgcagggttgcgtctattttctctctgtatttctgccttcagcacattttcttctctaatataggaaccacaggatgtgatgaaagcggcatttttacttctagactgggaaacatcattacatacgtatatatcaaaagttaaactagtatgaatgaaaacaacactaaaactttttgaactacaactatgaattaaatgtagttatgcgtcataattttggcaaactatgaattctctagttgtatacaagacttccatcggacgaatggttctatcagtaacaaattatttatttcagagctacgtccttggtacagcacatgtgacttcgggtttggtgcttataaatttgatattttttagggtaacattgtgttcatacaataatcgccataacttgcaatgtactttctatactgcactcttcaataattgcacaaatttgtagagaacaaatgtagtgtggattgtcatcacataagtatgtgcatggctgccttcttcagtccttgcttgcaacaagtcggtgccagaattctccgagagcccaaatgggatataagttgcggtagttcgggtaattgaagtaaagtgaagaattgaagcatccaacatgttccttcaatcaaagccaaatataaacaagtaagatggatattaagccaaaaatacttaaaaactagtttatgagtttgtgctagctttggcaaaaaaaatcagcactggatgaaactttttgcgaagcttacatctgaaaattgctttttgttggaaagccatttatacattttcacatgatcattcaagttgcacaaatatatgagttgggagcatatttcaatgctagtaatcaatttaattgtcggaaagttcaatcaaacttttttttcatatgcattttgtcttttgtaaacgatttgtgcctactctacttttctactttcttatctaggacttcgatatacaaaatttgttgtacttcaattttgttattttaatgtgttttgtgctctccatctagagaaaaaaaattagtggtgaacactctgcaactccattccttttcattcaacgaacaaatatctgctaactagacaaattaaattgtacaatccatcttataaaagtgcattcagaacattaatatcatcccaaaacttacttgttgggggaactctcctgtttcaagttgcatgctaattaattgttttgcagcacgatataatggtgttggatctcgttcaatctattcataacattaatggttaaaaaatcacatgaatatgagaaattgttgtgccaaatcaaacgaacagttgacaaacagacctgtccagagtaaagtaaagctaacattgccaaggaggtgttcactgcatgaggactcccactatcaacatagacctgtttgaaatcgttgttaaagtaatggtagacataaatatgaactcaaactaagcacataaatatatatatatagtaaaattaactggggcattaactatatatagcaaaactattcgacactacttcccacctcagtcaacccgcctgctaactccgccaaccacccatcttttctcagctctaatctcgcggaactatgtagtaacacgatggccatcgtgcagtaaccttctgtttgatgtgttgtaacaacactcaaatatatttgaaatatagtcatgacagatctacttctgataaacacttttttgctaccatgatatatcacatgagacatattgttcttcaaagcttagcttttttggaatttgactctgcacagatagtaatactatagcattacttattagtactgcttgctgtacgttactacaatcccatcacgatgttaatgtaaaagtgttgtaaagacaataagttttgtagtagcaacgtgtcttgctgcaatttttgggtaatgtgactgtataaacatgtggtaacgtgtatcggccaaacagtaacacttctacttttgtgcagtaacaagtatgtttagcatgtgagatttttaatccatacatttttgtttcggttcctagtttactacaatttcaccacgatgctactaccaaaagtgcagtaacatcttatatcttctgcagtaacgtgacgtgttactatacttctacaataaggttactattggaacatagtaacatgtgttatgagtttcataataacatatctattttgttctacgatggtagtgaaagagattagaatcgatcaccattttcctttctcacaaagtgagataaaaaaacaataatcctgaaaacaaatagaatcaatttatggattggttagaggaacatactatgaactatgagatcatgggttcgaatcttgaatttaccaatttattttttattttctagaaaagagaaaaatataaaaaaggagaagggaggggtgcgggaggagagagggtgatcgagaaaagagaaaaagcagaaagaaaagggtaaagagaaaaagcataaaagaaaaataaaagaaaaggaaaagggagggcgatcgagagaagagaaaaacagaagaaaaaaaagagaagggtgatcgagaaaagagaaaaagcagaaaagaaaaggagaagggagggtgatcgagaaaagagaaaaagcagaagaaaaaaaagagagaagggagggtgatcgagaaaagagaaaaagcagaaaagaaaaggagaagggagggtgatcgagaaaagagaaaaagcagaagaaaaaaaaagagagaagggcgagaagaaaaggagaagggagggcgatcgagaaaagagaaaacagaaggaaaaatggaagggaggagggggcacgagagtggagagtgatcgagaaacagaaaaagaaaggaggggcgcaggagggaaggagaggggggcacctgtaaggggagataatgatctagttttgtacatataaaaaggttggtgtactaaatgtattcctttatatagtagtaccgactgcgtttttaatttaaagttggtcataccactctaaccattaatttttataacttatgtagcatactaacttatacaacgtttagatagttaaactaactatgttacaatgtactaaacatattcatttatatagtagtaccgactgtttttttaatttaaagttggtcataccactctaaccattaattttaatataactattgcagcatactaacttacatagtgtttacatagttaaactaactaggttacaacaaaattaatatttacctcaatttcacttgaactgtagtgctcaccccatccacctgcactaagctgctttgacaataggaacttgcatccattcctgatagcttggctgttctcataatttctgccagcagcaattagtcctcttattgcaaagaatgccccataggtaaagcatataccccatgtcccatacctattgttgaaagatatacaaatataatacttagtaaccatataattcaaagcgtattttgacacacacctagcattgaactttgcat

SEQ ID NO: 22798 - DNA, 30528 bp, Oryza sativa
  unsure (1)..(30528): unsure at all n locations
tttgacacacacctagcattgaactttgcataccatgagccatcattttgttgtttgttctcaatgaacattacagcattcttaatacaactttcaatttctacaccacggtaccctgggtataactctgtaaatgatattagaccttgaattgctgatgatgtgcactcgacatgtctgcatattggccttatctttgtagttagattccaaggtaaaggcaaatggaattattataagatatttgacacttacggataatcaacgacaatgttccgaaaactctctgaagggttcagaatctgtgttatcaattacattcatgttagtacatacatagtcatagtatgctaaaatcgaaggactctaagataattttgaaatcaaaattacttgaagtatatacatatgaaggatgagcaaggataacatgatcatgatatcatagtcgagaaacgcatttgaccaatccgtggaatttatggtttgctggtttaacattgcattttgacaacataataggagtgttgatagatgcagaaactccaatagctagttatgaagaatacaatcatggatttgcaattaacagtggtaacttgaagtaacggtcatttgaatctattttgctagaccttaagttcatgtttgtctatcttatatgttggtgcatgtcaatgtcaagacattgaaatttgaaactatatttaatggtctgaacatcaaaatccagttttattcgttacaaccaaatagtgtttgaaatctgaaactgcagaatgaaagatcctttgaaacaactagtgtttgattgattacaacctctgtaatttttttgtgtttttcctttctttgtaaacaacccttttgatatataaaagttacacggctaggcaaattccaagaagtaattcacctaaaaaagagtctagtttcatacatagatatttgtctcttacataagtttgcacaatatgatatttaaaattacagtagttaagctagtacgatgagcctgtacttattgtgtatttgacaagtaataccttggtccattagtggaaacgatgcccattttattgtatatgttaattgaattagtcccatattgagagttaggtatgttggacaacatataaacacaagcattccaaacataatacccctgggttaatcatttttcacaccaagagatcaatgatgaaagtgtaagtggacttttatacatatgttggtgctggggtgttagcggtagtggagctagaaagatttttatatattgtcaatttgcttatcaatactaaaatttaatggagttctcgcagcagagccccgcgcgagggggtgggggggctgggtgttagtgtgttacgcatattgtgattgttaatgacgtaaagacacattttgctttcctaatgttataaaatgttttttggtgcatcatttgctttcatgtgtgttgagtattcttcatttttatctcacggaaacaatggaatgttaatttataataatttaggcaattgttcaaaatgtaagccaaagatgtgcacctctgtccacgaagctgttcttgtgcattcatacgaggagaaggtaccatctttgttctttgtgaaacacaaagaaaagaaattattcaaaagagcatgaaaacatcagtcaaaaagaaacattatattgctaagataataacttcacgtgaaattaacaaaatttaacatcatatttacacaactgttattttgtttgagaaagataacaaataacgaaatatattgacaacttcaacaactactacttttgaagaagtaattacctatccttttttattttatcttgattgaattgttctaatttctggttcttctcgaatagtaaggatacatcattgaactggcaacatatattataatgtgcacttaataaagttataatagaggatcactatcggtgatgtactataatttattacatgggaacaatgattattattcaatatatatgttcaataattttatattggtccatcaatctctcctacaagctagaatcttggtatgacttaaacataattgagctgttcaatatcatcgaatcttcttatgttcttttttactttatttcatttatgctttctctcaaggaattacaatacttagtattagtgctctagctattactacagcgttacctttttcatgatttttccactatcaaaaaatactttgtcactgagaggcctatactcaagaagagctatctgttcagaattaatgaacacagttcgttgtgcatcaacaaattctcattgaaatttagataagagaacacatacattagctaatactatcacacacgtaagctgtaaatttcttttattgtcttaagtctcttttaattatagatgaccacaatattaataaactgaaaaaccacatttcatttaacatgaataaaacaggaagaatactccaattgtatagtcataccgaaaaagacagcaggcagtccaccgcgtcatacaaacttttttcttttattggatcaccaacaagtttaggagaaatctttgacagccctagtaatgcctataataggatataatataaaatgtcaagaacagacaaaataataattaattaatgattattaggaaactatttgaacaacggattgcgctttggcaataaattttcttcaacgtaactgatggcgtatcgatattccaagatcatggcatataatgctcttaaaatgaaactcgacccatgggagagagagatcttcaaggcatttcgttgatggttgagtaaaagctccaaaagcctacacctatctatatgggaacactgttgtggtaggcagagtcttaatgcgtactttaggggaacacacaatgaggattcgtttttctttaagaaccagagtttgaggctgataactggaggacttacaaccacgctaaacacgttctcctcataatgctatttttttatgcttagatgttggactaaatatttcttgcttctaatattataagcaactgattgacatgttagaactagaaattgtacgaacagaagatattttagttaaaatctctccaagaaggccaaaaattgaagtaaaagagataatttaactgttttcaccactaagaaccatatccttttatagagtcagaataaggaggatgataacaaacttgtatgacctgaagtgtttctcctgtacaatcaggaactgaccaaccattgtctgctgtagaaagagtccatgaaccttttgatctatggcgatagaaacttttgccattagggaggtcatgaagaaccttcaagtaagaaaacaattttgagatttgtttctgaaagtgttcataactttccagttgcaaaaagttcaagaataatgaacctgcgaatttttcaggaaaccataggctttctcaagagttgtactgaactcatctactaagcccgtagagcaaatggcttgaactataaatgctgtctcccatgtctgacagccatcatatacctacgtacaatcaacacaataacaagatatgtctgtcattacacaatgcttgatcctcttttgtcttgaaaattaacttttgtacatactcatgcatgcagttgctaccaaggagcaatataaactttgtcaaaatgagattcactatacaaaacgccacagcatacatgtatgtcgatatcatactagaaaattgacgtgcccgttgggtttaaaatacatgatgaacaaaacaataagtgcatagtagatctattggtttataacaaaaacatactatataagaatacataaagatttttacatgaatacattcaattcctctgaaatatttacaaaaaccatacattccgcagaactcttcaatgtttgttttttttttttttacttttgtgtatgtaaaatggttgcaccgagtagtactatatgcttgctagcgtttatcgggttaataagtaaatggttttttaatgaaatttgcacattttgtatttgagcacttgaaatcttttttttttttgaaaatgcacattgtttttcttttcagggagaaatacatataccaatataaattcattttaggattgcgttttgtaagaacacctaataacaatgaacaacactcgcgagagcgaattgtaaggcatatatatgctaacctttaccatatgctcaagatatagtactgtgaattttgatgtattatctaattaaaaattacatttgtatgtgctatgaattacttatatacatttaaattcactacttaatcttaaaattatttttagtttatttttattatttttgggcacttttttgacaaaacatatgaagttaaatactacttaaatatgtttaactatttgccacccatacattaatgacatatgggccctcacgtgtctatgacatgtgggtctagtggcaacaattgattacaacatctaaaagtgaaaaaaaagtaagaagatgtaaggctgtgtttagatccaggggtgtaaagttttagcgtgtcacatcggatatacggacacatatttgaagtattaaacatagattaataataaaacaaattacagaatccgcctgtaaactgcaagacaaatttatgaagcctaattaatctgtcattagaaaatgtttactgtagcaccaaattgtcagatcatggagcaattaggcttaaaagatttgtctagcaatttacacacaatctatgtaattagttattttttcgtttatatttaatactccatgcatgagtccaaacagtcgatgtgactaggtgaaaaaatggagtgaacttattttgggacaaatggagtgaaaaaatgattttattccgggagggggtagtactcactatttttaagaggccctgtcaaatatagcattttcaatgaaatctaatataaattaaataaaattggttaaaacctataatgagaaataggctaattagctggtgtgcgcctatttctagtcgaatttgctatatatttgtcgacaaattttccaccaaaaatttgacagatgtaattatagtacaatcgtagtgtcattacactgtaacttgcatgtaattacactgtaactataatgtaacatgtatgtaactttcaaaaatctctccataacatttatttcggtaaaatggaggttgtgagaacaaattctttcacatatgtgtgtgatgtggttgtttttcttcctcaccagaacaaattttgtaatagatctaacgattcaaaattacgtgaaacttatatacaagttacactgtagttatatgcaagttacagtgtaattacactacgattgtactataattatatctgtcaaattttcggtggaaaatttgtcgacgaatgtataggtggtcccatttctagtctattctcactactctgttttctttcatcccacatgggcctggctagcccgttcaattaaatatggtgcctggcccatgatgttgccgagtcatgcaagcaaccgtgtgtatgcgtgaagctcgttcagggcttcgtcgaagcttcgtcgaatcagcgtgtgtgtacacgagtcaaaaaaggattgagcacctggaccaatttgcagctggcagaacaggcaacgtgaaaataatagatagatgggcttgtatgcagatcgaatgttcagagaatcatggtcataaatgtcagatgcaaaggatttgtttatgtgactagattcttaatcctaaacaaaacataacaacatgagaaaatgatgtagtatgttgaggaccatattttaaatgctgtgaaaggtgaaagtattatcatagcatactgtacttttaagtgtcatctatgctatttacaccgaagctaacttaatatggttcaaacattgatattaattgaaatagaagccaacagggggcacccaagtagcctagcgattacagtactcaaggaacatctctagatccttggttctactccccacaggagcgaattttaggcctagttaaaaaaagtcattcgctagctcctcataaatgcacgtgttaggaaatgatatatggagagcgagctctcgtgtagaggacaggaacctcaaagcaagcgttaaggaccaatccataagaggtgactcctctcgtgggttttctcggctggtttggttgaggcttcttcttcgtgaaaaaccgtgagggtggttattctcctactggtcgagtttttttttaataggggcacccaaaatttttaaattttgtttcaataatataaactctacaagctacatgactgcaagataatttgattttctataaaaagtgctcattctgaaatttcatacaggtaataatttcatacagctcatctaggatcgtgatgttgacaacctgtgcgactagccagaaatgataaagcaatgccagcatgcagcaatgcagcatatttcttaaggttacaaaaactttagctgcaaccattttctgacattgatatctgctagagattgatttataacagtggtttattgacatctacagtttaacttttatcttcactcatataattcaaagaaatatagatctgacattactcacttcttccaggacatgttggcttgcccacgcaaaaataggaagcgagttaataccaattaggagctgtttggttgcgtcgttttggcccgtatcagttcccaccatgaatagatcatgttacactcgtttgttacagatggaccgtaatcggatagcccgcaaatgaattccggcccaatacaaatctgattacgctccaagacgggcggaatgcgatatcgatacggagaggagagcgcgacctagctcctccaaatcgagcaccgctgccactactccctcgcagcgcacgcgttgccggcgccgccccctctccccacagactctgctgctccctcgtcttgtgcgctcctccaaccaccgcttggccaggctggcgcatcgatgctccccacctccaggagttccgcctccagagtccctcctcccccgtccaacgtgcactgccacctccccagagttccacctccttggcgattggatattgacgggaagaactccatggagactggatcttgacgggaagggcgaggacgtgcagcaggaggctagtcggagattctgctgctatcaactacatccgtcttttgtcgttgccgccgtggaatgaacaccttgccggtgagaaccctccccctactgaaaccacctttttttatgatgatatacttgtgatgctggtgagtggtgatcttgtgatagtcttctaaaaaatcatgtagtagtttatactagtgaatcacatgtgttcctgcctcatatatgtttgcttcataagttctgatgggttatgtagaatatattttcctcaattgcaagaaagttgaacatcagtacatggttttttttttagtgtagggaagttggaccaactcatattactatctagattttgagaattttgattttcattactgccaggtgatatattattttgcacaatatcagatcggggaaaaaagttttgcatattgcctgtttgacagaatatgttccagtaaaacagcacatacatgtaaatatgctccttgaatggatgcttgatatggtgttctggtgaattacttatgtttagcaacaaaaataatttgcaccgtcttttgtttgaatggtagcttgatgtattatgtgtgctagcaggatatattctgaacatagggttaatgcttttgttttatatatttgtagagtgctatggctcgccttcccttaagtaccaaaacgcggagaagaaatttagggcttagaaatatgatgattgctgttatacttatgtattattatgttgctgtactgttcttgatttcatataagagaaaatgttggaaaatagagaggaggatcagaattagagaacttaggagtgaaagaccattccagcttattcgtgagagtgatattgcttgtataagcgagctccgaatggataggaggacatttcacattctatgtgacatgcttagagacgttggaggtattgaggatacaagaaatatgtcgttggaggtatcagtagcttcattcttatatatactatctcaccatttaacgaatagaacaatagggaccttttattgccttatatactatttgtctgaaaccatgcaccagtataatgcatgtatgggtccagctgtccagctcaatgccataggaattaacctacgggagcataagtagtaatatcatattcactccaaactactcctagctggagtatgtgcctacgcctttcttgcttgcttgcacctataaaaaaggggttcatgaaaacagagcttttctacaaattccttgtgcagcccctttcctaaagggctatggttttttagtccagagattaaaaaatgctacctttttcttaatttggtatgatgctgagcattatatattctttcttgtaatgtttctttcactaatttctgaattttttttgttaccaaatgaggcaaagaaaaactgatgtgctggatgttaggcatttgatctacaagatgttcactatctatgtttgaaacccagaattccatatatgcacaagtcttggggattggagaccatatattttcactatatatttcctatgtgctaaagatgtttatttccaatacttcagcttttatttgcttgaaccatgatgatgtacatattctgtgatcaaagtgctaccctattcaacgtcctagaccttttgtttggttgtggaagacaaaatgtgtaatgaaaatcaaagtctttgcctggttaccattcactgacagattaaatactagagataagctagacagaagacactgtgcaaaagaggatgatgatttatcttgcgttctatgtaatggaggccacagagaaaccaggttacaccttttcttcacttgccctttcagcattgaatgttggcagcatttcttgggatttcgtgggatgctacactggagtttttctaaatgatagtgcttgcaagggttaactttggtaggaagggtttcttggaaatctgcttcattgctctgtggcatatctggaaaaaaggaatgggctgatttttcaaaatgttccaccatcttttcagtcctggagaagcctattcaagaatgagattcttctgcatatgtgcaaaatgaaggaccctatgaaacaaatagtttttgattggttacaaactgtataattttacttgtctttgtttcctctccctgtaaatttgtacttatattctaaataaatgaaaaacactactaggcaaagccctggtagtacttccagtaaaaaaaagtgttgtcctatttttgagacaaaagtactaccctagcttatttgttaactaatctggtagtttcactaatgtcaattgttcatccaatcctttattgattgaattttgaaggtgtgccattgattatattttgcaaaatattatctctcgtcttgaattcttgctgtcaaaatttgcatccaaatagaagtctccatattaagtattttcccgttgtgtatcaattttagaatttgaattctcagccgacacatgttttgcttgcacctgctagtctgttacctagctgcctaaccaaacagcgggaatgaattggtatccgttacaacaactatccaaacaaagcacgtaatcggtgtaatcggttaccggcagaagcattcccaattacgtttacgttaacgtgattgaacctaactccaccttaatgtcatagaggtagagcaatgataactatgggtggtcgacattacgttctctagtgtagcaaacttagaatttaagggtggttattggtaatgagtaaaatgattacgatggttggaacaacattgcaagggccacggagcttggaactccatggcgcagatgtggcatgcatggcaatggcagtgatattttctgttctgaggattttgatcaatatgtgtgggggaggtggctgcggtgatgtcaggtatggtggcaaggatgacaggagtaatgataaaatacagtccagagaagatgggaggcactggggaaaataatcctgctaatgtggacaacatggacataatcctactgataacatggacataatgacattgttggcttgcagaaaagtatgtgggtgaaagcagatgggttacgaaggtcagtggtgttgaattccatttagccagtatgcgctgatgaacattgcttcttgatgtcttcggtactggctgccaatctgcgtgatagatgtcgtcaccaggttcggtttcttgttcctgattctcatttactctcatgattatctaagaatataactaccatcagcaaaatctagttattgggtaggacatttagttgaattcacttgaggatcagtctgattttttgtttaaacaatctcaacatggttgttagactgagttgttttaatttcttggtttcactccaaatgcagagtcttttagtttcttccaattaaggtgatttaaatttcaggttatgattagtcctaaaatcgaattcaagaactttgaattaattataatccaaaactcagccaagcaggaaacatgtgattgtttcagctattcaatgaaagttcagcaaggaaatactagctttccatgcatgcaatgtttaatttccaccagagcagtatatatatgtattacgaagtccactaaaaagaagtatatatgaaaaacataaaatgagcaatgcatacacccaactaagaacaagtggtcatcacttagtctttccaaggaaaaaatatattcatgtgatgaccaattatgattaagtgaaagcaagcaagatttggttgttagcgacatgtgcaaaaaatgtgatattacctcattcatgatctgaaatggagctgaccaggacaaaaatgtgattttatattgatttaggcatgaccaatttacagataaagaatgatttaaaatttgttgagtacttacataagtttcgggatacgtgcaaaattctcaaagttcagggagtaagtaacagccccatggaaatttagtgagacataaattaaataaataaaagttcaattagaacagttttacaacagatgcaagcagccaaaatagtacctgagccttcatgccatcttcagcaagccatagaaagtcataaatccttggaagatgcctcttgaatgcatctgaatttgggtcttctatccaacagcaaatcatatttaatgcctaatattaaagcaaatcggtcaaagcatagtgctgaattgtgaattaataatgctaaatcaacaaagttagtaaaggatgataattaatttattagagctagaaactttctaggttctactacattcaacaagttttgcggagtattttaaacttgttataatcatcatgcttctgttattcttgcctatttattgtgtaaatgtccaatatttcactactctccacacgttgtaatgattatcagattatttataatatttgtccaatgagaaagtctaagattgtagtcacggttgcttttccgtcttctatgcctatatattattatattacggtacaaatgcatgaaaggtattgtgtgggttcaatacgtcatttattaggtcatcaaccttggtccaatttttccagccgttgctatatgtctatattttgggccctcttgtcaagtaggatggtttatgttttaaaagtttgatagaatctattcataaaagtcaactactatctgctctgtttttacttgtcattttagatagtgacatagtcttcgttgcatatgtttcatcactactttttctatataaaagctattaaattataactatttgaaagtgtttttcatgaaaaatatatgtatgattggagggtctagttgtagatgcaagatttcagaaacatcattatattacaggcagtaacttccccgaggaaatatgtatcaactcaacaactaaaaccaaatgttgtgaaacaaactgaaaatttactcacaagaatgcagctggaaagttcaccatatgctttttagtcgcacatgctaacatgtgggccccagctctgtaaattctcatttcattccagaaccctacccccctccccctccctcgtaatcaaacagagtctactataatacttcctgtattaattttagattctagaagaatcagtagaagaaatgtatgaaatttacttttaaactgtcgattaaatggactatcgggatgtgtcgaggtcatcgagttgtgcgaggttttcatttggtttccttgagatgcatcatggtagtatatgttatttttagcaggtgttaatgtgtcataatttcttattggggatgctcataaaaatttgaccatagggtgattttgttagaatttctattgaatctcattgaatctcagactcggtatttttatatgtgggtgtgtagctttcgaggtctaagtatagatgttatatcagaacctatagtaggccaccgcacttgtgagccaagtgactacataatcgaaacatagagagtaataccaaaacacttcctttgaagagacaaaaatagttctgatcaaattaccttgtttattgggcacaaacaaatgtatttggtattttcatcctcgtagtagatatgtttcataaggttgcgcagcgatatctccctcagcttattaaatggccagacattaaacattggatccacatacttgtttaaatatgtccacacaatatcttgtatccatgaacaaggatatcgaagatcttcctgtaccaacaaaagaaacatgttaatttcctggttatttaatatttctttatgtaatatagaaaatgtttggtgttttcttaggtcaaaaaagttgtatataattttgtttttgaccgttctgatactatgtcaccggctcactgcactatttatgccagagaaagcataaataaatgaaaccacttcataatttgctaggtaacatcacaacgtaaatataccacctcaagaaaattgggttaggaaatgccatgatatagaaatttgacttgcaagttaaatacaaaatgacctctgtgctctcctcttatgcttctctttatttctgttttatcatggtggccgtatggcctacctgtaatcatcagttcgtcctcctctactgctttgtcttctccaatgtcaagccatgaagatccttagctgatctcccccatcactaactaaccttctaagttccaagcactacatgttccaacatcctcctcaatgtactcttccattccccccaatcccccaccttcaccgatccaatcaacacatcgttttttgggctatagcaagtgttcaatggcaactccagcaatatcatcaaagcagaaaaccctacaaagattgtggctatgcatattcaaacaaaagaggtttcttttgtatttcttctgttcatctgtagtgccggaaccacagagtcgtgctatcggttctcatctactcttccttgcctccagacttcactgaccagatttgcggacgccaatcttgagatatcaaatggctcgcttagagctggcaaaccgcactgttttgcaactgtattcataagatgccttatttggaacattgtttttaacttgcgaacattttcttttgataccaggcaaatttgctgttcaactggaatagaaatatgtggcaagtatatagtacagtagtattgctaattaaatgaattaaatctcaatcttcagtgaaaaaattctctactcaaccaaaattctttataatgtactcattcaactatgaaggaagtaacaaaccttggcacagcaatctctagccttcttccagtcaatctcactgtatggtatgttgtacaactcctctcttatttccaatatagttggagtgattgggccgacaaactttttcccataaagatatgccatggacatgtaaatcatacggacaaagcaccaaaatcttgctgtggaaaaagaaggctcgcttcttaggatcaaattaaaaacgagaactttattactccctctgtatatgagtcatattgcaggctcttataccagggaaaacttgttttttaactaaaatatcaataactaatttagtactacttcttgttgcacgcatttaaaacctacaaaagtagagatactaagcgcaaaaaacatttcaaaaggtgaaaaatatgtgtgctttacattcttttacaaacacttgaataaatatggcttacattttttttatatggagggaatattgatctaatgctattctattttttttgacatcaagcaaaaccactcggcggaaacgaaaaagcaggacccttgggcagaagccttagccactcgagtgcgctgacgctccctacctcctctaccttgccgccgcttgagtgcgccgccggaaaacagcacgggtgcaaagatggcggcgtggggtgatagaggcgatggtgccagctgcgttgttctcctgatccaataatcgacttatcagattcgatgtctccagggactagctccggaaggatgggtatctgcgaaggttgatggcaactctgtggttgcggccgagtgaaaaaaggatcgtggcccggtgatcaaggtgcagccaaggaactggtggtggcggggatgtctgggtttagagcagatccggttccttgacgtgcaggtgcagtggtgtcacagtgaggctatgctactcatatgtcgtccctgcagcactggtgatcgccaccatcatccctcatgctgcagcatgccatgtggagccttactaaggggaggttcgctcgtggcaacaacggtggctggggtggctgaccattacaggaccttgctggaccgttgtctcaggcggtgagtatggcggtatgtccatccttattcgttgcaatagaagggagtagcagctttgagttatgctggcatcgaggctcggtgagctggccgctggccggtgacagtcgacgcctcattggtgtgccttatcggcagagcggttttcttttctagaatttgtcgacagccaccttcttcccacccctcgaataatgattgtctctccagcagctacttctcgcaacgatgttttcttcatcataagacagggacatctagatctgcttgtagaccaatgtaagcttggcttcaattcaaggtaccggttacatcaacatctctttcatctctagatcgaccctatggattttgggtgtgtgacttttggcttttcacaactttatctttgtatggtatcgtgtctacagaaggttgcaggaagtgatgttcgtggctgattgcaattgtgctaagtttggaaggtatggtggcactgtcttggaatgaggggagcaacaacactaggggcctcgtttaggtggtgcttgttgctaattgggttgaatccctaggtctggccttagctggttgtatctggcaatggtggttttgcatccttcttgatgacattatctagagttcatagagttttcataggcgaaaacctaaagtctggtcttacttgtttagagcataacaatggcagcacgtgcacgcgtcgtcctctttttggaggcattgttttatgggagcctttgtggtcgtccaagtgtttctttggtagagtacggagatgaagtttacttgtagttgtagacttatgcatcacaatttttgtagttgtgtcgccctttttcttttcttttgtaataatgataggctatcctagctttgcagaggccgagggtggtgttagaattactgtatcctcctgacgtaatacctaagatcatgtgaaggtaaatgctattattagaccatccaccatcatttaaaaaacattcatcttaatttttgccagtaaaatcaaaataaaaggaaataaaagaattgtgagaaattcaattggaactttagattaatgcaagaagctaatgaattatgtacctggatgtattggaagaaaatgcggcaccatccataattcaggaattattgctttgtttcctgaccaatcgtatacaccaatgacctttgattacattgaagattagcttgtattactaggcccgtatatttgttcatagatcttaaaaatgtttatttggtcattctgaatatttcaattaagtagtaaatatatgtttttaagcatatgctggaaatttaaaatagggtgatcattcactaattggaaccaaggtaacaattttgattcacctctatcaaagacagctaaaaataatattttttacattatttcattgcataccgagagccatatctttgcccattgaggtgccgccgttgcgcttccatgagataaaatccacatacgcccttgggctaatgcatcgttattatgtagggcctcaccaaggagctttaatgtagcatagttcaagcatgagccaaacatggtactctggccaagaacctgtgtcccccagccgccatcttcattctataaacatgtattatacatataaacaaaattcaatttacatatttaatttaaaattctatttttattgaaattaaattgttatcaaataataacatgcctgatgattgtaaatgtatcgacatatctctcgtttatgttccaatgacaagacgacatcgagcgttcccgtaacatgcatggagaatatctgaaaaattacatcaattcacaggatgtatgaataacattttgaggattataaataggacttaggtgccatccttattcaaaatccaacaatgttcttcatggattccaaagaaagcagccacctattcaaacccaggtcaatttctttgtccaggggtgttctagttgtccttcttatttctatctctgaaacagctgaaaataatgaaatattgcaaatattgcagatagtgttctgtggcaaagaatcaatttttttatccacgggcaaacctactttttagaagtcctccagcaaataccacattttagagtgttgtgtagcaatttttccttcaacgacagatcaatatatacctttattttcaactaagaagctagcccacgtattcgcgcgggcatgtgttatgggttgcgtttaaaaaacttacatagacaaaatatcaattggatgacaccttcaatgttttataagaactatttctccaaatgtttcttcatcaacattgcttaaataacttttccaaattatttgatagcttttaaaatatataatatttaataaatccctataaaataattatctatgatctcttcattgtggagttagatttagtttgtttaaaaaacgtgtctaacaaattatgtatatattaaaaggtgttttgtcttgtttaattaaatgtttaatggtttctttaaacaaatcctaaagaactatgaaatagtatgttttatttgtaccatgaagttagccctccgtttagttggtttagattgttgcaagttgttacatataaattaacaaagacatatcgtacacctcgcttcctttttatatacatgatttatactactttttaacaagaaagtacctagttaaaatgaatccaattaaaaaatgctttttaatagtgacaaatataacttttcaaccaactacatactactattactggggtttatatatgcaataatatgtggtaaaacttataatgctatggtatatgacggatgtaagtccattaatatctaaccatttaaaaactgttataaaaatagaacatgtaatggttggtccaattttagtgaaaagtaagaaccgatttattttcaaactcattacattttttttccaaatagttcaatttagttccgattgaaattttctattttctgttttattttataccagttaaaactatagacgttatggatctttaaattgttggtgtaattatgaatacaacaatagttagaatagaaatcagatgtgtagcttgaaaattatgcattttattttttttttattatttctcgctatataaaatgtggagtagagtggagagcttcaagtcgagaggcaagtggacacgtagtgttatgttctgcgcatgtgtgggggagcaaagcggaggatttaagtgaaaaaccaatgatcccatttttgtcctcggaatttataataacctcttttttaatttttatgttgtaacgcgtggtggcttaagattttactaaagtatttcaattggttaaaaataattgatccacctatttaagtggaaactaatagtcatatgtttttcttataatttctaagcttttatttttatttaagacgtaaaacatgatgtcttaagtgtgctagagaagatatacaatgactaaggtgatataatacttattttcattttttatagtgttttgttctttttgctatctggttaccatgtaatggattgacatctatgttcaaatgatgtatttttatttttataccgtaaaataggggtaatatggatattgatttatttattcaattataaataaaaaatcaaaaatactaaaatatatataactaaaaattataatcatttagctttataattatttattatttttattaattagttataaaatttaaaagatgaattaactgaatgcaagaggagtgaaatacagagttgaagggcagagagtatgcacatattataatattttttataggttatagtgttttagttgctattactttattaactaaaaatacaataaattctttattgatttattaaaatctaacctttttactcatcctttcgtataatatattcatagtagatatttaaaatttgaacagtataaatataataatgctattttgatttattatagtgttagaacgggggagtatttttctttaacattactcagagtttaggttcatttaactttaatcattatagatctaatttaattattatcaagttatatgcgatgataaaatatatatctttgtttttatataattttataattgtttgaatcacacgcaaaattcagaaaacatagcccaaagtgacatatttcattttaaagctgaattacagtggatataaaataatccaaacatataagtggatcaaatattagtatataatttagatgttatgttgcttaattgcttaacgcaattccttttgtttttctaactaataaacattaaaatagaagaaaaaataggtgaaaaagaaaggaaagaattgagggaatagggggacgtacgtaacgtacgtatatacttgcctacaggtctaggtgcgcccagtatttgggagatgatatttttagaagataaatctaatggttataaatagtgggtccgcgaaattaaataaaaatcaacggtaagatgttttgcctttttttagaaattttaagaatttttttatttttatgccacgtggcggcttagaaacgtttgtaaatgctatgtggtggtttaggagtgtttatagtaagtttaatggacttttagtatataatagatagatagataacagatagatagatagatgaatagaataaagtgcataccaggagtggcataatgaacaagattccactgtagtcaccaggccaatgcccatcatgtgcttgcaaagtcgaatattgattaagagctcgtcgcaatgaagacaatatagtttcttcggtaacattttgattatcttcaactatgacagccgaaagatctggttgtagatgccctaatttggcatactgcagagaagagataccagttaacaaaaaggatcaactgtctgaaaagacttattagttttgtaacaaattatgcttccacgacctcagtaattcctaggccctttatatagactgaagatttttttcttataaaaactcggaccttattgggccaaaactaagaggtcataagataagacactatcaatcccatgcatttgagtactctatcgatatttatatggactatctatatttatgtcgccgtatttttcatgaaaaaatagtcaacacactactagaaaacatcaaataggtgtcgacacttatnnnnnnnnnnnnnnnnnnnnnnnnnacctacatataggcactgagtccctattctgcagtagtgtatttacgatgtaaatatcaacaggtctgatacttgagtgcatgcaatgagaagaaaaaaatatcaacaaattaagttctgcagtagaccactaatccactgacctagggatgaaaacggagcagatacggacggataacgctcataccatattcgtttttatatttttttaccagatacgaaaatgaatacggatagctcgaatacagaaacaaatacggattatctcgattacgaataagaatcgaatatgatcggacacgaatacggaaacaattttttctcggaacacgaaaaccaactcagcttctaatagaaacaaatatcaacatatataattagctcattttatataaaatgaagtataatttataaatattttttacaatttaaataatattaatacggtaaatctaattggagaggcctctccagttagtcttaaccagagacacccacgtgctagtacttttaggagttttggttgctattagtatatccaatagtgcatatcttagttttcttcttatagaattttgtcttaaactagttatccaatctacaatctgattataccattacgttcgttgcaattaaatctttacaacaagatcttacatgattgtattacgataaaaaaatatttatatttataaattacttttattatatacgtaagttacttttatcatatatatataagttacttttagatttgactaaattacttctatacattcataatactctaagttgattatttttattattgtttttagttaattctatattttgtggactttataaatcttctatacactttacttgcgaatttactctacatagtttcttatttcagctcactcacaatttaattatttgggcccctaattatttctactacagagagtaaaattactccctccgtttcataacgtaagtcattctagcattgcccacattcatatagatgttaatgaatctagacatagaaaagttacattatgaaacggaggaagtacttctattgcataactaagttacttctgttgcatataattacttctactacagaaagttatttctattacatagctaagttacttctattgtatagctaagttacttctacaatttaaatacattacttttaaattaataaaatatttgaatatatccaatatggatcttgcattgtcacatattttatgtagagtataacgatgcaaatatatcttgaaaataatacatgatttaaaatatataagttattaaagagcttaaatctaaaattaatttatatatatgataaaactaacttacatatataatagaagtaacttacatataataaaatttacaacatacatatattttttatcagaatataatcatataagatcttgttgtaaagatttaattgcaacgaacacaacagtataatcagattataaatcggataagtaatttaagagaaacttctctaagaggaaaaaaaatacatagatattgagtgtactagtagcttttttttttttgaaagaagggtgtctctctttagcactatccagctagcactctcagtgtagttgtgtccattttaatagtatagactaatgttaagagataaactactattaaaatctataaaggtatattgaaggaaacctcgataccataaccatattcgtatccgtatccgaactatccgagaattatccagtccaagaggtatctgttttcgtttttgtccggagcggacggaaactatatggtccgttttcatccctacactgacctataacttgtagttacgcgtaatataattaattataatagcacgaatcctatgaccgatccaacggcacaaaaactgactgtaaccaaccagaaaatgtgtcaccaaaaatttagcaaaaccgtatttatatttaccacaaaaaattttataaaaaagaataccactaaaagcgctacaacggaacacctttaatttggagcccacacttctctgccggttgacaaaagtttactccgtatcgatcactgccggttcaatatgctacagtttagaccttggtttatgaagggataatttaaatacaacattattttctgcctgatggaaatccaaataaatcactatatttttttttactgggatctatgtttaccttctgaccaaccgatccgacactacctaaaaaagcatttttctatctggccaaaccctatttttccatgtggttgggacgcctgtatgccccaaaaggtctccaaaaattgcgatttttccatgcagttaccacatctgcatacgaaaatccgggtgctcatgtgtgccacgtgaaaaaataaaattccccaaagaaaaaaacacctcaaaattgaaaaacagaaaccctagctagcctggtgccggccactaccttcccgccgtggccactcctgaggtcgtgggtggtggatccgcccgcccctgcagctcgccgctaccgccaccgctccttcggtcaaagggcatggatctgctcgccgccattgctcccgttgttgggggagggggtacggtggatctgcccgctcccattgtcctgaggttacccatcaccgagcacccgagatagccgccgttgtcgctgcctaccaccaaggccatcaaggggctgagcccaaggaagccgaagccgcccgctgcctgccaccggccacacccactgcccaccggccgctagccactgagagagagggagaggaggtgagacagagaggagaggaggactgagaagataaggttggacttagaagaaaatgtaatgtgttgagaaggaaagtggaggcaagttaggcggatccataagagatccgtctacgaaaatatattattgcatgtggcacttaagaggtccgcctgtaaaaataggctaactttcgcatgcagctacttaagtggttcgtatgtgaaaactaatttttgcatctggacatcttaaggagccgtatgtgaaaatggaggtcgattttatagacgcggctacttatggtccatctgcatccaaattaacgaaggtctcgtccagaaaaattattttttaagtagtgcaagataatttttttattacacatttactgttcttgacatatatctgtctgcagaaaatgtttttattagaaacatacatattcagttagatatatcatttgtagtaatatctaggaatgtacaaatttcttaattgtactattaggggggaagaggagttccaaaacccggctcagatcggctagcttgaggccttgttaagtttgcgaaaaaaaaattttaggtgtcacatcatcggacatttgaccatatgtcggaagtggttttcggagacgaatgaaaaaactaatttcataactcggctggaaaccaagagacgaatctttggagtctaattaatccgtcactagcacatgtgggttactgtaacacttatggctaatcatagactaattaggctcaaaagattcgtctcgcgattttcatgcaaactgtgcaattaatttttcttgttatctatattcaatgctttatgtatgtttctagagattcgatgtgatgtttttgtaaaaaaaaattaggagctaaaccgggccttaacaagccaagacgagacagctattttgctcgttgagctacgagccgatcctgatcctgagccagttcacgagctacttgttaggctcgttatactcgttatttcagtttcatgtcagtttcgcatttgccactcccgcatcccaatcagatggcccagcccagtacagtaggccagtagaaagctccccatcgtcctcaataggtctgttgaaaaagctcgagacctattaggctactttaagagcatctccaatagtctctctatcggtctctccaagtcaaattttaaccatttaagtaaaaaaagagatccaacagactggccaaccgaatggccaagccatccagctgaccaaactcgctcgctggctggctagatttggctagtcaaaacgcctgccaacacatcgatcggtcggcgcggctggtgtactcctcgcgaggtcggagtgggcgccgtcgtcgtcgtcggggtcgtcatctaggtcgtcgtcggggtcgttgtcgaggtcgtcgggggcgccgtcgtcgtcatcagggtcatcgtcgaggtcatcttcgaggtcgttgtcggggtcatcctcgaggtcgttgccacgagccaccaccgccatcgcaatccccgccctgtgctccgccgcctcccgcctccccatgccgccgccgccatctccatccccgccccaagctccgtcgcctcccacctccccgcgccacctcccgcctccctccagcgtggtcgtcgcctcgaccggaaggaaggaatggggaaaaaggaaagagaaagaagaagggggagagggagagagaagaagaggggagagtggctgatatgtgggtccgattttattttggagagaattaatagagagtctgttggagtaaatatctagtttaactagccaaatcagatgaagagttggctatattagcgtttgaagagttcgatttagagaggctgttggagatgctctaacttggctcctattaggctaagcttgagctggatttgaacttcaaatgagccaagctcgagcttatcttctgactcactccatcaaaccacatggtcacacgtgtcttcatttgttgtttcacactagctagcctactgcaattaacaatccagcacaagcacaatatcgaataaatatttggtgttcttttcttattaagatataaaattttcatcgatttctgttagcacgctttttaatttactaaacggtatgtttcgtgcgaaaactttttatatacaagttattctaaaataccaaataaacccatttttcaaattttcaataattaaaaataaattaatcaagttaatagctttctcgttttacgtaccctttcttcatcttcattagatcccaactaaatgttttataagcaaatcttcattagcaaagtagactttgcccaatggcaatcactttttccctgaaggagtcaggagtgcatggcatgcatagttgacttgtagtaggaggagtacagtagcaaaccttgagaaaaactcaaagctcgaacgggctgagtcggagcccaacataaagctcaagatttgatgaggcccgagtcgagtccatacaaagctcgagcctggctgggcaggctcgatcaagttgataatcctactccctattccctaacagtacacaaccttagtcgcacgtacgcacgcaagaagctagggcccacgagacacgtcacgtcggtcgtgcgagtgggagaacgccacgtttcgcgccccagctctcctgtgccgccggccactactcccagagtctcgctgtcccctgatagactgccccgtcgcctcccagtcccatgcgcccctactcctcccgtaggggctcttctgcagggtcgcgccactgaccatgcaagtgaatatagtctcgtcacccgtataaaaaatatgtttgttagtttattttaaactcccttcatactcataaagaaagttgtttagcacaatgtttaaatcaaacattgggaataaatcataaataactcttaagttattgggtttgaaaatataaaaataatataaatagatttatcttgaaaaatacttttataaaagtatacatatatcacttttaaataaatatttttacagaaacatatatcacttttcaataaatatttttatagaaataacaagttaaagttgtgttttggagaccgtatcgctgtcgactttctttacgagtacggagggagtatatagcagtacaaaatttagaagaaaaagttaattagaaataggacaagtagacaaacaaagcccgcttgtctcgtcccgcttgcatccctacgcgccacttccatgcgccgcctcagcactgcaggctaacgctgccctttatgccctcaggcccttagcaccacactgcatggtttggaatgccggttggcatgcgtgaagtccaagaaccgcagcaaggggaagaactcgtcagcgacatctctaaggctttgtttggtaaatgagattggaaaataatatcccaccctccaaagagcaatattgcatcatatctattcattcctcacaccttatttaatcctacccattaatccatttccctttttcaatcccacctcccatatcccatttgccaaacacactctaaattctaagtgcttagtgctctctatatcctaagtggttgcactgactggatgagtggactataacatagtgctttctagattcttatgatgtttgatcctatctcattgctttattccttctaacatcattactagctactgcggcatgatgtattcttggtgtggatgtagtggatcatattaattaattaacaggattgcacaagggttcaaaggagtcaattcgatcgttaactagctaattaaataagctcaactagccagttcactgagctgagccaagttggcatttcacctcgttatatatactcttaatgagccgagccggctcgttataacgatttagaccgagccgagcttattcagacaagctatcctatctagtacaggaatgatttttctggatggcaggcattttaaattgtagacggatcgtaagtggtcgcgtctgtagaaatcgtgctccattatcccgtgcggctctctaaaatgaccgcaccgaaaaattaattttcacaaccgggcatatattatgatgtggaccttgttaatgacccgcacatgaaaataccacccacattttaatctcgacatctgcgccccacacccacactctccctctcagatcccgtctcctcccgtctcactctcgcacgactcctccctctccctatccctctcctcgtcccactccttcctctccctatccctctcctcgtcccactcctcccatctcccggcgatggcctcggctagggcggcggaggtagcggcatcggttagagcggccgaggcggcatcggccagtgtggcaagcgggaggccgaatccgtcgcctgctaccgcggggatgccggatccgtcgccggccactacggggactactgcagcgggcctcaggcaaggcggcgatgatgacggtggtgacggcaacgacgaagtctagattagggttccaggaggcttttgatttttttttcgattttttattttcccgtgcgggcggtttaagcgcccgcatgcgagattttcgtagacacctcgttctagacgggtggaagatctgcacacaaaaatcaattccaaccgcacggaaaaatcgttattgtactagtgccatccttatctatatcattaatattttatatcatgactgaattactttcataaataataagaaaattatagaaacattttaatagataattaccaagttgaatatgataagttgtcgtagcaatcaaacattcctgtttaatattttatattggtagtcttgacaatatataactcatggattcttcatccggtcagtcttttactggattccgtaatattagaattagatattaggtggtcatgcttaggataatagttgatatcaagatcagtcccataaaaaaaagaggttgatatcaagagattacaaagctcacacttacgactgtaccaccacagcacaccagtagtattaaggaagtaaaacggaccaaagcgttaaaaacaaaatttgttaattaataactaacgtgcctgcatccgcatgaggaggtcctgtgactccttcctctggaagcggtggcgggtgaagtcgcggcgcagcctcgccacctcggcgcgctcctccggcgtgccggcgtcgggatcgaactcccacactgccctgcctaggaagccgttgcccgtgtgcagcagcgggctgctgccgctgccgccgccgctctccgccgcgatcttcagccgccacatgcttgcctacttgcttttgctttattttaccagtggtactgcttggtgaacaaattaaggagcttgcacttgctagggtacgatgtctatcttatatagtagaagccgaacgagtgcaggccacaccatccacctaccttaccattttttttctcagtagggtagtgtcgtgggtgtttatgtgaacatgtacgatcatttattgtactctacatttgaaaactggaacggaatatatatcttgtgactggtaaagtcaccataagcgaggcctatgaacacaaacatacacacctaactatataagcaccgtactaactatataagtaccatacatctgaagattgagccatcatatcttgagagttatagtagatgccttgctaatagcggtacaccgattcactgaaaaaaaataaataaccttaaatacgagcatttgtgccaagtatagaatttgaatcagcatgaatagttttcaccagcagaaatctagctaaccagttaagccacactgatcacttcgcaacctttattttaaatagcacctatcttaattcattgcttcgatgaatagtacgatggtgtggtctctgaaacgtgctacccactaggcgtttgtatgtactattgatggtagatgataacaacaagccgaattgatgttgatttaaggaaataggataaacctggtctctacgtggttcgatgtagacgggcaactgatgaattgtagttgaaggctctcttcatgttctaccaaatttattgcgtttatattttgatttcgactaaggcctgtttagttcccaaaacaaaatttttcatgctgacacatcgaatatttggacacatacatggagtattaaatgtagaaaaaaaaccaattacacagactgcatgtaaattgtgagatgaatctttataaactaattgtgccatgattcgataatgtggtgctacagtaaatatttgctaatgacggattaattaggcttaataaatttgtctcgcagttttctggcggattctataatttgttttgttattggactacgtttaatactttaaatgtgtttccgtatatccgatgtgacaaccaaacccaaaacttttccccaactaaacgggcctgatctcacctaaaaattgttaccatgtcaaatcaaacgtctaaacacctacatgaagtattaaatataggctaaaaaataactaattatataaattacgactaatttgtgagacgaatcttttaagcctatttgctccatgatttgacaatgtgttatgtgctacagtgtatatttgctaatgacagattaattaggcttaataaatttgtctcttggtttactgatggattatgtaattaatttttttattagtgtccgaacactcccatgcgacaccctatataatactcgatttgacatgctaaaacttacacccctggatctaaacaccgcctatgtactgatgaattgtagttgaaggatctcttcatgttctaccaagtttgcattccaaggcatatgtctcacgtgtacaacaatactccccttctattccaaaggcatgcaattgcgtacttacacacatctatatggattgtctacagattaccataagtgcgaggaaagttaagagactcgggaatggcttctataatcaacgttggcaccgcgccttgccgtaggttatgtagttttatcgtcatgtttcaaatggttagatgcaactacaaaatatatgataatatggctttatataaacccaatgttattacaatgcaattcatgctttatttttcaaagtgttattatgtattgttataatatgtgaatattatattgatgtgcaatatgggtatcttgcaactagatagtttgcatctatatctacttctctcaggcttgctctgaaaatggtttcaagtaacgatacataattgttacatgctatttaatcacgtataataaaccaaaactaacattttaaacaataatttgagttgtatttagaaaaaaagttaagcattattttggaagagaaaaaacatgacgctctgtgtaaaataggaatgtgaatgtacgactaatatatgattaatttagatggataggtagctgcttgaactaacggttgttatctttatacaaatatgatctaatggcttaaaactatatatcgatgatgtggatttttacatgtcttgctttataagagtaaatgtattttagtgggtatcaactatacgggct

SEQ ID NO: 22799 - DNA, 7774 bp, Oryza sativa
cagccccaccacacatgcttcaagtggagagaagaggggaaacacgcgcgcgctcgctcgcctggcctggcctggcagggcagggcagggcaggcggcgcgcgtgcacgacgtacgcgtcgaatggtctcgaatggtccgaaaaattggctcctcacccttgcgcaaatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacaaaaacatgctaagattattcgatgtttacagtagcagtatagtcgccgaagcaaatacagatcaaatgcttcgaacaatcacttgatgggctgactcggtgagcatcccgctccaccatagtagaactgcaagccatcgtccgtggtgtaaggacgcccaacatcgtagcagtttggctcagttgcaaccgtgttgattgttttgagagcaggagttgcaaagcttcccgacgcgtcgatcaccttcgcatcggcgaagaaagcggcctttgtctctccttcatcagcaggctggccactgcccatgggaggaaaaggttcccctggagcagcttctactacacccatccaactgatcacgtctgcagcttcagacatgtgagtcaagagctttgatggccagtaccccactatttcttctccaactttcagcacccagtctcccatgaactattcattccagagaaaaaaaatcagatatacaaagtgtcccagttaaataatgcaaggttattggcacagtaaaggattatttaccttaataatcttaactctaatgatgtattgttttccattgacagtggaaactggcctgattattattccagggattgcctttttgctcatctgaacaaaccccgcacaacgaaggttgatacatgacttatcattatcaacctgttgcatgtaaagcaggaaacagttatttctcatgtttcctcctttggttaatacaaattgacagatggcatttttggcacacattcttacccacgcgatctcgaaatgaacaagattgtctccgtacagatgtggatcaacctgcgatcgaagcaccataggtttttacattagtatttgactgcaaagtatgtcaaaatgttcaacatttcatatgtactattgagggttagtacaagtttattgtttcaataaatgtaccatttctgatatgacaaaaagtcttcttctgatgtaaatagatttaactgtcaaaatgagattctttgagattattaagaacttacagaccatcctacagctacacgacttcctccattttttagaacaacaattgccccactaaaccttggtggacgtcctgtaccaagatctgtttcccatattgaaattgatgtttgtagtccgtaaaaagtagatggcactataacaactgcagccatctagaacaaaacagagaaggggagtcaatattaatgtacgattaataaaaacaattctaagcataggaaagaaaacatgggagataatgcaactacagaactataattcttacttgtctatttcctttgtcatttctgttctcactgtatataatcttatcgaatgatcttgtactcatggatccattgtagcttgttaggattggcaccgtccctgggggacactcaatttcgctcatctcaacattagagatgccaaatttagatccttcatcatcatcggtactgtgaggaaaggaaattggtggcatctgcattaagagtaagattcaagatgtatctaataaaaagttattgatgtttcttgggaaaaccatgcatgactaatatgaaatataagaaaataataacctaccaactgagtggtatgattcatcagcaaaggatgcctcaaggatggttgcgatttgaaactaacacaggcaaaggtttgcccatctgcggtctgaaattcgagcaacacaacagctttggatcagaacagatactgtaatcgtgcgttgttaaaatgcaatgtatacctgaatcgtcttgatgattaaattgttgtcaacctcttcttttgtcggatctacactgaatattagcaaatgaagtagaagaaatgtttttatggtccatcctttgtatcccatggtcagagactttgcatagatatgtatggtaaaatctatgcgaaataatgtacttatatcaatatgaataagcacataaatctaaatcttaaccaccatatttattgctttcataaatatacatctaaaccaacatatttattgctagcatcataatagcaaatgaatcgtcttcctttatttagcatttatatcttctttagtattttccattttcacttgtagacagaaatgcactagtttcaggggatgcacatttatgttgtcagactttcataaatggtgctgactgatttcaccaataaactataaactgaaacaaatgtttggattgccttccgcatttttgaaaatcaattgattgaacctatctttcttctttgtgtaactattaaaatatatatcttaggatggcgtagacaagcatggacatttagctattggacgcctagcacaaggattgaattcagcaaggtccttaaatgaactttaagggattcttacaacaatgaaaattctagacaaatacgtaaaattttgtgcatcattccattttgtgaagtagctgtttacacccaaatttagcacctagagtcgaaatagggaaatatttccaaaatttggaatgcgtcgggtttccttcatggggtcggtctaactaccgcctatgggcgggtctgaccgacatgtagcgctagtctgaccgccagcatgtggttggtcagaccggcagagtccgattctgtcaggtctcgggtttttttgcttcggaaggtattttttgagtttcaattagtttctacccagagttagacatggaggagaacttatagaaggcaataccaacccctttataagggctaaggctggttcgattctagcccccaatatctcaatccctacacaattgaatcattcttttccctttactttttagccatgtcttttacgttaccctagtttcatccatatttgtcgatttgcgttgtaaaacgtccacctttgccgtgagagtgcgatcatccctttgtaggtttgccctgtaaaccttccgttcaaccacgagatgggtggttatattcaaatcgatctaaattgtcctcgtggctagttttgatctctaaatcagctccagtagccggttcaatcttcaaaacccatattgatttagagttatctagatcgaggtggttggtgactccattaacaccgccaaccttttaggtgagtctcgtgttgggatcgaaaaagacgccaatagcagccttggatgcaaatctttaatacatataaatggcaaattgtcctaagtttctcaaaaaaaaaaataagacttcatatgcagacctgaactaaatttaaaataatagatgtgtttgaaaatcgaagtaatgttgttttgttgtcaatgtggccttttcgtgtggtcagtgatgtatgagagagctttctcaacctaaatccatcgttgtccgatctgttggatttgtagttaaagctaacatgtatgaaatattctatccctcttggctcaagctatagaggcaatgttgagccgggagggatcacacttttttttgctagtgtacctttctttaaatgtttaacaaaagggacaagccttgccgctaatcagctgtgaaggcctgccttgctagcccacaacccagtgctggcgaacagcgatcactactacaaaatcggtttttcatggcggaaccatatttttttcgctgacggccctgtgcataatccgcctgcgaaattgaaacgatgagtgaggggataaaaaccgccagcgaaaatagattttctctgacggttgagttatgtagcatgctagtgaagatatatatagctattttcgctggtggctcacttaaccaaccgccagcgaaaatcgattctcgctggcgatagctaaagaggtccgcttgcataatattatcaccaaatataaattgaccacgtggctcaccacctagtgccacccaccccttcctctctctctctccaccaccaccacccaggctggcagtaccctctctttcctcctcctctcccctctcatccctctcctcttggcgcggcaatgacggcgaggaggggaggagaccgcctgcagcacggcaacagtagaggggagagtgtatgtggctctcccaatccactcccctcccagatctggttaaatatacgggagctcgagaagggcgcggcgcggcaaaggggtaggtggcgttggcagcaggtgcgagtgctcggctacggctccctcctcactcacccttcttcgcgcggcatcagcggcggcaacctcctccctcgatcctctcccctctgaaacctctcttggcgcagcatcgacgaccagaggcgtcctagtggcggtgggattcggatccggttgcaggaggggaggaggctggtggcggtgcccgcggtagcgccccactctcctcccctctcagatctggccgaaggaaaggaggccatcaacggcgtgacaacagtagaggggagagtggcggtggctcccctactcccctcccgtcctatatttggccttatgagagctcgagaagggggcggcgtggcaaagggggaggtggcggtggtggccggtgacgacaaagggcaggggctgcataggtggatgtggctgatctggccgtggaggcgatggatccagccatggaggcagcggcgagtagatccagtcggcgacccgtctcccagatctgggtatgtatcctctccctgcagtctctctgtttcccatccatggatgttcatggatgcattggttagtgatctgtctcacaggacatgacaagatcgctggtgctgtggttgagggagcttgcagatcgttgtttactgtttaatgtagattgaaaattcgtgaatgttgtaaatctgtctttagtttttctgttattcatttgtagatttgtgaaacgagtaaatgctataaattgtggtgctctatggatctggcaatttgggattcacttttgtgatttgggaataattgttctggattggtgatctggtatgcatgagggtattttttttcccaaaatcatctacgctggcggtcgtcctgaccagccaccagtgaaaataacctcatcgcagatggttagcttaacctagccgccagcaaaaaccattttcgctagcggctggcttaggtcaccgtcaatgaaaataatttttcgctagcggctattggccgtcagcgaaaatggtgtgtttttactagccattagtcactggcggtagcgttggccgcatgagaaaactcaaaacggtcacgaaaaatccattttgtagtagtggaggcgaactggttcatcactgcaggtttgaattgcttaatggtaaatgtgtgtgtcgttctctgggaagaataaacactgaaggtttggtttaatacccttttgctcttaccaactagaagttattccgaaagttgatggcttgaaaaacatgtgaattagtttttttttagataatggaatttaacatcccagcctttgctcaaaaagagctacagccaattattacattgtatcaatccagaaaagaacgtagttcagctaaataggacaccaaacaaaaacagaggaaactaagccaaaataaggagaacacatttattgaagtctatttgtgaacctccatctataattggcaaataattgcataaccatggactccaacttgcggtatgcaacctttagaaactccctatcatcctcacacctttgtagctgtgcccaaaaccggagccagtgcgttgccctgaaaattacctgcatatatgaaatagatggtgatttattaaaaaccaaatcatttctactcaaccatagagcccaacaaatggcagaagctccaaccagtattagtttaatctttttcttgtcaatccccaaaagccatccatcaaatatatgagatatactagttggaagattaaaaccaaaagaaaactgaactgctctccatatgaattttgcataatgacaatccatgaagagatgttgaatagtttcatttttcatacaaaagcaacaccttaagctaccattccaattctgtctcgccaaattatccttggtcaacacaacccccttaagcaaataccacataaagattttaattttaagcggcatcttaagtttccatatatatttgttcctctcaacataaccattgttaattaaacctagatacattgaccttactgagaacctaccattctgatgataattatatctaaaacagtcagaagaaggatttaattgaatatgtacaatagaagcacataactcatgccaatatacaagattctgaccaactaaagctcttctaaaagaaacattaagcggaacagatcccataacagtggcaatagtggatgatttccttcggactatagcatataaagatggaaatttatccttgaaagccaagttacctagccatttatcttcccaaaatcttatttgttccccatcattcacaatccaagagcccatatctaaaaaagtacttttgactttcataagtcctgacaaaaaatgggaatcaccttgtttcttgtccacttaggttatagacttgttataaagatatttccttttcaataagttctgccaaaccccttcctcatttattagcttgtacaaccacttactcaaaagacatttattttgtaattccaaattatgaatcccaaggcctccctgatccttaggttggcaaataatatcccatctagtgagtctgtactttttcttatgatcatcaccttgccaaaagaaccgtgatctataataatcaatcttttgaagaacccctttgggtatctcgaacaaagatatcataaacatagctaaacttgaaagtacagaattaatcaagaccaaccttccctcgacagataaatgtttacctttccaactactaagctttttctcaattctttcttcaatcactttccaatctttattagatagtttcctaaaatgcattggaattcctaaatatttaa

SEQ ID NO: 22800 - DNA, 2283 bp, Oryza sativa
ccccttttaagagacccacttctttagctctcttaattaacaaagcaagcatatcagctactatgttaaaaagaattggtgatagcagatcccgttgcctaagacctttgtatgtttgaaaattgttgccattttgatcatttacttttataccaacatgaccaccttgaataaaagaagctatccactcacaccatttaggagagaaacccttcaccctcaacgtttgttgtacaaaggaccattttactttatcataagctttttcaaaatcaatcttaaagattacaccgcttttgtctttacgatgtaattcatgcatagtctcatgtaaaataaccactccttccataatatttctacctggaataaaggccgtttgagtgggactaataactttttgagcaactcccattattctattcgttgcaactttggtaaaaatcttaaaactcacatttagtaaacatataggtctatattgttgaatcttaatagcgtcaacacacttaggcagcagaataattgtgccaaaattaagagaaaacaaaggtagagtacccctatggaaatcattaaaaagctccaacaagtcatttttaataacattccaaaaaagttggtaaaactctgccggaaaaccatccggccccggtgctttattatgctctatctaaaaaacagcctccttaatctccttttcagagaaaggttgcgttaaagcttcattctccaactgagagacttgcgggacatccactattctattctcatcaaattgcagagaagagtcttcaggaggactaaataaacctttataaaaagtggtaatatgcgcttttaaattcgcatcaccatttattatttgatcgccatcctgtaattgaaaaattctagttttcctatgctttccatttgcaaccaaatgaaaatactttgtattagaatcaccatccaaaatatctttagttttagctctcagataccactttatttcctcttctctcagaattgaagaaagcctattcctataaaaccatctaatatcaatttcctcttgagtcaaaaggacattttctgcctttttatctagcaaattaaccttatccaataaatcttttttctcttttgtatatataccactcgtgtgcttagcccatcccctcaagtgttgccttaaacgacgtatttttgctggtcagcgctccataggagagtctgcttcatctacactatcccaaacctctctcaccatatcaacaaaaccctcacgtaaaagccacccaagttcaaacttaaaacaaggttgagcattactttgagaagatgaatttgtgtttaaaagtaaaggagtgtgattagaaatatctctgttaagtgcaaccaccgaggctaaaggaaaattatgttcccactctgtcgacattaagactctatcaagcttctcataagttgggtttgctaaattatttgcccaagtaaaatttcttccagacatctgcaactccataaggcacaacccatcaataatagcattaaaaagaaagggccatcggtcatcaaaattgctattacttttttcattagggctgcgtaaaatattaaaatcaccaccaataagaattggtaaggtttcacgagagcacatattgactaattcagcaagaaacttatccttattctcgttttgagccagcccataaaccaaaactaaggcccatttaaacttgtcagctctattacataaatgaaatttaacataaaaatcaccctcatcaattaaaccaacatcaaaattaagtaaattgatgcctaacaacaaaccaccagacctaccactaggagccttacaatgccacaagaaatctttaccagcacaaaggtttttaagtgtgcccggagcaaaatctttcttaacagtctcagacaaagcaataaaatccaactgatgttctttagttaggtcagaaataaatttgtgtttttttgggtatttgaacccatcacaattccaaaagatacctttcattaagactattttttttccttcttatttttaccttttttcccctttttcttggagttagaaggagaatccctagaatctaaggtggtctgaagacaattatcacagtccccacctgaatccattacctcctccataatttcactacataaatgttgcagtaagaaattatcatcaaaatgatcatctactaaatcaccatcaacattattggaaaaacctttagtagttgacaaccgtacatgatcacttaatct

SEQ ID NO: 22801 - DNA, 2679 bp, Oryza sativa
ctattttttttccttcttatttttaccttttttcccctttttcttggagttagaaggagaatccctagaatctaaggtggtctgaagacaattatcacagtccccacctgaatccattacctcctccataatttcactacataaatgttgcagtaagaaattatcatcaaaatgatcatctactaaatcaccatcaacattattggaaaaacctttagtagttgacaaccgtacatgatcacttaatctattttcctccatactccttaaatcattaataacatcatctaacaccacatttggactagaagtaatgataccaaggcttttaatagaagcggaaatctgatcattcgaaaaatgtaaaaaagaaacatcattaattaaattacctttaacatgcagattttccaaattcttgtcagccttcgacttctcagctctttgaagaacaagttgatcactatcacttgctcttcttttactcctcctggatggagagactgctgcctcaggaatagcagagagttttgcaaccagactttcctgagattggactctctcaactccaattacatcatcatgtaaaccatcaaactcttcatcagacagattcaagccaccagaatcagcagtcaagcccacctgaatagaatgtaaagaaggaccacccttctcatagaacatacttccagaacccaacttagattgacttgagcccccagggcctggctccttccccgaatcacccttctcattaccatcatttttcttctcaaagtcaccatcaccaatattgtccatatccattggtataggctcctcaggaccattctcaggttccactctaaaggccaactcatacaaataatccccaataaccacatcaaccacctcaggaatcaaagatggatcaaggactaacacttgtaaccgggcaatgtcataccttctagtaaacaccatatcaacagttttagttataccaagaatggaaccaacggcccaaataattaagtactcccttaactctgaagggatacccttacactgcacccacaccttcgggatcacatatttaacctcattacctacccctctctccacaatctgcatctcagcatcaccaaccttagtatgcactttaccccattccaccatgcgttttaattcagcggcagaaggaaaaatagtgcgaaaagaaccattcccattatcatgtactacccacctccatcctccagggattaatctttctaactcagaaatcacagcattcaccgtcatctgtcctttagacaccttaatcaaagctgctctaggctcatgtttaattttctgaccagctgaaagaggaatatggaagaaacccaaaccatctcctgcatatccacataactgagcagaaggtttaacagatgatcgaaaaatagggcaacgagcaacaatatgatcctcgctttcacaaatctcacaataaaatttagacaagcattcctgcattgtatgccccttagtataacacctataacagtatggcttacccgaacctttcacctcgacctttgcttttcccttgctctcatcaatcggacaaaacaccagagcttgctgatcaacaccacgaacaccctctgacccatgagggaccaatgcaccttagctcacacagattaaacatactggccaagaatattattcgatatgatcatagtagtagtagccgagtcaagtacagagcaaatgcttcgaacagttatttgatgaactgacttggcgagcatccggctccaccaaagaagaaatgtagcccgctgtcatatgaagaaggacggcctacttgatagcagttcaggtttgtcgttcttgtaaaaatttcgctaagattgggagacacaaatttggatgtcgatgaataaattacattcacatctgtgaagaaagcagctcttccctctccttcgtctggtgaatagccactacccatgggaggaaaaggttcacctgttgcagcacttgctacacccatccatccaatcatatttgcagctccagacaagtcagtgaagagctcccccggccagtatcccaccaattcctcttcaaatagcaacacccagacatcccatatctatgaatttaatggaaaaagaaaattatggcagtaaacttgactattgcaacaacttaattatttgctgttgcaattaaacagttgctttagatatgaatctttgtactgtgcaatatggagcaatacttttggtagagtcagggatttaccttaaaaattgaaattattattaagtatttttttccatcgattgtggaaattggcttgagtactgctccagggactattctattgctaagctgaataaagcccgcgcaacgaagattagtacatgacttgtctttattagtctgttgcatgaaaaagaaaaacgtgacagttatttctcataaaaatgtgattcactttaatacaatttgagatggtgcttttggtaaccgatcatacccatgcaatctcgaaatgagcgtgattgtcaccgtacatatctggatcaacctgggattgaagtaagcagagttgtacattactaaatgataacaaagcatgtaaaaatgtttgtcataatttatatattgttgagacttagtagttagtacaggttg

SEQ ID NO: 22802 - DNA, 448 bp, Oryza sativa
ataaatcttctgctttattatggttatagagttcatctgcaagcacacggatataccattgtagcatttcacccgagagaattccaagggtatcgtatttattttatcccccattattctattcgttgcaactttggtaaaatcttaaaactcacatttagtaaacatataggtctatattgttgaatcttaatagcgtcaacacacttaggcagcagaataattgtgccaaaattaagagaaaacaaaggtagagtacccctatggaaatcattaaaaagctccaacaagtcatttttaataacattccaaaaaagttggtaaaactctgccggaaaaccatccggccccggtgctttattatgctctatctaaaaaacagcctccttaatctccttttcagagaaaggttgcgttaaagcttcattctccaactgagagacttgcg

SEQ ID NO: 22803 - DNA, 611 bp, Oryza sativa
cttccttccctcctctgccgccgtcgcacgccgccgcaccaccatgcccagtcgtcgcccccatcgcactcgcgcgtgtggacctgagaggagtggaaggagagagagcagagaggagaaaccgattgaaagaagggagagagagaagaaaagaaaaggaagtgggacccactagtgggagccaccatctggactattcctccccgtgaccctttggccggctaaaaagtacatatgatctccctctactttattcaccaagctccgaacatcaatccttataaaagtctatgttactttcctttctttcttggccgcgcctatcgtaagatgcaattttttttcacatattttgaaataaagtatggtatactgatttttgttttctccttgataatgatgtctctttattgaatagagtaataaagttccttgcatttctcctgttcctacaaattattgtacaaattattacacccacgtaaatgtaaacacaacatatttcatgattagatcatatcggcaccattcccagtgtcacacatagtccctccttgggtcaccaccttctgctcattcctgtacacgtacctcctcgcgaagaatacgta

SEQ ID NO: 22804 - DNA, 2101 bp, Oryza sativa
  unsure (1)..(2101): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccagtcctccccaccagcagataaccactgcctctcccaaaaaaaccagtcctccccaccagctgataaccactgcctctcccaaaaaaaccaggcggttggttaactcaccagctgataaccactgcctctcccaaaaaaccaggcggttggttaacaaaaaaccagttggatctagtgctttatgctcgatccacaccctcagctcatctcccagtcgtatgggcccatgcaacccatctgtatgggcccatgcaatgggtaggcgtgttactagttaaactaacataacaccattacaaccactgcaaactcactgaggtcaagggggatgaccctcacttttgctaaatttctaatttattaagagaactactggtttttgccacctaactgtgaagtctgttacttgccaaggactcaactatctattgttcactggtcatttctccatttttcaacacactctcttactgagtacacgtacccattgccaaggactcaactatctattgttcactggtcctttctccatttttcaacacactctcttactgagtacacgtacccatgtgagactaatctcatcgtaccaataggccacaatccaaacatgaccttagttgtttgtctaatacttcagggtaattaactcactagttcctataatctgcacacaaacataaactagacaatgtaccatgtccaacttcacgtcgattcaagcccccacgtttcgcaacttcatttattgaaaatggtggaaagctgtagtgaagcatgaaacgctttgttggaggaccaacaattgaatccaatcgctgagcatcaccaggagcaccaagggtaactgtacataaaacctacaaataaagtagtccatgtgggtggtcactttactggaaaacaaatgttgcaatgttccttcaatttaaagtgtgtgcgagagaacctgtgtatccccacgtgaaaacagggcagatccatgcaatattggatatgtgctggattcacagtagagtggcctaacttcatcaagttgcctgccatcaactctaagtcctttctcgattattcttttgcgtataacctgcacaaaagatgggcacaaatccatgtcaactgaaataacagaagtgactctacataagaacataacactgaataaagtaatatcagatttttgtcaaggatagctagtacatctgggatctacaacaccaataaattatgtaggttgtgtaaatctaggcatatgaagcaaacgaaggctcaaaaggatgcatcaggactagaagtttgcttgtctcaatgcaaaaccggcatgctaagtttaaagtgctaaacaatgagatttgttatacactaatgtgttggatacataagttacagacttgccaaagtttataatttctgttaaatcataaagaaataaaagtgctctgctatttctgttagcatgaccaggtcattccaaacttgtaagtttcgatgcatttaaattggatgtgataaaatcattcaagcaggaaaactagatgtgataaaatcattcatgcagaagggcaaaaggtcgaataatgacatcagccatcgcgcattgcaaaatcaggatatatgttagctgtatatgtacaataataagttgaccgacatgcatgcatttgatgtccatcagttgccaaaaataggtttttccctccatttgcaaggctttaaccaaagcaattagtgtgcactacctgttttctcactgtatcaactgccttgtgaagaaacttcaagctgtcctcatcgcattcttcttcaagctttgctt

SEQ ID NO: 22805 - DNA, 6633 bp, Oryza sativa
tgccagctctcttagctaatctaagttgtgggttgatgcatttaactgcctgagaatgtgaatcaattcatgaggatatacttacaatagagcaagaatatgaagataaaataatacctcagcgtgtgcaagtttcattcctgcttgaagatccctttcagtaatctcacgagcttgcacatctatcattaatgttttatcacgagaacacgcataaacaaggttgaggtcactcaaacctaactgcaaaacacagttaaagtaaagtaaatacaacatgagacagctgaaaaaaaattctagcaatgtagaccacatttgaatcatatatgctgatggagttggtcgtgctacacaaaaagaccaaagagaatcaaataattgtatgcatctccgtaactggaccagtgcaatgaccaatatcaatactcctgagatacatcgcatccacagacagtacatttcacaacaccatgggaacaatttatggaggacagatcagtgcaattccatgtggtactaatcgatcagtatatacctcatccaccgttgggttcagcacaaaatttccatcaattcttcctacacgaattactccaattggtccattccaaggtatatccgatagcattaatgcagctgaagaggcatttgcagccatcacatctgggtcttgttttccatccgacgatataacatttaccatgatctagaaaagcaggatgttgctaggtaaataagttaaggattttacaaaaactttacacatgttaagaaccaaataatagtagcattcattacctggacttcatggtaaaatccaggaggaaacaatggtcgtattggtcgatcgattatacgcccacatagaagctccctttccttaggggcaccttccctccgcatatatgttgtcggaataacaccttgggcatattgtttctcttgataatcaacctgcatcatgaataataaacaaaatatctattagggcagagaacaaaatggagctaaaaagatgcacaaaatacaagacaagtgatgtctttaaaatgtgagcacgtcaatatttgttttcaatattgaattcgtcattttcctcaaataagctaaataaatggaagttgtcgatgggtatcagcagctgtaagaaaggcccaagaacaaccaagcttctcttttgcatcccgcctcaaactaaacacccttcaaaccaacggcgaggattacaaatggcatttagcatcagattttgacttccgcagtctcttagtgatacagaattgattctagacagagcgatcattagccaaattagctatataatactgcaaatcagaacctgctagtgaaagtttcccaatcaaattcaacgctctctaaaactccataacacggtaaccaggttggaaaatggggatccgtacagtcagtgggaggaagtcccggacgggttcggaggacttggcggcggcgacggtggagaggacatgggtgtcgtccatggagatcacgacggagccgttggcgaagcgggccatcttcccggtctcgaaggagatgacgcgcccaccgatctcgaactcctcgcggaagctctccagcaccttccgtcccggcggcggcggcggcggcgcgtccgcctgcgcgacctcctcggccgcgccggagaggaacgccgcgcggcctcccgggacggagagcggcgcggggaagcgggcgcggcggcggccgccgcgcgcgaggaggcggagggaggccaccgccatcgacatggtggccgcgcgccggtggaggggaggaggaggagaggggttttggtttagggtttaagcgaggcgaaggcgaaacggctgggccttggttttttcacaccgtatctatgggcccacgtatcagcgggagaatcggccacatcttctccagcgcgccacctccccgcgatctggaccgtacatggaatgatcgacggctgggaatggtcatggcgtgtcaaaacgcagaacccaccgccgcttcggcgcagtagagggcgaggcgacgcctcccgggccccggcggcggtgagctccttctcatgacccaggcggtcgccgtgggccgtggcccaaggttggtgatgaacgcttttcttttttgagagttcgtaatggatcgccttccagacgagttcttgaattgaattcagtttttgcgctaagattgcctgctaaggcagttaaaaagttatttggatcaagcgctcagtcataactcggcggtgtgtggacagaacagattgtctgatgaaccatgagttcctttcgacacttaaggctgttgttggcccgatctttcggtgagttgtgataactacgatttgggagaaacgttgacgattcgactacaaccgtacgagacgttgtgttgcgccttagcgatcaatacacctctccgtggtttgttgatcttgccggtgcaaatcaaccttattcctgcaagcaaatcgaagaaacaagcaagaacaagataaaagcaatctgaattgtaaataggagttaaatacgaatgataagttggggttccgaagaacaagcagacggacggtctagccgacacgcgcgctgcaagcaagtagcaatggctaaactttaatctatcaaaacccaataaactgtaaaggggtacctgactatttaaggaggtgggaggacgacctaaggggaccctagggtcgtgctccacctggttggggcgcaccccacatgggccccacttgggccggggtcccagacgaagttacaagcccataggcccattataggtgacgcagcaccttcttttttgatttcgcccgactgggatggaatttggcgatgaagctggatccattggaaagatgactccgagagctttccatcaagtactcatggacccaaaatggagctcgcatgcatatttggcggccgtttgaagtcgacactgtagcaggtggccgaactggattgcagaacttggacagcttgatcttgatgtgaacgacggttgtatctatagtagccatggtcacatcatcctccccttcttcacggaaaaccgtcctcggtttttccatatggtgctcttcgtgtagtccatttaaaactacctgtttcttccaatcacaacaagacaaactcgagataattttgttagcaataacatttctctctagattgcatgttttatccacatgtacaggaggttctaaatctgaacagatgtaaactctatgcaccaaatatattcctctatcattatattcaccaaagagatgaaaaatagcgttacttggacatggaaaatcaaacttagcaaataatttctccttcaaattatcgagctcatgaaaatcagcaaactgaacatagcccaaagtatttaaagaagatgtcaattaacgttcctctactctattagcaatgtgaacaacatgcttaaaatcagcgcagttagtattaacaacaggaatagcatgtccattcactagttgtggcatggatataagtgaagcattatcgcacaactcttctttatcacaaggaacagcaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaactttcttcagacttcgcaggtgcttcatcctctttcttctcaagtataccattctccttttcttggatgtgctaatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgtccaatatgattatatgtcacattatcaagcaaaacctgaatttcagaattaagcccattgaaaaatctacgcattgtattttcattgcactctttgtgatcactgtagatgatacaaaccttaaattcatgaatgtactccctaacagttctgtcaccttgtttcagatgttctaatttctcccgaagagtacatttgtaataagatgtcacaaagcgttttctcatcatggttttcaatccatcccaagtttcaggtttattactaacataagtccaccaaaataatgcagaagaggtaaacttattactagcagccttaatcatttgagcatcagaaaaatcatatatatcaaattcattgtctactactagctcccaatcaatgtatgcaacagaatcatacttcccatcatagaatggtaacttagatgcaacttgttcaaaattatagtcatgtacctcatatgcatcacatggagaagtcgtcatatctcgtcgaaggtgtagaagtcgatgttctcgtattcccttacacaatcctaccatggttagtagcaaacaagaaacacacaaaaatatgcacgctcctatcaactactaggtagtggcagctcaaatatcacacacactcaagcttttaaccaagctcttacaagttcttactaaagcaagcggaatggtgatgtacaccgacttaaccaagcaccccaatggaggttggatgtatcgatgccttggcaaacacttgctgtacggctgcaatcagatctgtggagctctgggtaggcttaaatatgtagcaaagggatagcaaatgctcaaatgagagaatgcaaagttgaataatggttcaaagtcaagtaccgtgctggtcctaggctagaacgtactagagacgcgagcctagacacaaacgataccacaaaatagcactaggaacaactcatgcacaactctgatatatgaagttcagctaactcataacagtattttctcttttctttctttcttctttcttctttttcttttttttctttccttttctttttctttttttttgtgcggctttttttcttttttttatgcacctttctgcctttttttctcacttttttcttgatttttttaacaaaaactgactcaaggaccttaatgtaaggttacagggactcaaacgtaaatataaaatttacagggactcaaatgtaaaagtctaaacccaaaattaaaattatacaaaaatggaatgctctgaatttatgccggttccgtttttccaaacagatctcgaaaccgacaccaaacaaaaaattcaccaaggtgtatgggatggcacggtgtagattgaaccaaaaggaaaggagagggagtcggactcaaggggggaatgccgcatggaaggtggtgggactcggtgagaaatctaaaagaaggaaaccgattccttttctgcgtggcccccaaatagaaacgaaagcaatctaatctagtctaatattctccttctatcttcctcatgcgcatcttctgcttccttcttcttcacgcgcacatgcacggcaaaaacaaacacacacaaggatcggcaaactctagatgcaactcaagaactcaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagtaaaaactgaaaagaacaatgcaatggcacaatatggctaggtaaatgatacaaatttttttgtatggctattttctagttataggaagataaaaactcaccgagcaacgaaagctctgataccacttgatgaaccctgagttcttttcgacactcaaggctgttgttggctcgatctttcggtgagttgtgataactacgatttgggagaaacgttaacgatccgactacaaccgtacgagacgttgtgttgcgccttagcgatcgatacacctctccgtgggttgttgatcttgccggtgcaaatcaaccttattcctgcaagcaaatcgaagaaacaagctgacggagctcgaggctcctcaccgggagaccgcgcaggcccccctttgccggttcggccgggggcttagggtgcaatctcaagctctctctcaaaaatttaactgtatgtggaaagattactccccggcaagacacacgagacacggcgatgtatacaggttcgggccgctgcgaagcgtaataccctactcctgtgtttttgtggatttgtgtatgaatgagctacaaagtgtgagcccacttctcccccgctctaagctctaaatctggccagaatcaaccccttctctatgggcaaggtcctccttttatacttcaaggggataccacatgcacccttccctttccaaactggactgttctttttttctttaatgggcggagattggtatggttgtcgtccaaatgacacttcgatgggacaactcacacctacctccactcccggcggagacgggcgcaacgtgagatcgtggctgcccgttgctgatgcgaccagtgt

SEQ ID NO: 22806 - DNA, 7720 bp, Oryza sativa
agccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtaatggtgagttggctgtccataatgggcggtctcttcaagactgccacattacctgagcagcgcacgaatctgggcgagccgatttgcttcgcctggagatatggtgatggtgcttttctcggagccatcagaatagcgtatagcatcttctgggcccgagggtatcgggttttggcgtcccggagggcctcactaacaaagtagacgggccgctgcacctttcggcggggccgatcctcttcgctaggggccgcatctccagggcgctcttcatccgagaggcagcgcggggcgccctcggcttctgcgccgatatcctcggggtaagagggcgacaggcgcggccttcccgcagtggccccgaggctatcctgagggtcgggggcgcctgacaccgtcggacaagcaggcggagggccaactccggccgtcgggggccttgggccgccgttcggcttgggggcctctcggaccctgacttctccccgtgggcagcgctggaagagttccctttcggaaccgaggacggcgcacgcgcgcaggtccgggacgccgccgaccacatcgttcacagcttcgagggtacggcccctcggctcgcgttcgccctcgactccgacgaggagggcggcgacggtggtgcggacgataacgacgacaaggctggtgacccgggcgcgtcggagtgagcccccaggcccctgccaatcttgaatagctttttctttcttcttccgaggccttcgggcccccttcttgtatagactaatttaatctgcaaccaaataaagaggaaatttctatgtcaattctatttgttgtgtgtatgagacgaggatggtctgtgccgcggtccttctgtgtcttggcttgatcaagggctcgtgcccaggtcctagtcctcaaatggctcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacctatttcaagtcaagattcttcaaaaaggaaacaaaagcacagacacagcctttaggaaatcgaaaatgcttttgttgaaatacggaagagaaaaaagataagcccccggccaaccctgcacgcccgggggggtgcggggttggcccgagcccgaaacctgacacccgacccccactaggggtagaagcgacgaaggtgtttgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcagacctcccctttcgggtggccagcgaaacgccctcgactgcgaggacatgaccctcgtcgtcggaatgggccgacctcttcttcctcctcctgtcccgccgccctgtctgagcggcggattcgggggcggccgaagctgccactccggaaccggaggagttccatgtccacgcttcctctttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcatggggagtacgccggccattacgccggcgcccggtgttgaggcgggcatccggctccccatgctgatcctcccgagtcgacggtgtagacgagggagtggcagccgaatggcgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcatccagccatcgctgggctggagactccgggtcagggacgacaggcgggtgacgtaagagcgcgccaacagcctgaagcgcgccttgaggcgtgctgccgtcgccgtagacgaggaggcgacgctccccatctcgccgttctcctgcaccacccgcgactggtgatgctgcggatttctcgactctatcgagcgcctccccctgcttgggactttggcgtggaggaggtgggggagtgcgagctcggcggcgcggatttggctccccgtcatcgccgctcacactcggagagagatcgtgcgcctttgcttgctcggccattgggctgaacaagggaaacttggcgcacacggaagagtatgagagctcagaaaacacacgctgagccccctacctggcgcgccagatgacggagctcgaggctcctcaccgggagaccgcgcaggcccccctttgccggttcggccgggggcttagggtgcaatctcaagctctctctcaaaaatttaactgtatgtggaaagattactccccggcaagacacacgagacacggcgatgtatacaggttcgggccgctgcgaagcgtaataccctactcctgtgtttttgtggatttgtgtatgaatgagctacaaagtgtgagcccacttctcccccgctctaagctctaaatctggccagaatcaaccccttctctatgggcaaggtcctccttttatacttcaaggggataccacatgcacccttccctttccaaactggactgttctttttttctttaatgggcggagattggtatggttgtcgtccaaatgacacttcgatgggacaactcacacctacctccactcccggcggagacgggcgcaacgtgagatcgtggctgcccgttgctgatgcgaccagtgtcagaccggtcattcttgtccaccacgcgtcagtttaacaacgtgcacgtttgccctttttcgtgtaacaccttgcctgtaatggttaggatgaagcctggtataaatctaaccagggctaacgtgccatctctaagaaataacacgcttgctccggcttgagacgagtgcctagaggctttcgtcttgatgggatggggcaaggcgtgcgtcagaccgccagtcgccacctaacccttgatctgaccggtctgtgactggtcacagaccggataaaagagcgtgctgtactgcgttgcatgcagcgtgacacgcttgaccagactgcaataaatgctgttaggtgagcactgctgtgctcacttatcccatatatgtggcgcagacttccttaagggggtcggggtgcctcggccctcggggccggggcagcgcacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacacaagcaataacaagataaaagtaatctgaattgcaaataagaattaaatacgaatgataagttggggttccgaagaacaagcagacggacggtctagccgacacgcgcgctgcaagcaagtagcaatggctaaactttaatctatcaaaacccaataaactgtaaaggggtacctaactatttaaggaggtgggaggacgacctaaggggaccctagggtcgtgctccacctggttggggcgcaccccacatgggccccacttgggccggggtcccagacgaagttacaagcccataggcccattataggtgacgcaacaccttctctttgtgatttcgcccgactgggatggaatttggcgatgaagctggatccattggaaagatgactccgagagctttccatcaagtactcatggacctaaaatggagctcgcatgcatatttggcggccgtttgaagtcgacactgtagcaggtgaccgaactggattgcagaacttggacagcttgatcttgatgtgaacgacggttgtatctatagtagtcatggtcacatcattgtcctttgtgatcagccatgtactacctctgaagaatgttctgcgcagttctgttgttcgatagtatttgctccgaaattaactattccttgcaaattggttgtgtttgaatttgaagctaaactgactaggctttgttcattgtcctgttggcatttctggaaccattttgcagagagtttaattactcgtgcgcatctaatgtgggaaccgtgggcataattatttgagatccattgcatttgcagatctgtagttcataagcagatatgctagtagtatctacattgtattgtaggcgccaacaaaatataggcatcactaaatcacagtcagaataaaatggatttgccaggataaagtagcgtgtgcaaataagcaaattataaacaggaatcttgataataatatcttggcagcaagccttaataaatcacaatggtaacctttgtaaacttttatcttactgtgccgtagtatggaactgttcactgcatagacaataggcccatctgttgggctaataagctagagcaaaagccaaaatttgaatttttaaacttaattttgaagttgatttaagatatacttaacttagtttctttttcagcattggtttttaagtcgctaagaataaatatataaaatttttatctataaattaatttttatttcctaataagtggcttattagggaatatagtcaaccaagaagacttataaatttgtcaggtagttactcagactttgtggtaatcaaattgcagtctgaattgttgtttctacttgggctttctgataatgccaagtctgaaatttgtagtacccagttaatttgcatagctacgtatctactcctctactgcaaaagttgctaatgtggtgacttcgaggttttgtttccagttgcctacttgatcataggtacttttcagcattcaattgttctcatccctgattttttttttaatatctgttctagaggaacttgtataatttgcaatacgtaattcaaagtattatatgaagcaccaattcacagtcaaaattagtatatgaggaaaatccacttatctgaaacactggccacttcattttttggtacaaatactagttcaccgatcatttgggtccaaagcaaaaccaaagggattaaatattctattattctgtggcttgatagtaccgcagcatgtaacgatgatgagaatggttgttgctgtgagtcggagaattggctatcctatatactggtagagaaaaaatgatatatgctagaagatggtgtagaaaaagatgttcataactttactaatttcttgaatctctcaatactcctaattcaggagatcaatgggtttgtcatgttggataaatttgtccagtcctgtaaaagagtcatcctaccatttattttgtcattcttgattttttttgtcatatttagctcatgggtttattgtgttctctttgaattgtgtcccctgcagtttgaatttggtcatttgtttttgctgggatcaagcctctcaaaaagggataaattttaagtttaggctattagtactactcattactcaccctgagcatgctaggaagaaaacaaatcatttatttcttgtggggtaatcatgtcccttcagtgatgttagctttagactagtcttcactctacagattgacagcaatataaattgttgaaagcgaatggaagttggcaattgctttgtagattattgagagtgagacatttgttcttcattgagtggatttagtggagtagtggggtataacagcaatgctttctgatatcaaccctagaggagtcttgggtaaactgaacatggatcacatattcgcagcgctgattgacaacagaatatgtaatgaattggactctcttagtaaaaatatataatttaatatatgtcttttcttcttcgtttcttcttttgttgagtaaagcatctctactttttgttactccctgatgggtagacctaggcagcgttccagagggtgggagagtgagtttgtttgtttcgttttccgcgcgcacgtttctcaaactactaaacggtgtgttttttgtaaaaaatttatataggaaagttgctttaaaaaatcatattaatccatttttgaaatttaaaatagttgatactcaattaatcatgagctaatagctcacctcgttttgcgtatcttcccaatctactcaatccccttctcctcaaacacacccctagaatcctttgccatgaactttgcacttattctttagaagcatgatgttttagtactactttacctccttttcaggccatcgtttctgaaggttatagttcatccataggtcaaggctggacaggatttaatttttttcatagcaacatgttttggtttgtacaaacaaaaaatcattcagtacacacggacacacagctagaggtggagactatcagtccaaagactagtgatgcgtgcacatattgatgctttctctgttggtcatggtctcatggatgacgcgtaaggtcgaaaggaccctgtaagacgttagtgcttctcatcagggagtgagggtagtgtgcatgatggcaatgattgggtgcactcgcaagaggaattttcacttcccctcttgctcacccacctgtacaaaaaaagagaggaaaagggagattgtttgggagggtctaggccgtgattagt

SEQ ID NO: 22807 - DNA, 9689 bp, Oryza sativa
tttgcctcatcaacagctgagcatttgcaacttcaatcaggtacggaaagacacctcatggcttcttggcctgtcttttttttttctcatgaagactcttgaattctctgcctccacagatcatggtgggtgcatggcaggagcatcttcatggttcttgagatcgggagcagcataagcagtatgaggatggagaagaatggctgtgctgttccttctcctcctccttctcaagaactcttcagtttgtccatgcctttcatggcataattccctggattccagaatctctgggtggcttagggaggtatgaacaaaccggcaagtcataaatcggcaatagtgagctccgactggatcttactcctcagtttatcaaatttagtttcattcccttgtaaccttattccagttgtttcaactttctattgttcccccttacaaaggtcattgcaattgtatcttgtggaagcagataagaagttgtctcggtgtaatcttgttttgtggagtcaaatgtttgcttgtgtgttgcttgggaatattttatccgagatgctcatatttaccttgaaagatagcattattgttatatcttcttttacatcaagttatttcctttcgttcgaaaaaaaaatgcataaagttatttgcacgaagagacaggattatgtgaggtcggtgttggaagtacttaaggctctgtagcttcagtcataaatttttttgcttctgatagaaagaatgggaagagcatgtatgtgttgaatacttgaatctacgaacgtctaagcatgtactgagactgaagcactgtaattgcatcttggttattcttgcaagctgatgctgccaaagtgcttcccgcatactgcaggctagtactagagcacagatttccggcagatgtccagaaaagcttccttggacatgaacatacagccaaaagaagtgcttgtaatgctggagacagatgctttactcagtacttttcttgggagcttttaagtgtccaggaaagatagcatccttgattgatcttgttcgacatatcaacgctgccatctttcacatatcaacgctgccatctttcttgttgttcgatttgcaatgaagaggcaggattgtgtgggtgggtattgcaaagtaagaatacgtgccattctgtttatcaatagctcggtcacaaatatgtgttgtttttctgatgaaaataataatagaacacatgtaattaatctacaaacatctaagcatatatgtattgaaaatcgctgtctctgaataccgaagcactgcaggtggtaccttgatccatcatacgtcctagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatgatttatttatatatatatatatatatatatatatatatatatatatatatatatatatatatatatatatatatatatatatatatatatatttgtgtgaaaaaattgaataagacaaatggtacaatatttgataaaaaactaatagtgtcatatattaaagaaacggatgtagtatcatagtgctaccagagtacaaatttgcaacgtatgtctagaaaaagtgtcctaatgcatcaatattcagcccaaaaagggcttatgatgttaggggcaacctactccaaactttttactcggatctttaagtgttgagaaatgtttggaatacaattgtttgttccatgatacactattctgaattctctcaaagaatgtgcagttgcatacttacatgagggaagctgaacaagtgaacaacacattcatacagcttcaaatgaagaaaacatttggaacgaagcaaaactgccactagaggcggacccaggcccctaacaccctaggtcatggcctggggctggtgtcaaaagcccatgggccacaacaaattttcatcgtatataggttatcttactgttagagcaccacaggtcgccccaagccttagctataggctaggtccatgttgttgtaaccttgctcaggaacctgccacaacgtcagagttgtatgtgttctcaacaagacaaagcttttgccttaatgttgcattgggttatagtaatcctgttagatatagatcaaatggcaaatgttacactcgaatatagaatatataattgggaagttgaacaatgcttagcatcgggtgcccgacacacgcatggaagtatcggacgcaacgccattgcatgcaaggactgcgctcttagcctctcactctcaccgtgcgtccctccctctctccccatgtgcccctctctctatatacaccctctacacatgaatgcacaaaatcgactagtagtatctattaagttgtaaaacaatattttttactaatatatttatcaaatctacgatttaattgcaccatttattcgttgcaattaaattttgataacaatatttcgtatggttgcattccgataaaaacaatatacatgtttcacaccattaaaaatagatgtttcatgcgtgagaaacaaatgtttcaatttgtatttgactatgttgcacattcaacttttttttcagtatgtattttttaattcgttgcacgatgtattattaggatgtttcaataaatatgttctaatgttccactagttaatgtgtaaatgttgcacgtggtgttcttggtgtgtttcactcagtatcttacgatgttagtagttacaactatttttcttgtatggtataaaaatgtttcaattaggaatataatcatatatttgataaaaataatcatttgagattttgttttgaaaatttacttgtaaggagtataacaatgtaggagtaattagatagtatatataataaatagtttagtagaaaaatcatttaaaatttatttatgttgcatgtcctccttcttgcatgcatggagtagaccatttattcataagagaaacaaagagatagacacgtagacaggaaagatgcatactttttgtatcgagtagtagtactagtctactgcatttagggcagtaacagtgtgccacacattttcgccgaacctcgcttgccaccaaggccaggaacggtattagctacatgctctacagtggaggtcactcatggtgggtccccccactctctctatttctctctctatccccctttacttttcactctgcttttcatcacatcgccttttctatcgcgtaggaaatgaggcgtcggcacggagcgttcccggcgatggactcggatccaagcggagctacggtggtgtttagggtggaaaataacatctgagatctcgtttgtttagagatacatatatgtgtgggcgtgccagtgtacctgaatacacaatgtaaacaaaacataggaaacatgctctttattaatcttaaaagatcataaatacaaattcccaatgtaatatatatgtatgcgcgctccataatctgtcattggacagatctgacttgtgcgatgtggtctcctggttcctggggcctcgagaagctcccagttaattacctccgcaggtctaggcctgcaagagaacctccgattaagctgcttgtggtcgtctcgtcgtcttcacttcgcattctccatgcatggttgtgatgatgatgtagatgtgtgtgtgtgtgtgtgagcgccggcagcgatccatggcctcgtcggtccgtgcgccagtgttggtcgcccaccctccgtcgtctagccttgtcggtcttgaacaacgtgtcgatgtagattgttggtgaagacatgcatggagttgcgtagcttgaacgacttgacgtcacagcagttgcgtcgagattagattagagaagaatcagggaggaattattgaagatggttgatgtagacggtggccggatttaatcaaagctcggcatctcatttgggacaaataagaaaaaccaacaggacttcttcagcccacgcattggtttgtgcatggcactgtagcagcgatgacatgtcgtcctccgattggttggccacgttgccacaataattaacttaatcaacatgcattagctagcttgttgccatccaacagcactggctcgccgtcctcccgtcgtccttcctctgtactgcagccatacttgcctccatcgtcatccgctggtttcgacgccatgcatgatgcttgacctccggcatgagaactgatagaagtcttggcagtcggcggcagctccgccgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtccagggacaagtagcactgcgtcggcttgaacagacaccggcatcgatgaggcttctgtgacgcgtagatgaatcggccaccgcgacttccccggcgacgacgatacgtgtagatggatccctatgcatggatgtgtgcgtgctgtagatgaaagaaaacgaaacaatcttgctagcttttacctggactagccatcaagctcctctcctgcgcttgctaatgatcggatcaccgcgcgcgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctggctaccgaggggtcgacgccttatataggggtctgaggtcggtgctcgccgcgtccgcgcgccgtttcctccgcgtcaagttcgttgcagataaggcttgatcgatcagtttgttatttgttcatatccttctttgattttatctcttagcttctcctggcgtcaaatatctaatttgtaattcgctttgtttctctgctgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcctatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatgtatttgcgtgtatatacatggccgagcattgcgtagaaatgataagctagccaacttacaaactgcttgtttgctttgtccatcatgagtaagtcttgtgtacacatataatagccaaaataccatcaaataggtggacggcagggctacgtctctcctcccatcggcgggcgcgagcgggagacggcgctgacgggggcacggcgggagcttggtggagtggatctggcggtgtggccctctccgtcgagctgccgctgctgtggtccttggtggcgcggaatggcgacaacagcgaggttaagttgccgccgccaccaccatatccctttcctccctaggccgctgccaccaccatctttcttctcctcgcttggctgtcgccgccgccatcttccttctcctcgcttagccgccaccgccaccccgtcgagctcaccagatccagcctcgggttcgccggatctagcaagctgcaccgcttaggggatgacgcagctggtcggggcggcggcctcgccggcgaccgtcgccacttcgcacgggatgtgggggcatcgcatggggctacggcctctcccaacgcgccgctccaccctcgctgcaagttatgacgaagaacgggtaacttagtttggctccgcggacttcggttgggaacgccacgcacatatatgggaaggaatatctgacgtggatggttggggcagaatgccacctcagtgcactgtgaatgcccttaatagatggggtggggagagacaaagggctcccgagcctgacgcgtagtcttttcgggagaagctacaaacttcaaaaaggaaaaaaacactatgagtcccattggttaccctaacaaaccaaagcaaaagctgaaatttatttttgtcaaacttgattttgaagttgattgtaagatattttcaacgtagtttatttttcagtattggtttttaagtcacaaacatatatataaaaaccttacctataaattaattattatttattaataaattgttttggcttattaagaaatactatacgtacaacagaatgagaacttctttttttacttataaatgttactacggctacacttaatctaagcctcacatcaataccatagtgcctgtgaacctcgaatattaacgattcattcgtacaaaaatcctacaaaatttctgttaagcagtggtcattatggacagatccttttttttttgtccacacgaaaattctatgaagttcagacgtttaattgtccttgatcatcaaagttatatcgaccgtccattctccgatgtactcatcctggccgtccaccgctacgagccttctccccctcgtacgcatacgcgaaacgcccccccaccgccgccgccgccgccgtattcctcctccgctcctcccttctcaagcaaaccaccggacctccctcgtctccgcatccggtccacccctcgctgctcgggtgtgcccctcgcgttgccctgtacgccggcgaggcgctatctccacctcatcgtgctgattttcccttctgtgggtgtgcaggaatcatcagaaaggaggaggaggatatgccgctgggactgatactgagctcgctcggaaggtcgatgcggcgtaagcggctgtcctcgctcggcatcctctcctccaagagggcgcctcgggattactacaaggggaagaactgcaagcccaccgggttccacacccgcaaaggtaatgccttgcgggacgctctgtgatctgattctagtcgtctgtattgctcaagcatgctctctttgtgtataatcgcatataagattgcgaccaggttttgcttagctgagaaattttgtgatttcgaaccggatagtttaattaaaccgaacgttgatggagaatgaaatggtgacagttgctagtcaccacactatttgcccaaccggaaatctggaagaacctaggaagggatgttctttatgtgaatcgttttgttccaggatttatctgagtcaaccgtgcaagtaattgtctgcttactgtaatttgggaggtgctttcaataatgtcaaatatcgcttcaataaaaggtgtgagtaaccaaagtttaataaggcattaaagatctagtgagtagcaaataacatttcaattcaacaggtccatttcaactggtggttcagccaagcagaaatttctcatggacacattgaaaaatgctctatctatcatagttacataatggtattttaatttgtatggtatataatcatcctacagaacatagtaaatcttggtgctatcatggctgcagctgtactgtggctacgctgcagccatggcaaggtgcaaagcactattgcattggcttgcagccgcagcccacacaaccgcagcaaagagatccgaacagcctgtttgttagtctgccagaaagaaaaatattgaagagcagagtctggtggtattcagttcaccttgaaaatatgtaggcagtattcaacaaagaggcccaaacataaaatattgaagagcagagtctggtggtattcagttcaccttgaaaatatgtaggcagtattcaacaaagaagcccaaacatatctgtatgcaagtacagttttaccagtgctagatgattatgggtaacaaattacaggataacgcaaagacttatccatcagtggatatttgctcttagctataacttagccttgacctttctatgcaattcttgtttggagcacggacatgtttaaattttagttatcattgattagtttgattgttttgtgcaagggacggatacttctccattgtattcctgatttacttgatacttgattcaaatgacatttgtactaactattatatgatcattcaactgattgtcgttatctatgtccatcccttttctttcatgagtaaagcaacctacttgcttagtctaattttcgaaatattgattaattctgcaggtggatatgttatggtggatgagaagttgccaagatttgtggtccctgacttgactgatttcaaggtaattagcatactgccacggtttagtgtccactgcttctctggttaattccagtctgaacttgctgggcaaacttttaaaagtaacttaatggcacctaacaaacagaaaatagctaatataacataatcaaagctctcagttctgtttgaggtccttcttaagaaatatgatggaaataacttgccatgtccaaattttatctgaaaagatgatgacttcattccttgggcaatgagttgaatgctccataatccattactgttgaaacgtttaactcaggcaagacagataaattgatcatgaatggtataacatggaattcttctttatgtggtatgagtgaccaaggaatcatcttgttcctgttttttttcccttttcaattatggttgtgtgtatagtaataaatttcctgtataaatgactgcagttgaagccgtacgtgtcacaatgtgccagggacatcacagcgtcatcggcatcctccacttcagcagagactagtgaaaacaagaagtgatcttatggatgctctaggcattgtttgtgttttgcaagaacgcagagcatctttgcagttatgcttttcttatggtgaaaacaagaactgatcttagtgcatgtagcttcatcgtctgctgcatgttgactattatttagctacatcttttttgtaagagaacttgataggcagcatatattatctgaattgtctgttacatgttagctgtttctctggctctaataaacgtccatgtctggaggcatatgcatgaggtgatgccactggttgcaaatttgctgtgatataaaagtgagatttgatcatttgatcctgatcacgcacgacctatccactcgcaaaccactgaaaacaaagttgattatcttgtgctgtccagttaaactggaactgaatttctttcctcaaggcacagactaccaaacatgttcactcttggttgtgtgaagtttgatcaactgcaggcatttatacagactaccatagaaagtcataggtatgtctggcaaacttgcccaaaatcatgctagctccaaaactttggcacctatttgtaaggttgccaaa

SEQ ID NO: 22808 - DNA, 5301 bp, Oryza sativa
ctagtttgttccctccataggtggttttcacaggaataaaccgagctaccttggttaatcggtccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacgtcacaaagggccacgaactctgcaatttcccgcttcatactaacccaccagtatttctctttcaagtctaagtacatcttcgtgctgccagggtggatggaataaggactctcgtgagcttcctgaagtatcagctgtttaagttctctgacatctggaacgcatacccgatttccgttccatagggttccgtgttcatcctctgtgaaaccagcggctttaccctgtttcatattcttgaggagtccacgcatgtccggatcgttcttctgagcctcgcggatttgatcgagcaaggaaggcttggcttccagcgtagccaagaatccacgactaactatgcttagattcagggcttccatctgttgattaagttcgggtggaatgccacggacgacaagagtgttgcaatggctttttcgacttagagcgtcggctaccacgttggccttaccaggatgatagtgaattcccacatcataatccttgatgagttctaaccatctcctctgccgaagattcagatccgactgggtgaagatgtatttcaaactcttatgatcagtatatatttcacagcgattcccaatgaggtagtgccgccagatctttagagcatgaaccacagcggctaactccaaatcatgggtagggtaattgccttcatggggccgtagctggcgtgaggcataggccaccacatgaccttcctgcatgagcacgcaccccaatccttggcgcgaagcgtcacaatacaccatgaagtccttgcgagtatccggttaagactaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatccagccaaacctaagaaactgcgaatttgagtgactgtcttgggttgcttccaatcggtgacggcggtcactgtttcggggtccacagcaactcctttagcagatatcacgtgccctaagaatttgacttcggacaaccagaactcgcacttgctaagtttggcatacaattgatgttcccgcaactttcccaacaccagacggagatggtgctgatggtcttcctctgattgtgagtataccataatgtcatcaatgaaaactacaacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccggaacgaagatcaatcttggagaataccgtggcacctttaagctgattgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcggccagttcatttgctgccatacggtagggtcgcttgtacagaggagtggttcctggagcaagatctatccggaactcaatctctcgcttgggcggcataccgggtagttcttccggaaacacgtctccgaactctttgacgatggggatttctgacagtcctatctgatgaagttctaaactactgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagaagaatcagatccgaaggaaaaggaattccctgaatttctataggaacagcagggctataatactttgctgtcataacccctccaggggtggtgatgagcggagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggctttgggcatttatccgcaaagtgcccaggctcgaagcaattgaagcacagacgctgcggaccttgaacgtccctgcggccttgaccagactgcgcggctgtcgtaggaggacggggcgcacgggtcccttgctgactctgctgttgttgcggctgtgggatgcgcaccacgaattgaggtcggggcgcggagcgaggttgttgctgctgttgctgctgcgaggacgatccccctggatagggattggtgtagcggatcctttagttagctccctgttgattgcggaaattcgccaagcggcgcttgtgcgactccagttccttgtgcttggcttccaagcggatgctcttgtccaccagacgttggaaatccggatagtcaccggagactagacgcacggacagctcagggtccattcctgccaagaacttctcctgcttttcctcatcttcccgtacatcctccggggcgtaccgggccaggttgttaaactcatgcaaatactccatcacggagcggttgccttgcttcaactctcggaattcccttttcttaagggccatgactccggcgggcacatgggtcctccggaaggcggcggtgaagcgggcccaagtaataggctgcccctctggctgcgtagcctggaaatggtcccaccatagagatgcgggcccctgcagctggtgggcggcgaagacgactttctcctcatcgctgcactgcacggtgtctaactttttccccacggcatgcaaccaatccaatgcatccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctgggctaggatttgggtgaggatggcattggtgtctagtggtggtggtggaggcggaggaggaggtggaggtgggctgccatggttgttgtggttgctgccttcaggttggttgccatcaccggtgttagcacttctcctggtcgtcaccatctgacaaccccacacagatccagcaaacagagagagctgacaattaaagctaaccacccacgactaccataattcttgaatttattactgctattaaattggttcattaaagttcaagttgcttaggcaaataaaataaagacaggctctgacacagttataccacacaccggcataaccatgccccacacggctccaacaagaagacaaacgagaaagaacacacgcgcaagcctactaactgctcgtctaccgctgcgacgggccaggacggaaggtgagcaacagcgcatcctccgtgctaccaacgcctgaggcttccccctcctgaggaaccacgggcgcgggctcggcacgaggggtctcgacgaagcaggtccatgccaaggactggcgaacaagctcgggcctggaggtactcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcagctccaggatcttcatgctgttctcgaccatcccacggcgcaccatctgatggaagtcgatacgggccgcgtcgtacgcctccaccatgcgcgccagatgcatgatggtagcgtcatcctccgagctagcatcccgaaaggtggcgtggtcgcgggctcctccgcggcgagggtggtagcggtagggcgagtgctgcaactcgtccgggtagcgctggtgaagagtgccgatggcgaggagagcggcgttctggcaagcggcggagaaagaatctccacccgcggtgactgccaacgaagtcctctcgggagagccagtgaggatcactgcagtaacctcccaagcagcgtggggctctgcatcgtcaccctcctgctccgggagctgcctgccctggtagtccactccatgcggataccccaggacaacacacatgccccgcagctccaaaacaaagccagtcaggtccagaccacgacggttgatgctgccggccatctacaaacaaaaacaaaaagaaaagcaacattttaaagatcagattttggcgataaatgaagcggcaagacagagagagactagaggattttcacaaataagacaggatttttatttttgaaaatattgctaaggcttgggatctacggctcgtcctagggtcaagggtggctctgataccaacttgtcacgaccggaattaacccaacgggcgttccttacgtgcgtgtattattccttgtcccaggaggcaaggtacaccaagagttgatacatttcagagtatatcaagcggaagcgtaaatagttaatttattacatgggcgacgaaggcccagcacacacaaagacaaacgggaaacagcggaagactagggcgacgaccacaggcgcttgacggcaggcacgagctagacaccaaagccttcatcttccagaggctcctcttctgggtttgggaaaaattgagcaagactgagtacaaccatcgtactcaacaagacacacccacaagtgcagaataaatgcaagggagtacaagggaattataatataaagggttagggttgcagtaaacggcatttaaagacatttagttgctcaaagctattttgtagacacgattctagaactatacattattatttatcaaggccgtgaacccacacga

SEQ ID NO: 22809 - DNA, 6375 bp, Oryza sativa
ccgcgcgccgcgcgcgcgtgcgcgtgagccgcgccgagccgagccctccctctccgctccctcgctgccgctccccgcgcgccgttgttcgcgtgcgcgcgcccgcgtggtcgccgcccgtgccgcgcctgcgccgtctgcgccgcccggccccgccgccctgccgcgcttgcagccgcgcagccgctcggccccgcgagccagcacgcgtgcccgagccgcgccgctcaaaccgccgcgccacccattgcttcccgcgcgcgcgtgccatggtggccgaccgcctggtcgccgccgccgtcagcctcagccgcgcctgtccgcgcctgccgcccgtgtcgccgctccgctccaaaccgccccgccgtcatcgctgttgtcatcgactcggccccgcctctccccgcgctagcttccaaggaaatgaggcagagctcctcctccttctgccgcgtcacccccgctccctcctccttttcccaaagcggcaaggaggcaagccccctttccctcttcctttcttcttttcctcctctcgccggcgtcacctcctgtcgtcgttttggccgctagccgggcgccagctcgccggcttgaccgtccaatgtcggttcccctctcccaaaccgacattgtcgcccctataaacccaagctcattcctcctccaatctccctctttttcgtctctcgccgccacgccattgtcgccgcctcccgtgctctgttcgccgtcgccgttcgtcgttgcacgtgtcggaggagccggcacgagcaaggacgcggaaggggactccgggcgcgccctccccctcctcttcctcagcccgaggccgaaacgatcacgtttcgcgccgtcggctctcgtaactgcgcccgcccgcacggtagtgcctccctccgttcttcctcctcgttccatctcctccccttagactcgggtagtagcacgagtagcctccccgtagctagccggcgccgccccgaccgttgccgccgctcgccgtgtgctcgccgccgtcgccgcccgagctcggaagcgcctctcgtcgccggcctcactcgatgcgtttcctcctaatccggcgcaagggacggattcccgtagccgcgtagatgctctcgccgccgggaatcggccccccgtgacctcgtcgccgttttccccttttccctccgccggttgccgccgccgcaatccgccgccgtcgagctccctccggcgaatccgagccgttggctcgactcccctcgtcccgtgcaaccacccggtgtgctcgctttctcctgtatcgccgtggttcgctccgccgctcgccgctgttgtccgccgtccgttccggccggcgtcgtcgtctacctcccgccggcccgcgtggcagccacgtaggcgccacgtcggccccagctcggccaagaccgggtcgagccgaccccggtcagccgctcccctcggccccgctcgcgggcgcggtccaccgcgagcggtgaggctgcgcgtgggcccgccgcatccgtgtcccccgcgaactgcgcgcgtgcaccgcgtccctcccccaaaccctagcgcgcgccgggtgcgcgttccgcacggtgaaccgtgtcaccgacaagcgggtcccactcgggaccacgcgaggtgagcccggtccaccggctccctctctcctccccgcccgcgcgcgcgctctgggtcgccttgttgggccggccggcccatttagctcggcagagccgtcccttttctctcgggccgcgccctagccgcccgagggaagtctaatttttccccctccttcttttcttttcttttctttttcaaaaaggatttaaataaatccttttcctttagaccaaaaatccaataatcttagaaattcaatatcttcccaaccgtaggtccgtttgactccgttcaacttccaaaattcctaatctcgagatctatctaatggcacgcttagaggtaattaatagagctttattttcgccgtttattgagttgtcctgttttgcgtatagtttcggagcccgaagacccgcagtgcgaggatttcgaggatcaagctcaagatctcgagcaaggcaagccacctttgaacatctcgagcctatatttgaacttaattatgttgcttgaaaaatattatgcattgataggatcgcacttaatctgcttgtcccgtctgcaaggcagaatggcagcctacctaatttgttgcatttgatccttccttcgttaattgttataccatgttcccttgtaaccacccagttgcgcctcggaaatcgtgcactctgcgttcagacaggaggcaagcactgtcacgaccggaattaacccaacgggcgttccttacgtgcgtgtattattccttgtcccaggaggcaaggtacaccaagagttgatacatttcagagtatatcaagcggaagcgtaaatagttaatttattacatgggcgacgaaggcccagcacacacaaagacaaacgggaaacagcggaagactagggcgacgaccacaggcgcttgacggtaggcacgagctagacactaaagccttcatcttccagaggctcctcttctgggtttgggaaaaattgagcaagactgagtacaaccaccgtactcaacaagacacacccacaagtgcagaataaatgcaagggagtacaagggaattagaatataaagggttagggttgcagtaaacggcatttaaagatatttagttgctcaaagctattttgtagacacgattctagaactatacattattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggtgcggctattcgaataggttatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccagaatctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtctacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagttggggttttgtttattctagggtgaacaaggaaataataacaataacaataataaggtcataacaaaggtaaataggcatggctaaataaaacagtgattacgcgggaatttaaataaagcgataatgcaataatttaaatcaacatatttttataaactgggattcaatatgttcaaggatgatgtgacttgccttgctcgctttcccaaacgccggcttcaacttccacgaagagcggatcttccgaagctgcagcgtctacacgaccaacggaaaagaaaaggctttcactctaataaactccatataacaagcaggaacaaagcacaaaaataggttcttgacttcttaaggaaaaattagagacttgaacggtccaattccgagttcaaatggccaagttatggccatttgaagtttatatgctctttaaatgaatatttgcgaatttcttcatttaaaatttaatttaaaaatggatttattgcgtcagccgaggggaggggcgcgcggaccgggtccacgggagtggggcccacgcggcagcctcacggtccacggtggaccgggcgcacccgggctcgcaccgggcggcgccgtgggccccacgcgtcagccgcacccgagggcgcgggcggctgacagccgggccccacgcggcagccgcacggtgcgcccgaaggcggccacgccggcgcagcggcgggaggcggcgcgcccgcgcccctatggtcgccggcggcggccataggcacggcggagcggcggccgagagaggggaaggggagggggaaaagaagcggcggtccacggctcaccccgggtcgacggcgacgacggaaacggcgaccggagcggaggaagacggcggcgcggctcgggtggacggggtcgacggcgttccggcggtcggcgaatgaaacggaggggtggacgaggtcgccggggatgcggtgaagccgaaggtggcgacgccgaggcgggaggtggtccggggcgacgacggcggcggaccggagctcggcggtgacggcagagagagagagcgatggcgcgagctcgattccgacggggagagagggcggcgagtggcggaaacggtggagggaggcacggggagtgtttatatagggtcgggagtgagagagagcggccggacgaggaggaaacgggcgcggaagatccggccgccattgatggcgccggcgaggttaggggagagatttccaaacgaatccgagggagagagggagggaaaaatggggggaaagagggagggaatcacggggaatatttcccccctcttgattgcacgcggggcagacgggggcggcgggattcgcggcggcggcgggagcggcgggaggaaggggatgacgggtgggccccacccgtcagcgagagtggcgggcgggcccgcccgtcagcggcgcgcgcgcggggaggaggccgaatgggccgcggggagaggagagggagggatagagagctgggccggaccggccgaagagggagagggggagggaaagggaactttttagggtttttccttttataaaatcattttaactttgtttatttcttaataattattatttgtgctctgaaaattccactaaaatttatttacgcattttaggctattaggaaatatacaaaaatcctccaagccttatttgacttttaactttgcacattttaattgtggaggctttcacatggattttaattattctaggcataaattcgaggatgtattttagagtcgttttgggacgcgacaaacctaccccccttaaacggaatctcgaccccgagattcggaagaactggcgaagagatccggatgggctgccttcagctcgtcttcacgctcccaggtagcttcttcctcggcgtggttgctccattggaccttgcaaaaacggattacccggttcctggtcctgcgctccatggtgtccaggattttcactggcctctccacgtaggtcaagtcttggcgaacttcaatttactctgagtcggcctgctcggatggcactcgaagacatttcttgagttgcgacacatggaacacatcatgcacgttgcccaaggaggcgggcagctccaactggtaagcaacttctccgcgtcgagcaatgatgcggaaaggacccacgaaccgaggtgcgagcttccctttcgtctgaaacctgtgtacacctcgcaatggcgtgacccgaagatacacaaagtcatccactgcgaattccaggtcacggcgtcggttgtctgcataactcttctgccgagactgggccacctttagattatcccgaatggttctgactttagcttcagcttctctcaggatatcagtcccgaacacttggctttccccaacttggtcccacaatagcggtgtccggcatttgcgtccatacaacgcttcatagggtgccatttgtatgctggcttgatagctgttattgtaggagaactcggcataggtgagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacattttcttaggaacgccatggaga

SEQ ID NO: 22810 - DNA, 1405 bp, Oryza sativa
atagagagctgggaccggaccggcccaagagagagagggaggagggaaagggaactttttagggtttttctttttataaaatcattttaactttgtttatttcttaataattattatttgtgctgtgaaaattccactaaaatttatttacgcattttaggcttttaggaaatatacaaaaatcctccaagccttatttgacttttaactttgcacattttaattgtggaggctttcacacggattttaattattctaggcataaattcgaggatgtattttagagtcgttttgggacgcgacaagcactcacttagttgttttcagaaaagatatcaaataaaatcaattgcaaaaacaacagcctttccttgaagtctgcattaaacacttatttcccatggcttgctgagtactcccgtactcacccttcctctatataaataatcccccccagttgctgaagaagatgaagcggatccctctgatgacgagttcttctaggagcaagccggctacgatgagttttagggtttcggcctagttcccaagtcgcgcctgtgttgtttggtccgagtcttggcttccgcttcccttttgtaatgcagttgtgagctcgggatctgtccgcagcctaacatgactgtacctctactctataataaagagacctctgttgctgtgatattctgtcttcctgtgataccaggactgtttcctgggactggtatcgattaacaggttaatttggagcgtcacgggctagttccggtcgggactagttcggggcgtgacaaaaactcttttatatttgacaaagtttattgaaatatttagcaacatctataataccaaattagcttcattaaaagaagcattgaatatattttttaaaaaaaattgttgttttgtgatagaaattttgttatactttttataaatatagtcaaacttaaaaaaagtttaataaaaaacattcaaaacaacttataatatgaaatgaagggagtatataaatagtgataaaatttgataagataatttaatatgtaatatcaaatacggatacgtatttgcaaaagcaaaggaaattaaaacccgactcatacacgaatgacttaccaaagtaccggtaaaatcatcttaaaattttataatagtagagaagagatagagattttgattttttttctagtaaaactcttttatatttgacaaagtttattgaaatatttagcaacatctataataccaaattagcttcattaaaagaagcattgaatatattttttaaaaaaaaattgttgttttgtgatagtaattttgttatactttttataaatatagtcgaacttaaaaatgtttaataaaaaacattcaaacacttataatatgaggatgaagg

SEQ ID NO: 22811 - DNA, 1391 bp, Oryza sativa
  unsure (1)..(1391): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctactcttactttattggtgttttttttcgaacaagattttatgataaattttttacctatacaaattcgatttcttagtttacatccaaacacggatgaacgatgaacggatccacagtttgccttagtctctctaaaaaaccaccaccttcacaaaacccgctaaactcatatcttcgtagttgccggagatgaacattagagttggagaaagcattgcgaataatttaaccggatggttcaaaacatgtcaatattcttttgtaagaaaaaagtgtatctttcccattatttcccgtcaaatgacatttatcaaatttgaattcaaatctattatattattaaaggaatagaaaaaaaagccttcaagtttgctttaatggtctagaaatttccacattaataggagaaaaagaaaaaacagagtctatataagaatacaatttaataatagctgaaatttggaattaaaagtaaggaatataggaagctaagattagagtctaaatcggtatacaatagaactaatggaaattcagaattaaaaaaataaaaaaaattaaatgtaaaggttagagtccatctagaaatacaatttagaaataaaaaaaatcgaaattaaaaaaatatattggatgaagaatatagagtccatatagaaatagaatttaaaaataattaaaattcggaattaaaaaaatattgaaagataagtttagaatccatatataaaaatacaatttagaaataatagaaattaggaattaaaataaggaatatcggaataagagtacagaatacatataagattttaaaatttagaataaaactaataaaattaaagtagaatttagagtacaaatagaaatacaatttataaataactaaaattcaaaggaatattggaagtttgctctcataagagcatctccaacagcctctccaaatctaactctccaaacacccatatagccaactctccatttgatttggctagtcaaactagttgttcactccaatagcctctttatctacgctctctactttaactctatgggctagtttggtttgtagcctaaattggccttaccaatttttgtcaatgtcaaattttggcaacttttggcatggctaattttggcaaaagaaaaaattgtgttt

SEQ ID NO: 22812 - DNA, 1778 bp, Oryza sativa
catatgtcagcatcggctttcttctttctccctagccttcccctcttcctctttttttctcgcgttggctgggagcagacgacgccgacaagctgggaggggacggcggtggaccggtggtgggcgcggcggggagcttgtgccgcacgggtggccgcagcgagcggaggcggcagccgcggcgcgcgggggacagcggccccggcgagccgagacggcgggccgcgccgcgcgtgggacggcggtcgcggtgagcgggggcggcgcctcggcgcgtgggggtgttgacagaaaacacgaggcctaggagatctgcttaactccagtgcatgtccaaaactcgccttcggatgtatgagcgtgccagttgatttgatcctgcaatcaacaagaaataaaacaaaaaaaccgcaattaatcctataaatgatagccgatcagctaggtgccgatgacatatcatttatttcaagccgatgtcatgcgtacatcgatcggcaaatatcaataagcaaatcagaactaaatctactcgatcggctgtaaatattaatgatatataatccttatatcgatatatacttaaatcaagtgattgagatagatcggttgccttgccgagacagtataaatcacttagatcgaaatatatattaatagtgggattatatacatttatagcatagccgatcaaatggatctagcatgtatcggctaatactccgataccactctatattaagatgttaaagcaagtagaatatatcaaacagaagcctaatatatttagatgcgacaaaatcttaacataaagggcagatttaacatatagattaagcatatggaataaaagtagttaaatcagataagatcggctgaaactccgatactaccctgatcggcaaccagaaagcaggctagagattgcagttctaaacacgacttaatagatcaaactcaactgatgtagcattaagtatgaaaagaaaaaacaatatctagacaatcaagccgctggaagttttatagagtggtagatatatcacataatctaagttaacattgttgtctaacctaatcggctgccttccattaacagatgttagtcgattataggttagataaagatattatcgaagattatatgagatatatgataactcgacgaattacatagacaagattagagtatcataaagatggaagcactaatcctaagaacataaatcgtcgcgacaagttttacctcttgttgaagatcgaagccgatgcagctcaacccgaaagcacaaactcgtcgaaataaaagtaaagcaaaaagggtggcgatgcgccgagattgtattgaatgtcctttttttttacatagggctcgggtctatttatacccgagaattacaagatacgtccataacagacacgactattatctctaacaaactctaagataccataagtctctatagcagacttttgcccaaacatatctctaaggaaattacatagaatattctaattaataaatacaattgccttcccaggactctatccatgcgtggcaatcatcttgaagcacatcaacttaaacccgatgacgtacaccgggtcatattatcgaaattggctgtatcggctagccccgtctgactcgaactctgccgatcctgaccttagccgatttggactgcagccgattcttactttgtttccgcaacgatcttcatcttggattccacttcgatctgatcttcatctccgatgccaatagtgatagaatt

SEQ ID NO: 22813 - DNA, 8079 bp, Oryza sativa
catgcaaaattatgttgtcattttaatatatttgaataatacattgagaaaatatatatgctattataagagagaaaatatagtaatactagccgtgcaatctacgcgggccactatgctagttactgtgaagtgaacttgcaaggaactgaccatgcatattcgcaaagtgaattattcaaccagatggttcaaaacatgtaaattttcttttgtaataaaaaagtgtaattttttcccatgatttactgtgaaatgatatatatcaaatttaaaattaaattactgtgaaatgcaaggaattgaccatattcctgtgaaattccgtattcactactgccactcggtacatgctcattgcccaggtaagcagataccatgtgatatacggtaaccggagtagatgggttatattgacgatggttcgtggtttattccttctggtgcaagtgcaatgctaaaaggcttcaaagtgcaaacatatcgcagtggtccattaatccttagtacacaaagtcggatccgttgacatggccccccaagaggacaggcttaaacagagtcatctttcttgagctgtggtaggtactaatcaatgaccttccttcatctctgaatagactgtcatatcgtagtttagcaaacgtaaacgacagctccttcaattccagcgataaaaaatgaaccaaacggcggtcaatacatgcggtttcgcatgtttatcgtttttgttgttgcaataatcaggtcaaatatattcacgcttcacttgagagcgactccttaaaaaaaaaactttggtcagtcaaactcacacgatcgtgccaaaggggtactcatctttttttagtgtcaaatcaactttagcaaaccacaacctccccaggggccagggggtggttaaaagggtgttaaacttcccgtgccatgcatgatgcaacctttttacagtcttgtaaacttaacaaagatgaatcaccccctgacatagtagataaagtccatgctactttatgggcagaaagcagcactactcctactatactgtcctactactaaaacctgggtatcaaaaaggacacctagctaaggtaagctaaccactactctcgcagcgttatcatggcagagattgcaccaacatgagaccacctgctctgctttgcatctcccagcaggagccttgctttgcatctcctagcaggagctcggctccagactccagtgcagcactgcagcggctagccgcttgcatatgcagtagacatgcagatcactttacgcgatcacgtcgcatcaaatccgtgctcgatatggcctaaatccgtaaagtaatctgccggcgctgattgctggagtgcgcgaacaagggtcaggtgatggccgaaaagttaaactgcaaatgggcaatttgggctcgaagttaaggagaatctcgcctgagttgagatcgcgctgcacgtgctcgcggtcgcggcctaaaataatttactagtagtaataaaactatacaagtaggagcatgtgcaagacggtcaaattgaaaaatcgatacaaataaccggtcgtagcgcgtgcgtgcgtgcactggcctgtctggtctatcagcttgattttcagtctctgaggtgtgctttaaccacagtataaacgtaaaaggtgtttaaatggtgctgtcaaacagagatggacgaacaataagttttttaaggagtaaagtgaacgcctgatctctaaatttgcatgtgttattaggttaacatattctcaaatataaatttaagatccagaacttatcaaagtgtgtcatcccggtttaaaattgtcacaaccatattggatcctaaatggtgccgaagcctgcaagctagctcgggaagctagcgtccgcaggtgtgtcagcccttcttcatcttctatgggttccacaagtgaaactttggatccgaccctatacttggttgtgtttagttcacactgaagtttggaaatttggttgaaattgaaatgatgtgactaaaaagttatgtgtgtatgaaaggtttgatgtgatggaaagttggaagtttagaaaaaaaaaactttggaactaaacagagccaaaagtcatggcctcacctcggtcaacccgtaggttgaaaaatcgcctcggacctggcttgtaggtggaaaccgcactgaacgaaaaaattgctatcctagtttagtatatgtaatctggcagtaattaaagttttaaatgtaggccgaaaatcaaagttttaaggcttcgttcgtttgttatggttgggaactctcccattggcagaaattacgaagcaattcattagcacgtgattaactaaatattagttagaaaaacttgaaaaatggattaatatgatttttttaaaacagcattcgtatatacatttttttaaaccacaccatttagtagtttgaaaagcgtgcacgcggaaaaagaggggcaggagttgggaacagtaagtaatgaactcagcctaagggcatctacaaccaaagccacccctagagtgtcctcactaactgagggtactctctatgaaactcatctctcaatggagaatacctctagatgggttcttcaaaatctgaggccacttgatggagaaacgccagctcataatgggtgtcccagcccaaggtaccctagtgaaaaaaataccaaccgtacccctcctcttttttctcatttcgcctgctcctctctccgccttgtctcctccgctggctcctctctctgtctcatctcctctgcgaagaaggcgacggcagtcgcgtcgagcgcaaggggtgccaccggcggttcccgtcgccgccacctccctcctcgccctctccagcaatcgtcgtcgactccctcctcttcatccgcaaccccatcttgccgccgtcaccggcctccagtcgaagtggttccggcactggcggtggccgaaggcgacagatcctgcgtcgtcataggcggatctgcgcccccctcccccccatggccagatccggatggagcggcaccggccgcgccacatcgagacattggacaaacacaacaactactactactccatatgcaagcacggggacaagagtagtacgctgctggtgcctggtgatgagcaaatggatcattgaatggagtgttggactgcctcctttaggtggtgattgaattcagtcacttaaagtcacttaactttagtctttatatttaaatactaattaagaatttttaagcctaattaatccacaattagagaatgtttactgtagcatcacataggctaatcatggattaattagactcaatagattcgtctcgcgaattagtccaagattatatctaagattatggatgtgctttattaatagtctacgtttaatatttatatttagtgtccaaacatccgatgtgatagggatttaaaagttttagtcccatctaaatagggtcttaggcctctttgggaaacatggacttgttccaagtccctgtcacatcgaatgtttggacactaatttggagtattaaacatacattaattacaaaacccattccataaccttgggctaatccgcgagacgaatcttttgagtctaattacgccatgatttgacaatgtgatgctacagtaaacttttcataattatagattaattaggcttaaaaaattcatctcgcagattagctctcatttatgaaattaatttttttattagtctattaatactccaaattagcgtccaaacatccgatatgatatgtactgaaaaaattttagccccatctaaacacccccttagacaaatgccaatcctataaatgctgcttcaccagtaccaaggttgttaggatcgggataccaggcagtatcgttttgctcaaagtaatatcgcatcgtaggatcgtatcgtagtatcgggatactatgagattttctttttttaagtttaattaatatttatattaattatatatagacattctatataaaaaaatgtagtaatgatatatgtcatacaaatagagacctttatcaagagaaaccatgttggttttgatatatttaactgatttttatataattttgagtatatttatttacattattttcaaaccatgatattttaaataatattttgtagtatcgtagggatcgtagaatcgggataccacctaagattttataggatcgtgtagtaatgaatagtaggatcgagatactatgaaaattaggatactaggtgggatcggtatcgtttcagcttggtaagatcgtagtatcgtagtatcgtaagatactaggatatgaatcgggatactgacaaccttgactagtactagacatttctatgtcacctgcctatgcgatgcgcctcatctacaaaccgcaagggtaatagttcgatgtcaagaaaaaaaaaagagaaaatcccctgtgtactctcgaaagttcacctaatcccttctgtaccccttttgtacccctgaattttgctcaatcccttacatacccctgaattttagtttggatccctttcatgccctttccgctagttgaccgttagttgaccgttaaattcttatgaaaaagtccattttgccctttggtataaagaagcatataaattaatagagtatattgttagagcatataaatttgttatatgagactattatgtttatgagatagttatgcaccatattatttgtgataaatatacttagatatgacataaaaattaatacttatttattagttattaaaagattttttttagcatatgtattctgaagtaataaacaaatctgttgtattactatgaaaacacatatgctacataaaagaacttttaataactaataaataagtatcaactttttatgtcgtatgtaaaagtaaatttgttacaaataatatggtgcatcacatactcataaatataatagtctcatccaataaatttttacattccaacaatatacttcattaatttattatgtttcttcatagcaaaggggcaaaatggactttttcaaaagaatttaacggtcaactagcggaaagggcatggaagggatccaaactaaaattcagaggtgtgtaagtgattgagcaaaattcaggggtatagaagagattagatgaactttcatggatacttaagggattttcttaaaaaaaaggcgcgattattgcatgcgagaacttgacaaaatcgcattctttcttgattctttctctatgggcctaaagttgatagtatatactaatatttagagcgtgtaaatcaatgcattagctctctcacggaaaaaggaagatagtaggccaaaacaacggtctacatgctactagtacatgccttgaactggtactccaggaacattaaaaccatatttacctgatctatgctgcacatcgcaatgagcagcagagacacttccatcgttttgagcttggtgggcaaaatatgggccaatcctcccagccacaagttccgctgtgatttatgaccggagtcggcgcccaccaaccggggtgcgtgcgacctgaccagcaccgcacatcggcagcgaaaacccctccgttttttcttcatctcttcttccatttcgcttctcccaccaccataccaccacgggtcataaccccctcctcctcctctcatccacccaccgtcacctctctccctcctcaacctctgcttggctgtctgcctcctcgcctgtcatctgtccctctcatcagcagcggcgcacgggtcaaaccaagagccgcagcatcgccaccaccattcaccaccgccactcagactctccaatggcggctcctccccctcctcctcgtcaaaaccgcccctctcctctccttgtagcgggtagttgcttgtcgcgagtagggacgaatctgtgctaggggcgagaggtgtgtgcgcgctctagggggcaatggaggggatgtggaggaaggccaagaaggcgctgggcgccggcctctgcgttcgcctccccgccgtcgccggcgactgggaggacggcgtcagcgagcgccgcgcgtcggatgcgctctcccacgacgcgtcttcggcggcggcggcgcatgtgtcggcgccgaatacgccggccgcggcgttgccgggagcaggcccgctccggaggtccaagtccgggaccaagtccgccaaggttaggctcttctccttttctccctcttcttctcattgtgagttatataacctgtgccttggattgtatccgtggtagccttggttcggggtggctggatgtgaaatgcggagcagattggggtttcctccggggttaggcgcggatttggagcaatgtggcttcacccgtgaacgatttagattcagatgtgcttcccctggccgacagtttttggttgcagtaatgggcgtttcctttgtttgtgtctactgtctagcaatttttttttgtatgcatctgtttttttaatactgagttttgtcttgagcctcgcctctgctagtttggatttgtcattacctttgttactttgtctgcaattgaaatcatcctatgttgtttctgaggaaacatgggtcttgcccattttataataaaaaaaccattttgtgtgcagattttgatgattctgcaaactatttattctctaaattattcaaaggaatatccaaaaaagaaaagagatgcatccgtcattggcttcatcttgttgctccattcttcgtgtcatgttccagcaaactatcataccattttgttcttcaccattcagaaaggaatcaatttgtgttttatagcttctttttgggctctgttgtatttatttcatatcttccatagtacaaaaatttgctgcttgtttctttttctcaaatttatacgccaacagagattcttacgaatttctatcagctatcagtctgctggtatttttcccctcggtatcgcgcttcgttatgggttaattcaaataaaaaaacccagttgttttttttttctgtctaagatacattcatatcttaacgtaagcttcttttctactgttccacttgctcgttccggaatgggaaagttcgcttctttcctcagcaactccccatgtgttcacgtgtagtatcatcctgccgtctctctcttactccgttagtactactactacgtactccaactccaattaattttgtaaaggcgtgttttccaactgtagctgtcatccatcactgaaaatttgtatcaccagcctcttattagaattaccttatactgttctttttatatttatctttatttagttgtcatggcatgtgcgtgatctctttgaatggtcaatgtcaatttgtgatgttttctgatacaatactattttttcgtgtggtgttcattgatgccttttattgctgtgttcacaccttttgtttagtagcagttctgatttagcgagatattgtgtatggtagtgccctgtttgaccaactacttcacgaggatttcctcattactcattactcaattggttgacatttatctgccttggtcagaagtgaagacttgaaaagttctgataataagcatcgcacagttatttattgtgatttccgcattactgcctttgctaagcttgatttgtctatattatcaaatttgacaatttggtaaactggcatgaacgcttactgtgtttagttgaatatattgacacgcatgcaagtctgacaattctttgtggtttctctggtttaaaatgattttatttgtcaaggtaatgccgcgaaatgcaacatatattgggtgcccaaatgcaaaatatgtatttcttttaagttatcagtaaggaaaccgtaaaatcaggtgtgctgtttccattggtatttatgacgtgcatacgttatcataaaatataaaatacagttgtggttgctgacttggtgttagtcaaaagatgtatttgtttgaacatgctttggtttttatgttttagtcaaaatcaataacagtacctatcttaggtcctgtttagattccaacttttttcttcaaacttccaactt

SEQ ID NO: 22814 - DNA, 8140 bp, Oryza sativa
acacagccttagcttatgatggcaccaatgaactaatagatccaacaccttgtatgtcacaaaaaaagatggaatggatgtgatatgacatcaattcatttagttctggtatgtgtttgtgatatatttttgtttagctttcatgtgaggccctattcgagttgccatattgatccaatgaaaataaatcaagaaagtagtaactttagtccatgaattgcagtttgtgtctatccgactatgtttcagaaataacaaacaaatatattgttcgacgtggatacactttgatgaagaattgggatgaaaaataagtctggataatggtaatttaaggtgggcctaagtaaatttgttgaacatgcagattagtggagatatctatgcagatcttggagttgattcagaatttgagatcggcttctgtcatagtatggcaaactctaggcagggcttaattctgtacagtggaattgatctgtgaagataaggacttaaataggggtgtacggggtgtggatatcaggacaaagggttgttgttatatgccagtctgttcactatgttggatgtaacatacaaaaagttttgttctcaataaagtatcattaatatcagttgaaccgtcttttcgcagcaaggctcatctttaagcccttatgtttcatgttttaaaacacatgtctccatgttgattgcacatttcaaatgtgaaggggtgagttctgatgttgcacaattaaattgatacatctttctttttttctctcaacagggaatgtgcgcaatatgtttcgatcccatgaagtcaggccatggacaagcacttttcactgctgaatgttctcacatgtttcacttccactgcatctcctccagtgtgaaacatggaaattatgtatgcccagtttgtcgagcgaagtggaaagagataccctttaaccgctcgttatcttctattgtacctcgtggtagaagtgggttgaatgtgaatcaagctcgattaccccaacaaggcacctacatggctcttctacgccaggttccaagtcaccatcgagaagcttctggttcccatacttctgagccagttgatttcaatgacgatgaacctttgcagctgatagagtctggtgacagtcgtgatgctagatgcagtagagctgtggagatcaagacatatcctgaattctcagccattccacagtcgtcatctgaagatgattttgctgttttgatccatctaaaagccccttgtgctaacccagaacaagtcacaggcagaccattcaatgccacctcaattggataccctacatctcgcgctcctgttgatctggttactgtgcttgatgttagtggcagtatggcaggcaccaaactagcactcctaaaacgagccatgggttttgttattcaacaccttgggccttcggatcgcctttcagttattgctttctcatctactgccagaaggttgtttcatctccgacggatgtctcactctggcaggcagcaagccttgcaggctgtcaacttgcttggtgctggtggtggtacgaacattgctgatgcattgaagaaagctgccaaggttattgaggatcgcaattataagaatccagtctgcagcattattctgttatcagatggtcaagacacatacaatatttcctcaaatgttaggggaacccgtccagattataggtcacttgttccatcttccattctgaatcatactatctgcacagtgcctgtccatggctttggttttggtgcagatcatgattcagatgctctgcactcaattgctgagtcctctggtggtacattttcctttatcgaggatgaaagtgtgattcaggatgcatttgctcagtgcattggtgggcttcttagtgttgttgttcaggatatgcgactaactgtggaatgcgtgcatcctagtgttcagcttcatactatcaaatctggtagttacttgagtaaggtggctggagatggacgaaatggatcaattgaagttggtcatctttatgctgatgaggagagggacttcttactatctttgagcttcccacaatctcgtgatcagaccatgcttttgaaggttgcatgtgcctatagagattcagtaacgaatgaagccatcaagattcatgcagatgaggtaaaaatcctaaggccaaagtcacctacgtctgagccagtttgcatggaggttgatcgtgagaggaaccgtgtccgtgctgctgatgctattgaggctgcaagggcagcagctgagaggggtgctctttctgatgcagtggctattcttgagcattgtcggaggatactctcggaatctttttcaagaaagagtggggatcgcctgtgcatttcccttgatgcagagctaaaggagatgcaggataggatggctagccggcaacgatatgaagcttcggggagggcatatctgctatctggattgagctcacattcttggcagagagctacaacgcgtggtgactctacagacagtaccacacttgtttactcctatcaaacaccatccatggttcagatgctgcagcgctcacagaaccaatgcccttcacctccgggcctgaggccgcagctccgacaaactaggtcactcttggagaaaccccatccaaggtagaaggcagtttgccattgtctcttgcgaagcaagtgcaaagatgatggtgtagaaatttcattggtgtcattgcttagtaggtcagtagtgcagtagcttagcattcatcctttgttcttctgttcaagtcaaggatggcggtataccggaaatggggaggtgagcttggaggtaaatatgtttttgggggtatactggagaaagtgaatgggggcttggtggtaaatacattgtgaagggggcctgggaagaaatagtagagaactggagcagtggtgtaattgctacaaggagtaagattgtgtaggttggtaatttagattgtcaggatgtttctaattgatgaacctcttttcattttgccttttggtgatgtaaagggtctggtatgggggaggtataccatagaatcttggggaattttgatttggggtggcaatgtaattccatggatttcttgtttttattcaccagttattaattgctggtgttctgctgtcgccttgccgtgaattgcaagtattatccactacatgcacgtccttacttttccgaattgtaagtattatccagttcattcatgcccttgtctttcagggtcatatatgctgatataatctttcttgtgccttattacacaaaccgcacatgagtacacacacctttaagatatgctcataagaagcaaaccccctaacctcacaaaatcaatattgactaaattcatattgaaagtgaatagactaaatttagggggtgtttagaactatgggtgtaaagttttggcgtgttacatcaaatattatatagggtatcgcatagggtatttgggcactaataaaaaaataaatacagaatccgtcagtaaatcacgagacgaatttattaagcctaattaatatgtcattagcaaatctttactgcatcaccatattgttaaatcatggagtaattaggcttaaaagattcgtctcataaattagtctcaatatgtaaaattagttatttttttggcctatatttaatacttcatgccagtattcaaacgttcgatgtgataggatgaaaaattttagggtgtgatataaatagggccttatattgaaaatgtataagcgatattgataggttgtgtgaagttatacttttatgattttaccgccagtgtaattacatgtgaaagtttttagagattttttatgtcgaaagttgtacttccaaacgaatttgctatactactatagtaatttagggaagaaactcgatatagatatttcggggaaccgtgggatacacttttaagggaaacatattcgctttttcgaccatgggatacactttaagggaaacatatcctctaactttgtgcagtctgtagttgtaacactgattatatgggccctactttgttatggcccacatgtcagtgatacaattgcacactacataaagttaggggagtcttttttacttttaagattcatgcacaggatagagagcaaaaattaaacactccatgcaaggtgctagagtcaaacccacaacatgccaacgacatgctcgcgctatccaccaccaagctacgtggttttagttataatgcaattacatagtacttatactttagttacacatttgttacaatgtacctatattagttttatattgtaattatatcttaataaagtttttaggaacttctcaatggaaagttacatgggtagttcctttataaaatctctctcatgaatccactattacgaatgattacttgaattttgagagatcacttgatcattaacaccaggatgccagatgcgtcaagaaaaaaaaacactttcaatcgtcaacatcaataaaaactgaatgcatatggatcactgactcattgtcattgtcaaataaaaacagatgaaattcattaaaaaacgaaatccttatgatgctgttacaattgatttcctcccaaaaaaaaaaaaacaacctagattagcaacctgactaccacctgaggagcctcctccctggctgcaatacctgatacagcggatacggcacgtctgggctgtcgggaaaggtcgggaaatccgtcgtcacgccgcaccgcggcgagaactccccgctgcccacgcgatgcttgcactcgatcaccgtctgcatgcacgacctgcagtacctcgccggcgtcgtcagggtcacgtccaccgccgcgtccccgcggcggagctcctcggcgaggcgctcccgcgcgaactctgggacggcgttcgcgtggccccacgccatcacggacctcgcctccgtggtgttctcgttcctcccgcagagctccggcgcgggcccgctcgccagctggacgccgcggtaggacacggccgccgtcgtgccgcgctcgacgcacgccacgctgtacctgcgcggctccttgatgcggacggtgaggtcgaacgtggggtccagcgtgggccgcccgaggtcgcggtccgggtcgagcccgctgacgccggcgacggcgacgctgaactccgcggacttgccgtcgtcgaaggaccacttgtagggatagtagagcaacgctgacatgagcaccagcgccgtgagggcgccgaggatcccctgaaggatattccagcagaaccccttcatcatcacgccgcagtcttccatcgtaagaatcaacgagccgctcgcataagtactcccgcgagcgccccatgtcgacgatttcgtaggtttctctccgtacgcgatctaagcaacagtagaagaaaggcggttttgctaaatatttatcgggtgatttttttcatagtatttgacgtttttctcgccgcacgatgttttccaagatttgtgcaaaaccacggtcagttgattccatgaccgagtcaacctgactttgtatcgatggattcctatacatcacgcatgttagtagccatttatttcttctctctatttctttctttctttttctagttacaaaaaagtttacagtgcacttatactaaaattacagtctacttacatgccatatctactatttttccaaatataattttaattataaagcactgtaattttagttataaatgtaacatttaacacttcagatatctgcatggtttctcaaacaatgtatttgtactaaaacgacaaatattccagttaccaaaatttatagcgcacttgtactaaaacaatgcacttacatgccatatctactatttttacaaatgtaattttagttataaagcactgtaattttagttataaatgcaacatttaacacttcagatatctgcacggtttctcaagcaatgtatttatactaaaacgacaaatattctagttaccaaaatttacagtgcacttgtactaaaacaatgcacttacatgccatatctattgtttttacaaatgtaattttagttataaatgcaacatttaacacttcagatatctgcatggtttctcaagcaatgtatttatactaaaacgacaaatattctagttaccaaaatttacagtgcacttgtactaaaattatagtgcacttacatgccatatctactgtttttacaaatgtaattttagttataaaacaccgtaattttagttataaatgcaactactctactaacgagcacaatcacaggctacatggacggtttctctgtactgttaatttttttttaccgttagatgcagatttgaggggaggaaaaatttgagtgattttttctcaaaaatcacacgacagatgcctagacagtcccgaagaaaggcgttatgacttagcgtccgccgtatcaaggcgtcagttatatacaggtcgcagttggaagattaatccaaggagtaatcagattgggagtttgatttacagatgagttcggcaatgatacgggagataatttgatttctattcgaatgtttcgcgttgatgcgttgtagaattctgcgtttgccgcggccgattacaattgcaaactccatggatgtccacgagtacgtgctggtaacaattgacacgacgtcacgtcaagcgtagaagcccaaatctggagaggaggccatgggtgcgttcccggagcaagaacagccacctctccttggtcgacgcagctcctttcgaccggaggaagaagaagaagacgatgagtacacggatgccttcggtgtatgcttcggcctgtttctggccatcttcgcgatcatgctggtcgtcctctgcatccgccggcccgacacggacgggatggcggcgagcccgcccgactacttcgtcgcgatcaacgccgtctcgggcgtcgacccgtccacggacctcggccggccggcgctcgacccggtgttcagcctgaccgtccgcgtcgcctcgcggagctccacccgcggggcgtgcgtcagggccggcacgtcggtgctggtgtcctaccgcggcgtcccgctggccggcgggcgcgcgccggcggacccggagctctgcgcggggccgatgggcgcggcggaggacggctccgtcgtcgcgcgggggagcggggcgcgcgtgccggggacacagctggacgccctcgcggaggacatgcggcgcggcgaggcgctgttcgaggtgacgctcgcgatgccgtactacgggcagcggaaggtggcgtcgtgctgggacagggtcggcgacgccgcggcgctccgggtgccgtgcgacgtgtccctggtggacccgcgccgccttgccggaatcactggcttcagcgatctacctagtgccgtgtaaaacgacatattcgctgggaactctaaccacttttgagtctctcgtggtttacatgtaatttaaataatttttaaaaattattaaaatatcaataatatatatgataaatcactccattttagtctgtctttttattttttaaaactttttttcaaccattttaattataagcaaaaaatacaaacaatgagaagatggttccttcagagtttataatccaatcacgagatcaacacaacagcaaccactcccacatgtgttgagttgtaactttccgtagtttctagagtagtgatcactcgtgtcctcaggatgtatctgatttggtactttcttggttttctttaaaatctctatgtgtaaggactttgggggactgattttcccccaattattttttcacactttatctaacgttcgtatagagatttggttttatggacgcattctccgtagattgtatttgaattatgttgtgcatatttgtcaagctcccaaggatatatctgttctaaaatatactcatcacctaatagggttcaacatttgtactaaaatataataacctttacacctattctcatcttgaaaaaactaatcggcacatatgcgcttgataagttataagttgctggcgtacgctcagcccaagccggcccacatgcttctcttttctccatacacggtcgcacttc

SEQ ID NO: 22815 - DNA, 18115 bp, Oryza sativa
ccttctttctacatgaaaggttttcattttcctccggttgactcaggcagtcaccatgaaaggcattttctttcataccttttcattttattttgagtaaatttcacaaaattagatatactttcatcaaactatcacaatactacaggtttaaggcaatatatctcaaaactataaattaacactaaaattaccacaaaactataaatttaaggccaagtatcacaaaactacagatttagtaacaaaattatcccaaaactaaaagtttagtaccaattcaatcgcaaaattgtaatgcttatacctccaacgtaatagtagtgctagagatctaaacttgtcgacgttttagcacgactacgatatttgcatggtatgaagatcgttggtacaaaggcatatgccagattgaggtaaaagaaacagtgacaaagatttttatacaggttcaggcctcttattcatcagaatcaggttatagctctactcatgttggccgaagccggtgttgctcttattcatcagaatcacaaaagtacaatatttgagataatctatctagctatcgtcgatatggcggcatgaacaccaacacatagtcgatgatagggtagtcttcctcctcaaatatgaactcagcgagatcagagatagcgctagatccctcttgtcggcctctacatgcactagattgggtatgtctaagctgatatctgatgtcgatgtttggcggcgtgtattagtgtctattctgactgttccgtggcccctctcctcctatggggtcttgtatttatacccatagatgtccccttttgtctaagtaaaactagggagacacgtatggatacaattagagtagtcattatagtttccatgtagaactctacttgttcttctttatccgaaactccttctgtatacaaggtatgattccgtataagatttggaatatggtgggccccgccgaacttaatcgattactattggatatgtgttatccataaccctgacaaaacttgataatttgcagttttgtgatacttagtttcaaatctgtagttttgtgatataacgccttgaatctgtagctttttgatagtttgattaaaattctgtagttttttaaaatttactcttttatttttataccatatttcaaattattaaaacttaacaaattcaagtaaagtttgacactaaatttgaaattttcaattcaaaacctgaaactttcaactcaaatttaaaacttccaactcaaaatttgaaaactttcgactcaaagtttgaaaactttaaagtcaaaataaaatatttcaactcattttttaaaactttcgacctaaagttaaaatatgaaagctttaaatgtcaagttgaaagttttcaaatttgatttgaaacttctaaatttttaattaaagtttcaaaaagtgggttgattttttttcaaaagttaagttgaaaagttttaaaatccatgttaaaattttcaaattctagtaaaaagtttactagattttttgaatttgaatttgttgatgaatattttaaaattaattttgttgatgaagttggcctacaatttgagcttgtggtcctagaggcccagtagatcagaggacgagagaagtgagcgcatgccacatgggagaaaattgaagatgcgtgaatgagaaaaatccatgtgggcctggaattatgcgccattttattctcctagcgcacctgcgctaattagacattccctcctcatctaaactaatcacaacatctcgcattttatttccccttctatttcatctaaactattttttgtttaatttttttgcgtatttctttatcttaatctagtcacaacctatactcattcaatttcacacctcatttttctaaaagtatttatgaagtgattattttgggacgtacaaagtactctctccgtccacgtcccataatataatttggagggatgtgacaaaatatagtacgacgagtttggacagattcgtctgttgacagaaaacacgaggcctgggagatctgtttaactccagtgcaggtccaaaactcgcattcggatgtgtgagcgtgccagttgatttgatcatgtaatcaacaagaaacaaagacaaagaaaccgtggttaaatccataaatgatagccgatcggctaagtgccgatgacatatcatttattttaggccgatgtcatatgtacatcgatcggtaagtattagtaagcaaatcagaactaaatctactcgatcggctgtagatattaatgatatataatcctcatatcgatatatacttaaatcaagtgattggaatagatcggtcaccttgccaagacagtataaatcacttagatcgaaacatatattaatagtgggattatatatattcatagcatagccgatcagatagatctagcatgtatcggctaatattccgataccactctatattaaaatattaaagcaagtaaaatataccaaacaaaagcctaatatacttaaatgcaacaagatcttaacataaagggcagatttaacatatcaatcaagcatataggataaaagtagttaaatcaggtaagatcggttgaaactccgatactaccctaatcggcaaccagaaagcaggctagagattgaagttctaagcacgacttaatagatcaaactgaactgatgcagcattaagtatgaagagaagaataatatctagacaatcaagccgctggatgtttcatagagtggtagatatatcacataatccaagttaacattgttatctaacctaatcggctgccttctattgacaggtgctagtcggttataggttagatgacgatattatcaaagattatgtgagatatatgataactcgacgaattatataaacaagattagagtatcataaagatggaagcactaatctcgagaacacaagtcgtcataacaagttttacctcttattgaagatcgaaaccgatgcagctcaacccgaaagcaagaactcgtcgaaataaaactaaatcaaaagggtggcgatgcgccgagattgtattgaacgtgtgttaataattacatagggttcggggtctatttatacccgagaattacaagatatgtccataccggacacgactattatctctaacaaactctaagataccgtaagtctttgcagcagacttttgtccacatttatctctaaggaatttacataaaatatcctaattaatagatacaattgcctttctcaggactctatccatgtacggcaatcatcttgaagcacatcaactcaatcccgattgtcggatacgagccatattgtcagaattggctgtatcacttaacccagtctgactcagacttagccgtagccgatccggactccagccgattcttactctgcctccgcgataacatcgtcgtactagattgtgtcacatccctctaaaatcccttatattatgggacggagggagtgcgatttttttttttgaaaatcttttcttcattagtaatctatataaagttttcaaaatcaacttaccaacttttgtcataatcaatttgtgttctagaataataatcagtttcagtttcatccgtcatccatcctaacaaagaattcatctaggagtacgacggagagagagtaggagttagcgtaagatatatctaggagtattttttatttcgaatatagaataacgatatacggtactataacagattagtatttgtttgatacgtaatgtagcatagttggcccgtaaaccaggactcggatctctttccgggcacccgaagaactccacgtccgatcaacttacgacgtgtttcgatccacggacatatagaccagccttccggccgctccgtccgttccccctcctctctctccgcccccacccccaaaaaaaaaaaaatccatctagtctctcaatctcgatcaccaaccatgggcgcgctcgtcgaggaagaacagccctttttgcccctcagccgcggcggcggcggcgcctctggtccgagagcagcaagggagcgcggacgctcacagacgagcgacccgtgcctggaatgctgcggcatgatcgtcgggattgccttatttggggtcctcttcggtgccttgggctggttggccatcaatcatcatgggggagtactacgtcccagcgatgccgcagtactccgtcgagatcgcctccgtctccggcctcgacccggcgacggacctccacgccggggcggcgctcgacccggtgttcaacctgaccgtcggcatcgcctcgaagggcgagtatcgcggggtgtgcatcgagccgcgcaccgccgtcaaggtgtcctactcgtacctcggcctcccgctggccgggggccgcgtgccggaggtgtgcgcggggccgaaggagccggccgagaagcggaccgtcgtcgcgcggggcgtcggggtgagcgtgccggggtacatgctggacagcctcgccgaggacatgaggagcggggaggcggtgttcgaggtcaagctgatcaagggagacggcgacaggtacagcaggacggtggcgacgtgctgggccagggtcggcggcggcttggacgataggtgcatctgaatacaaacttccaatcgcgaaaaatcatcacggcttcgtagtgtcagtttatctgaggttttttttcttccttggatggaaattcatggaattttgtcggtcagcatatatgcatttcttttctttgatggattctaccaattggtttatacgtacataatattgtttacaaaatatgcatatgttggaattttcaaatgttgactaaatattatcctaagtgtcaaatatttatgacttaaccaaagaaaggaaaatatttgcatggtatgatcggtctaaaacattgttgatcgatcgagatatataccaaatacaatcggatctatggaagcaaaaagggtgaatagcttatcgaaacccaagtctatttctaatatcaattgcatacaaattgcaaattgcatgtatgtaaacaaaaactaagagttgtggtatattaaatctatttctattttaaaatttaactccacgtaaaattatacggaatattattatttagggattatgaaaaccaccccaaatatcacattgagtttgagattcctccctataggatgatttcaaataccgcccccctataagatgatttcaaatactttcttatttaccagtttgatatttctccccaattgttgttcatgcttttattttttcatctttctgaatgtgttatataatttaaaacatggccctagacacatattctttctcagcgacacaatatcgtatcatatgctcatctttatcgtcctgtatgtaccgaagaaccgtgtactttcagacctcatgaggcaagcacaatagctcatcttttatcgatctcgatgttcaggagcaaagactcatgaccaacattgcccaacgacgtgctaagctccatgaggaaggttgccacggtcatgtcaatattcatataatcgcctgtggggtttgtggccacaagaattagtgagcaacgataatcggagaaatctcaaaacaaactgaatagaggggatatttgcaacaaatcttcttatgtttataggaggagttttaaactcaggtaggcatttagggtagccttttcaattcttttcttgttttaaggaaaattttaaaatccaaaaggaagagagatgatcatatctctaccatatagttcaacaaatagtttcactcatcactcattctttcatctccactatagtacgttcaacaaatggtttcactatcactcattctttcatctaccctatagttcaacaaatggtttcactcttcacccattctttcattcctcattgaacaaatggtttcacttatcactcattctttcattcctcatggaacgatctagatcatctctctaagatccaacgtccctatagttcaacaatggtttcgcttatcacccattctttcattcctcatggaacggttcaactgattcctctcatcttgcgcgtgcatgcccctcccacctgtgcgcataccgccgatctctcctaaaatcatgcactcatggtgatttcagaaaagaaaaaaaaatcatgcactgactatactgtgctaccccccctcaacccccaatctggtgttcatcaagcccgctgcctaagggagccatcgtttcgcttattcgtggaataagcgaaacaacatatttgcaaacgaaaagtaatttgtgaataaaacttttatatacgtgtttttagcgatctaaaagcaaaggttgaaaaataaacttggatgaaaaaaacctcaaaatcaactccaaatttaaggttgaaaattcaaattttggctgataagcataagcgaaaagatgagactgtacgtcagcgtgtcctatgcctaccaagaccccccgctggtcaccgggctggtgccggacttctgcatcgggccgcgggaatcgcggggcgagcttgccgtcgcacgggtgccaatgtgagcgcgctagggtactggctgccaagcctcgccgatagcatgagggcagtagcaatgcgtcacgcctcattgaggaaccaaaatgtccatgttggaaaaaaagcagtcgaagctcacctcagctcccctctccacattgcacttgagctttaggtaggtccaccaccttttcttttcaggccggccccaccaccttttcttctccttccccctctctctcttcctaaagctgacgacgctgacacaaagcggatgaagaacacgtgtctcagtttggtcacacgttcttggtttagtcacgtgaaatgcacacgtggctgagaatctcctatgtgtaagcttgaggctgaatgccacatcactacactgtgaaagcccttaggagcgctcaagtgatgtttgacgtcaatctgcagaagcggaacaggtgggatgagtgcaggacgagagtcggcgagaaggcttcatgccatttagattttgccgaatagttattaggagacattataattccttctgttaatatgtgatacatttattataagaaaatattatgttttcgtttcgttttttaagtgatgtttgacacatttattttgttcaaagattatgtacaaatgcataagatataaattatacataaaatatttttatgataaaacaactcataacaaaataaatgatagtttcgtaaattttttaaataagataaatggtcaaacgtgtatctaaaattcaaaaatgtcatctattaaaatacctaggtaacactaatggtattttctctcattaaatcacaacattctagttatttctaacatttggatgattcacctatatgatgcatatcatgttaatatttttaagagtggctatatttatgatgttatattttgcactaaaagacaatcaaattttcggatatcgaagtttaaactctcccgtatatccacggtggatagaacaaatcaatcgattcaggcgcataaatacataccagacacccgctctgtttggcaagataagattaaaactctaaagtagattccaaagcacaacgtgtgctgagaaagcgatgtccgccgtgatcgcgccgccggcagagcatgagctgcctgtccattgggccgtcgctgagccggacaacactcaacgccgaggtgtactaggaggtgtaagattgcgtatagacaccgtatgcctcgtcatggtttgcatgatcctcatagcagtagccttcttggctatgatgattgttgccatcgtcaaagactggacgcaaccggcctcctactccgtcgcgatcgattccgtcgccggcctcgacccggagacggacctgccccgcgacacgctcaacccggagttcaacctcacgctccgcctcgcgtcgcaacgtgccgacatgggggtctgcttcgaggccggcaccaccgtggcggtgtactacggaggagtcctgctcgccggcgccgccgtgccggcgctctgcgcggggccgcggccgtcggccgaggaggagagcgtcgtcgcgtgggggagaggggtgcccgtgccacgcctggctcgggaccgcctcgccggggacctgcggggcggcggcgcggcggagttcgacgtcacgctcacggtccaaaggtacacctacgccgagtcgtgggatgtcgtgttgtgcagcggtaaggtaggggatgccgccgcgttgataactccgtgcagcctgtacgacgaaaatgtgcaggagccgtcgctggaaccgggttacggcgggtattcttcgcagccggagtcaccaccagagaccggcgatgacggttaaggtgaaggttttgctttgtgatctgtgagccatctgaattttcagatgttgcaaatattgggtttttgttgttgcaatcggtgtgttgcattcaattgaaacatctttgataaagcggctaaatgttctttagtgaaagatgaaacatcaagaaacaatttatgttgaaatatttttttcgagcaatggaacattacgcgcaacattgtccggagacgtctgatgcataggtctatccaaaaagaagcagtcggatgcggacgtttagtcgtcaactcctaacaagaaccggtttcgaaaaaagtgccccaagcacgcacgtcgacatggccgatcaaactatattaatcggagtcgtgcactcccaatcccaactccacaccccatcgtccgtgaggccggcatccccctcccggccacgccacgccaccgtccaagccactaagccagttcatacatacgaaacaggtagcgccgcgtcgtcgacgacgacgatgcccgcggacttcggggcagaccaagatcggattcgacgtctcctccgctgtttcagtggcatcgcaatagcggtgttggtcgtagtggccgtgctcgtcttgtgcgcattggaggcctccaaggccccgcggctgtccgtcgcggtcgccatcgtctcgggcctcgacccggcgacggacctcgcccggccagcggtggacccgcagttcaacctcaccctccgcgtcgcctcgcggagcctcctgagccgcgcgtgcgtcggggtgagcagcacggccgtggccgtgtcgtaccacggcgtccggctcgccagcgcgcccgttgcgccgcgcgtctgcgcggcgcggaggaagtcggcggacgcggggccgttcgtggcgtggggctcctcggtgcgcctgccggggttcgcgcgggacagcctcgccgcggacatgaggaacggcgcggcggcgttcgacgtcgcgctcatggacgggcacctggtggtgtgcaggggcaggcgggtcggggacgcggacgccttgcaggctccgtgcgtcttgacccacgtggaaacgggtgcggcggtgccgcacacgggaacgtaaagaggctcgccgtaagagtatatctttgctcggccggccgtgatcatcttggcacagttttttcttagcccagatcttagcgcaattgtcttagtatttcgaactgatgcgatttttgggttacttttgtatttcctgcaagattattagtccaaattcaggttattttcttattctttaataatgtaaaatcctaaaccaaaatttctatacacacatcctttacttgtaagaaactcaaatggttatgaacaaattatacattttgactaacctagcctatgatgatttaagtcaatatataaatgtgtggtttcttcatctatatataccgttaaatttaaattttgacgtacatgcttatgaaagaatccttatattatcataatctaccgtagcaacttctattaaatgttcccctcaaaaatatttctattaaatttatctataacacgagcacgtacgtatgtgtgcaacatactctctccatctaacaaaactagcctagtattaggatgggacacatcctagctagtaaatctggacttatattttatattagtgaggttgtctttagttccacgcctaaattggaagtttaattaaaattggaagtttgaagaaaaaagttagaagtttatgtgtgtaggaaaattttgatgtgatgaaaaaattggaagtttgaagaaaaagttgggaactaaactcagcctgatacttactcctcctgtcaaaaaaaataacctagtacattttctattgtaaatttgatacctcttaatacttagatattatatagtattaaattttacattaaattaaatttaatacctcattatacctcaataataacagtaaaattgctcattatataaacaacagtttcttaaccactccctccatccggtcttaggaaacgtaacgtcggtgcgacaccagttactataccttcgttgaaaccaaacgctatattaggtaaaaaagaatacattaacatatataatttccgggatatggaaggctcaaactacgggaactatccgtgtgtattcgatttcagactgcaacatataccatttttaaggcttcagaagctaccaatatgtcagatcaacgtgtataaaaacccaggccgccgtacccctgctttatccatcaaaaacgcgaggacgaagcgaatcgaatacaaacagaggctaaaaatcaacgtacaacaatgctgcgcgcggcgccgatccaagtgcagccggcagagccagggccacctcctcgtcgctgcagcgcctgcgtggctgtctttatcacattcgtcatattgtccgggttgttgttcgtgttagtgctctcagccgctctatttggtgagcagaagtactacgtcgccatagacaccgcctccggcctcgacccggcgacggatcttccctggccagtgctgacccctgagttcaacctcaccctccgcgtcacgtcgtggagcgtcgttggagccgcgtgcctggatcccgccatggacgtggcggtggcctaccggggcctcgccctcgcgcgcgcgtcgccgccgccgcgtgtctgcgcgcgggggtggggccggacggagcaggtgccggtcgtcgcctcgtcggggaacggagtgcgcctgcccggtttcgcgctgcacggcctcgaggcggacgcgtggggcggggctgtggcgttcgacgtcgcgctgactatgccgccgaagggcagagacaaccggcatcagctgtggtgcagagctgtgccggtcggcgatgacggcggcttggggatcccgtgcaatgcaaattcggagtactaaaggtattagcggtgcgaattaacttgtgtcaacagtgatgtgcgtgcatgcacgcgtgtgtctgtgcgaacataatactatgtgtctttgtgtttttctcccgtgatatagacttgattatcttggatggtgaaatactgtaacgttactacagggtataactatttatagatacatgtgccataatttaaaatagggtctaaacctcggacttgctggtgatccgggtctagcaaaacaacggcgtttgtctactatatcggcacacagatgaaacctctcgttgcttgttcatagactgcagatacacaaggaaaagctaagacaccattgccaactagatagcctataaccccatcaaaccaacaaactgggtgcatgtgacccagtctatgattggtgggagtcacttgcaacacgtcagagcgcacccaagcgtagtacttgatccataattctcctagtctcatgggaaatatgaaaggaacggaatcactgaattttccgaaataaggagttatccacggcggccctcattgtgaacataaaggaagagtcaaaatctcgggctttggcgggagccaaacacctaacggagatgttgccatagttccccaatcttttttttttgtaaatattaccttactccttacttaaatattacttccttctacataatgagtgagacatggggaaaaggctagcttctcctctctttctcaatcggttttgtgattaaaagtaattaataattaaaaatagttttattactctgattggtattcgggctaaaattctagaaccaaatctggctcgggtaaggtaacaggcttagtcgaaattaatactacaatattgtgatgtccgattgacgaatttgttttttttcttataactcaaggttaccgagattaggatccatccaaacctgcgacgcgtagtgatcatcaatgaactcgccggaagaacgaggcatgtcagcggcagcggctacggaggtggaagcgcacgcagcagacagccctcctcgccgtcgcctgtcgggtcgcaaccatggcgataactgcctgacggttttgttggtagtgctcctcttgctcatcgtcggcggggtagttttcttcgtagtcgattccaacacgagaccgcggtactccgtcgcgatcgacgccgtctccggcctcgacccggccgcgacgggtgatgacgggcggggtcccacgctggacccggtgttcgacctcaccgtcagcatctcgccgcggagccgggtaagaggcacggactgctacgagcccggcaccaccgtggaggtgaactaccacggcgtcctcctcgccagcgggcccgtcgagcagctgtgcgcccgggcgacgaagacggggcgggggcgcgccgtcgcgtggggcaccggcgtgcgcttgccggggttcgtcctggacgcgctcgtgtccgacgtgcggcgcggcggggtggaggccacagggttcgacgtcacggtgaagatcccgtccaccggcggtggcgaccgctccagcccggccgggatgctcgtgtcgtgcagggcgaggcgggccggggacgacgccgccgctgtgttgaggactccgtgcgacgcgctgagcgcgaacatcgtcgtgccattgccgaacacggggaggacgcagacgggcggtgccagttaacattgtgtgaataacggcgacgtcgtcgtagcacgctgcagcctgcacgcagccatcgctacaagtctacaactcacaggtcgcgagtcgcgaccagttaattcgacggaaagtctgtaccgtaccgtccggcaacgaagcagaggattcaagaaaagcgactaaacagactttcactgtatactatttatatgtttttttttgcttcacttttgttgaagctattgatcaatgaacatagtgttcattgcaggattatatttgtaaattttttaaacagaattactaaaacaaggccggaaagtattccttcttctacgggaacatgcatctatatgtgggcatgttcacttcttttgttgctgaatagtaaaatatgaattgtaataatcattcgagggcataaacgaatttaattaaatattataaagttaaaaaggatttaaaacagcattgtaacatattcatatgtagaatttttttttgccaaaatctcttcatttagaagctcgggaagcatgcacaattatccaacattctactgcacagagagaaagtactccaggtagttaggtacctcgagttaccaaaacctttgatacttaccgtaaaatttctccttttctaatttgtgttttcttttgatattgtatgttaaaatgttcttagaattttaactggcaaacttttaagggcttattcagttaataggttttcaaaatcgaaggaatacgaaaagcaaaagattagcaagttatacgtactccactccttaggatttttatcaaaagttctcaccccatgataagaatcgtatgaaatagggttataagattacaattcttagaaatttgataggatccaatcctataaaacaaatgatgcatatagaaaaaaaaaactaagattttaattactacaataatcttacgaaaattctttaaactaaatgagcccttaaggcgtggatctttcggtgcttgataatcaattttgctagctgatcctggctcagctcgtagctatgtctcataccggtggttcatgctagcagagttataatcttgatggataattttatcatccatgagaaggtatcaggaggtaccatattttgtaatgtaaaaaaaataaggacaattttaccatacttaaaaagctatctagtgttaaacttggtacttctaggtactaagtatctcaatatatcaaaaattttattgcaaaatttagatacctcaaggtacattctcaaatactataaaattcctcaaaacttaatactttcagataataggtactttgagatataaagtttttattgtaaaattttgatactatagatactttctcaaaaactctagaattcctaatgtcaattggccgatgagtttcaagccgcggcgagatgtcgatttttcgttagtttcatctcttttggtaaatttctaactagtaaaattcaacgagttttgagccggctcgatatgctcgaaattcactaaattcatcgattgtgaatccgggcaccaatttgctccagcgggaagaaggaaagagaggagaagaaagaggagggaagtagggaacggaggaatacatattcggatccgacttgtactgggagacctagctagcttcggagtctccagttgtttccaaacaagagtcgacggaactccaaaaaaaactggcccgccttgctgatcgtgaacacaaaaatccctcgacatcgcccctggtcttcaagccaaaagcagcgacgcgatttgaagttatcgacgaagtccgctctagaaggaagagatgccaagggagcgagcgatgcagatggaagcgtcgccggaagaacttccctggggctgctgcgtctgcgcgtgcgtactcatccccgccgtcgtgctgttcgctggcttgatcttcttcgcaatcgacgacaatgacgcgctgtactccgccgctgtcgacgccgtctccggcctcgaccccgtttcggagcttggccgggatcccacgctggacccgactttcgacctcaccgtccgcatcaggtcgcggagctggttgcgcggggacgagtgcctcgagcctggcactgccgtggaggtgacctaccgcggcgtcctgctcgccagcgggcccgtcgagaagttctgctcgggagggaagaaggcgaaggaccagcacgtcgtggcgtggggcaccggggtgcgcttgccggggttcgctctggacgcgctggtggcggacgcgcggcgcggggcggaggcgttcgacgtcgcggtgaagatgccgtccaaacacaggggtcacgtgacggtcgacgggacgctgatatcgtgcaaggcgaggcgggtcggggacgccgccgcgctggggacgccgtgcgacgtgtccagtatggacatccccgtgccatccccgaacacggggaggacgcagaagactggcggtgccaattagcacgtgtatgaataacgtcgctctcggcttgtggtagtagctacagtacacatccgtctgctgtgcggagtttcatgttaagtttagagttggggctcttttttctttgtttaatctgtttcttttggaagagattggcagttgatcaattgatggcctcaatgtgtttttccgatatagaagatgcatacgtgcccacgccaatatacacataaacttatcacatatgcaacagcaaataagtcccttgcgcacgttataggggcaaagactagcggaaaattccagtcttaataaaatcctactcacccgttccatattactttttcctattaactcaaattttaccaaaattatttaaaaaaaatactcactccgttttaatacatgtcgcccttggctttttaatatacgtttaaccatttattttatttaaaaaattatgtagttattactccatccgttccaaaatataaaggattttggacggatggacactagtactacgaatctagactgtccaaaatctcatatattttgggatggagggagtatttatgttgttgtagcttgatttatcatttaagattcttgaagcacaacttatttttatgtttgtacaaacatcttcaacccaaaatataaatactaacaaaatgtagttaattgtagatttaataaagctattttaatattgtagatattgttacctttcttctaaaagggagtattaataaatatccgtatatgtgtaatatttgcagacatcgaaattttgatagaatcatgtactagctacttcacgaagatatgattccaagaaacaaaggaagtccaaattataacagtaagaaaaacaatcccgtacgggcctgggaatttttttagaaaaaaaaaagaaagagatcgaccaactaagatgtctgttgaagcctctaagaattgcaatagttctataaggtgacaattttagaattgtttctctacaaatccaaaagatcatgcatacccttatttgttccatcctattaaccgacggtccttattcagaaagtagtagccggccgccgactcaattttatcatatattttctggacgtgactacacagctagtggtagctggtttgtctaaaccaactaccactctatatatgaaagacactatccacctataattttaatacaattttctcttaaactactcatccgatctacgatccgattataccgttgtgttcgtaacaattaaatctttataacaagatcccacatgattatattttgatgaaaaattataaattaattttataatatatataaattacttttagatttcactaaattacttcttagacatatgaaagtaaattcaataaagcctaaaagtaatttacatactccctctggttctatattaattgatgttttggacaagattgaggttaaacttttataactttgaccatcaataactttaaaaatatttagtttaaagaaactagaaaaacatatatatatatttgtctttcaaaacactataataaaagtaaacatgcatttatttattgtatatattataatagaaaaataaggtcaaagatatatcttgtagagcgtgtcattgtccaaagcgtcaattaaaatgaaaccggagggagtatattatagaaataacttataacaaaaagaaagtaactttattgaatgccttttttctcattggacatgactacacagctaaaaatgaaaggaaaaaaaacaatcgatgattaaacagatttatagagagttacttttgaaccatgcaaaagttacttccaattaacattgaagttaggtggtgtttggatccagggactaaactttagtccctaacatatcggatgaatttggagtattaaacatagactacttataaaactaattacataaatgagagttaaatcgtgtgacaaaatttttaagcctaattaatccataattagcgcatgtttactgtagcatcacataggctaatcatagattaattaggctcaatagattcgtcttgcgaattagtccaagattatggatgggttttattaatagtctacgtttaatatttataattagtgtccaaacatccgatgtgatagggatttaaaagttttagtgccatctaaacatggtcttacttttaaaaattgttaaacttacgtgtgttgatctgtgttgattaaattttatttctagataaagtcatatttttatccctacaacgaatttacttctaatgtcgtgacaaagttacttccgttttgttttaagttacttttataatatatgtaacttacttttagactctattaaatttacttttatatgactaagaagtaatttagtcaaatataaaagtaacttatatatatgataaaagtaacttacatatatagtaaaagtaatttataaatataaatattttttcatcgtaatataatcatgtgaaatcttgttgtgaagatttaattgtaacgaacacaatggtgtaatctgattgtagatcggataaataatttaagagaaaactttgtttggagaggaaaaggacatacatgtgctgtagtagacttctcaaaaaaaaaaaatgcatgcatgcagtacgctatagtaga

SEQ ID NO: 22816 - DNA, 1257 bp, Oryza sativa
cacgacggcaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaaaaatcttgatcagtctttccttgtaggtcagattcttttccagctcgatattacccagggggacttgctcttctggaactcgaagacatttctttaactgggatacgtggaacacgttgtgcacatatgcgagaccttcaggtaactcaagctgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgccttcgattgtccgcgtaattcttctgacggttctgcgctgtctttaaacgttctcggatcagtttaacttgttcttctgctgccttgagtacgtcaggaccgaataccagtgcttcgcccacctcattccagcacaagggagtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcctctaggacttggtttaccctttctgtctgaccatcggtctgcggatggtaggctgtaataaatttagatcggttccgagggcttcatgcaactgcttccagaactttgaggtgaactgagtgcctcggtctgacacaattttcttgggacagccaaatctacacacgacatgggtcatgtagagttctgctagtttctttccatcaaaggtggttttcactagcacgaaatgagctgatttcgtgagtcggtccacgattacccagatggagttgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgcattctgcgacatctcgcttcattccagcccaccagaagtatgcct

SEQ ID NO: 22817 - DNA, 16346 bp, Oryza sativa
acaggcgatcttggtaagaccgtatttgagctacattgcaataggccttgcgacttagcgcatcagtgaccacgttagctttactggggtggtaatgaattccaagatcgtaatccttgattagttccaaccattttctctgcctcatatttaactcggtctgagtgaagatgtacttgagacttttgtgattggtgtatacttcacatctgttcccgattaaatagtgcctccagatcttaagagcatgaaccacggctgccaactcgaggtcatgggtgggatagttgacttcatgaggcctgagctgcctggatgcataggccacaacctttcgttcttgcattaggacacatcctaagccttgtcttgttgcatcatagaagatctcgaaatctcttcggatatctggcaaggtgagaactggggcagtggtaaaccttttcttcatttcttgaaagctgtcttcacaggctgtagaccattgaaatttcttttccttctttaacagctcggtcataggtctggctagcttagagaatccttcaatgaatcttcgataatatccagctaagccaaggaagctgcgaatctctgacacattcgtgggcgggttccaagcaagtacagcttcaaccttgctgggatctacttcgacaccattgggggagatcacgtgtccaagaaatgctactcggtctaaccaaaattcgcatttcgagaatttagcgaatagttgatgatccctgagcttttccattatcagcctcaggtgttcagcatgttcttcctcattcttggagtatatcaggatgtcatcgatgaacaccacgacaaactggtccaggtattccatgaagattttgttcattatgttcatgaagaatgctggagcattggtgagtccgaaggacatcactgtgaactcatatagaccataacgcgttgagaaagcggtcttcgggatatcttcagatctgattttcaattggtggtaacctgatctcaagtcaattttagagaaaactcttgctcctttaagttgatcgaacaaatcgtcaatccgtggcaacgggtacttgttctttatagttacttcatttagggctctatagtcgattaccattctctcacagccatcctttttcttgaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatacttgttaattcttctggaaatacgtcgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagcttctgaatcaaacagaactattgcgggtacggagttgacagagaacatacccatcacaacgtctggagcatcctgagcggtctcagcttgaatgtggttcacccggcctcgaccaaagttgttggaagcacgagagccttgtccacttgcctgagagctaggacgagactgagctgccgctggagtaggagttctggcagtgctgccattagcatgccctgagttggtgttggtaggattctgagggcactgtcgggcatagtgacccatctggttgcaccggaaacactgaactgctgacggtcctagcggtgacttgaaagaggtaacactgtttggtgcagtattgccactaggggcacgctgctgtggctgaggtgccggacggttcatctgaggacgaggggcgtagcctggctggcggttagcctgagtgaccgactggtggtattgcatgggttgaccatagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattcctactgcgattcccttcaagaacttcctgatcttcttcttgtctgtgtccacttcctcaggggcgtaccgagccaacttgttgaacatacttaggtactcattgacactgttgttgccttgcttaagtctgttgaattcctctttcttcatatcaatggtgctttcaggcacatgagctgcacggaaagccgtagcaaactcatcccaagcaatgttagtgggttcagggtgtgcattgcagtaattctcccaccaatctgcagcaggtccttttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgttagattggatctattgttgcccatgtgagggtggccatttccatgcgcattgtgctgataaccggctacggctgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcattacgggaagctgtgtgatgcgagcggttgctgcggcggggttgctcaacttctgcgttgcgggaagtagtacggtgcgaacggttgctgtggtgagactgctcattagctgactcatgatttgcttctggctcaactctaccttcctcaaaaccaaagcgggctggtgcacgagcagcacggcgggggcggctagccatctaaactcccagatgagggcgaggtaagaatcagataagcacttaggagggcaaggagcaaagtaaatagcaactcagatagcacacactaggcataaactggatttttcaaatcataaaaacacctaatacaacgggtgtggacaagtcacagagctacgccgagcttgactgtgcgcacaccacctaggagaaccggactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggccgacagcagcacgggccgctggcggtgtgggagctgggtagtcgaaacggaacacggtggaagaaccaacaacacgcttccgcgcagtgcggataaagcgtgggccacggtgggaggaagcaactggggtgtgtccaggggtgtaggaggggctaactgggtgagggtagggggagtacactggtgagtacggcgcacgcgagctgggggagcgcaggccactgggagtgcgagcagagccgcgggagctgtgggaggacaggtggctggcgtggtagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgaaactcactgtaaggacaagggtacctggcgtttgcgtggccagaaggaaggcgtggaagctgccggaaggcagagcccccgagacggtggctgtagtcgtaggccaagcgacgaagcgcagtccaggagaggtcctggcacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgagaagccaaggaagcgggcgaggtctcgaagctgagcgacatggtgaccctcaccaaaaccgtgggaactgaagctggcgttcactgccatctacaattttgaaagagggagaaaagatcagtaaccattttagaaacaaactattgaaaataaggaaaccaaaaaaagccttagcttttcgcaagtagttttgaacttagtacccttagggtcgtcctaaacgtcgggtttcgccctaggggcaagcctgtgctctgataccatctcttgtcacgcccctaactagtcccgaccggaactagcccgtgacgctccaaattaacctgttaatctataccagtcctaggaaacagtgctggtatcacaggaagacagaatatcacagcaacagaggtctctttattatagagtagaggtacagtcatgttgggctgcggacagatcccgagctcacaactgcatttcaaaagggaagcggaagccaagactcggaccaaacaacacaggcgcgacttgggaactaggccgaaaccctaaaactcatcgtagcgggatccgcttcatcttcttcagcaactgggggggattatttatatagagcaagggtgagtacgggagtactcagcaagccataggaaataagtgtttaatgcaagcttcaaggaaaggctgttgtttttgcaattgattttatttgatctcttttctgaaaacaactaagtgagtgcttctcaaacgacacggatgagacagtgcgtctcgtccggtcggagtatgtgcaatgtatcagtcttttgaattgatcaagattggcacccggccaacaattttcaaacggccacccgggccaacaactttcaaacggcctcccgggcctagctgatcccatcagctgcagattttccaaacatcgatcccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacactaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaaattcatttagttcgcaagcaccgacccaggtgtcgggttttccaagtcttttgtaaaacccaagttttacccaagatgtttatcatattttaagtttgaaggcgaccgtcgatactcgtgcagagtgcacgatttccgaggcgcaactgggtggttacaagggaacatggtataacaattaacgaaggaaggatcaaatgcaacaaattaggtaggctgccattctgccttgcagacgggacaaacagattaagtgcgatcctattaatgcataatatttttcaagcaacataattaagttcaaatataggctcaagatgttcaaaggtggcttgccttgctcgagatcttgagcttgatcctcgaaatccttggactgcgggtcttcgggtgtataggaatcaggagatcaggaattctggaccgtatagaaatcgtacgacgtcgcccgttcccgagtgatcaaacgttcacgaaactccgcataaaactgaccaagtcgtatcgatcttccagggcgcgcggaaaacgaattaagcatgccagctgcgacgacgattcagatggaagcgtcgccggcagaccattggtctccccgtcatcgccggcggtgcggttgccatggtgtaaactggtgccgtgtcgtgagcactgccatcgtactcctgttcgttggcctcgctgtcggcgggttgttttacctcatagctgtgtccaccagggatctggtttactccgcctcgatcgacgccgtctccggcctcgatctcgaccacccgacgctggacccggtgttcaacctcacagtccgcctctcctcgcagaaccaggtgaccaactacccaaactgcatctggcctggtacaaccgtggaggtcacctaccgcggcgtccagctcgccatcgggtccgtggagcagctctgcgtcggggcgcgggagacgaaggagcagcacgtcgtcgcgtggggcgccggcgtgcgcttgccgggctccgcgctggacgcgctcgcggcggacgcgcggcgcggggcggaggcgttcgacgtcgcggtgaagatcccgaccgtcatccacagtggctaccacagctacgacccccgccacgtccacctggggacgcttgtgtcgtgcatgtcgaggcgggtcggggacgaccccgtcgccgcgctgaggactccgtgccatgcgtccagtacggacatcgctgcgtcatacccaaacaaggggaggacgcagcctgggggtgccagttaacgtgcgtgaatatgcaatccgcccgtcatgtggtagtgagcgagaccagtttctacgttactagaatataatagagttcagtttttttttgggtcaatatatattttgtggtgcatgaattatacatatatagccgaggaatcaataatagatcatgatataaaacaacagtccataatgtccattgctgtacactctattatgcaattttgttgctaatttcccgatccgttgagcatgccttcttgtacaaaagggagagacacaccagtcgtcacatcatcaccgtttcaggcacacgccaatccgcgagcctgacgctccgatcgagcacgaaacatatagtcgtacacaattaacgcagctagccaactaatgaaacgcataaaacttggggggaaaaatcatatggacgatccacgagggcgctcaaaatcgaccttcgtcgtccatctcacgctcgaccgccgcgtcctccaccgtgtcgccaatgtacaagtacgggttcttcgccaccggctggaagttgtagaaaacgaacaggtagaaggcgaggctggcggcctcgatggccacgttgacgccccactggtacttgtagctgagcaaggcgaggaacgccgacgcgatgatccgggtgaagtagaggtagccgacgacgacgaggtagaagcgcttgaacagcgtgagcttctggaggttgagcgccgccttgccatcggtcttggatgcctcgcgcatgctgcggatcgaccagatgatcgggaagaacacggcgcagcagcagatgacgtccaccagcaggaacacctggttccacacgacccagtcctgccccgtcggccccgtctccccgatcaccaccagcaacaggttctcgaccacttgcagcgggatcacgatcataagcatgttcttctccctctcctggaacgagtaattcgcaataattctgtaaaaatggaaaattctatagcctggaattctaggttcgttaatggcgagagagagtaattaagatcaatggtgatcacctggaggtagggcttgaggatggaccagccggtgccgatgaggatgatgacggtgaagagcaggacgcccttgaagaagccgaagacgtagaacgccacgtcccagccgtgcggcgtgccggtgcgctccacgtaccacgagtcctccgccgcgcacgccatcttgagcgccttgaacagcagcagcgcgcccatgacggcgtggatccgctccaccgtcgcgcggtgccgcacgcacacgcacgcccacagcgccaggaacgcgaagtacacctccgacacgaccgtgtagatggtcggcagcggccgcaggcccacgggtaggtagtccctgggcccgtcggagatgccgtcccgcacgttgtacatctcggtgtacacgtcgacggtgacctccacgccgtcctggcagttgctgaacacgacggcgtactggtctgggtcgtcgatgctcacggtggtggtgacgccgccgggcgggacgtcgccgagccggagcaccgggagggcgtactcgctcgtcagcacgcagtaactgcccccgccgtcgtcgccgttgtcccccgggtcggcggccgcgtacgcggacgcgttgttgatcttcgggaactgggttccggagatgaggacgaaccccatgaggctggggtcaaccgcggtgcgccgtgacccccgccggagattccaaaacgagcggcgtatggagatggtcgccttcccgccacgctcgaagccaaactgctcgaacagaatgagaggccgagcgtccgacacgatgagcgtcgtcctgatctcggcatcggcgccccgcacgaggagcagcagcacgacggcggcggctgcgacggcgatggagagggaggtgtccatggaccttgccggcgatcgtacgtgcatgtcgtccaacgctgcggattagccgttctgcttgttgcatcgatcttaatctgcccttcccgatgcagaaatcgcaccatgcatcgatcttaatctaccgtgcaggaggaggaggaggaggaggaggggcggcaatggaaatggacaggcggttcgtcgatgaccatggcgtgttttagggatggccatgagaggagagcgaacggagaagggcgacgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcactgaggtgtggcatcatgttcttgtattttctaaatcctgattttcaaatacctgaatgtatactcttggagcttaatttgctctaaggcccccgcgtcgcctcccgctcgggcgactcgggcggcgacccaagccaccgccgccgccgttcttcccccctcccctctgcctcgccgccgcctgagcaaacggccggcaaagccatcagcttgctaggatggtggcggcggggctcgtggcggcggccaccctagatccggcgcgggcgaatctgagggtggaggccggccggagcggcgctgtcgtcgaggccggaggcgtgcagggcgcgcgggcgacggcggcaggtggtcgtggtggcgacaggcggcgcaggggcgcggggttggcggcggtaggtggaggcagagactggcggtgggatgtgggccacggtggtgaaggcggcggcaggcggaggcggcggggtgtgggccgcggtggtgaaggcagcggtggcggagtctacgacctcgggcatcaccggatccgcgtcgaccattgccggatctggagctaggtgcgggaggggaggcgggtggcagcggggatgcggtggcagcggggatgcaggcggcagcgggagcataggaggcgtggctctggtggtggtggcgcgtggaggagcgtggaggcgaggccggtggtgtggaggccggcgcggcccgtggagatgcggccggcggcgtggcgtggaggccggctcggcagcgtggagtcgggtgcgtcacgtggagtgtggaggccggctcggcagcgtggagacgcgactggcagcgggaggccggtgcggcatgtagaggcgcggccggcggcgtggaggctggcgacggcgcgtggttgtgcggccggcgatggcagaggccggtgcagcacgtggaagcgcggccggcggcatggatggctagccgagcttcgacgaccggtcccttggccgccttggctggttctagtcggtgcagcaggggaatgtgggcgacgataggttgagtcgagggttgaatgcttgtgagacgtcgtggactatcgtgtggccgtcgatgtggggggcttgtgtgggtaatgtgtagacgccggtgaaagccttgccgtgcctttggccggttcgatgacgacgacgccgttggcgccgtttcccttcttgaaggcgttgtcatggcgctctgccatttgccccacaaatctccaggtgaaaaccttgctccggcctcggacgagcggtgacgacgttacgcgtcgtgtccttcttgggggcatcgcttcgggaaagttccttacatcgatgactattgatggtcccttcggctcaaaagctttctttccttggcattcggcgaggcctaagcctcttgggtctgcttcgttctatgatggacgacacactcttcggttgcttctgcggatgaagttggagctgctcgctgttggggtgcggcgacgcttggcaacgatgacgtgttgtagtctcttccaaagagttggtgctggccatgtggaggaagtggctctttggtggcttggctgatgtccattgtggatgtcggagctgctttcgctttggcgacttttgtggcttcagtgtcgctgcagtggtgaagtcggcgctgctgggtcgcttgggcggctagctcggcaacgataatacctcttctgtgatgtcggagctgttgtgccgcttttgtgtttagcttggcaacgatgtcctgtatttgggctccgctgttgttgttagttgtgtgttaggtcccatgctttcttctgtccgttgggttttagccggttccccataattaaccgtgcagctgtatggttttcgggcctgatttcccttataaattgggtcgttgtctcttgtctgtacagtttctccctctcttaatataaaaccagcaatgctggcttaggtttcaaaaaaaaaaattgctctataagtaagaccggttcggaaaagctggttgttgcaacgctgctgagcagtatctacagtgctacagcagccagccaacagcggtcgtaggagcttttcagccagtacaaaacaactagctgcattcaaaatagtccagaccgctgcagccgaacggttaggatgtgcatcacagctgagattgacgtggaaacaggatactaaacatgccttaattcgaagttgttccatgttctaccaaacaaaatgtcttatcatccatcacattcatatatatgagcaaagttcttgatcatgtcctttgggacgaacagaaaagattttgcctacaactcaaggtcgtaggcaaagaactgtttctcatgcatcgtgacgcaagcatattagcactgtcttttcgctgggccggcttggagccctgcatgatgcatcaatatttttcttcctctgaaccagcagcagctcgcttgcagcacgggcaaatcatacgtacagatcacgttcagttcgccgaataataaccaaaactagaatactaatgagatcgacccttctagtagtagaaatgcaaagtgcaaaagcgccagggagaataccatccgaccagaaagacgcttgagaatcgacgtgccatcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcgaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatcccattgcaacattctggtgcctcgactgctctcccgccctgatgtgatttattgattaattatacggagtagtaagagtgctgagtctttttaatcagtgcaggaattaaattctactgcaaggttatatgcaacgtgttcccctgttgctcgtaaaagagatacgaccgacagggagaatgactgaatatgcaggaagtagagtgaaattggttctgcttgcctaccttgggctaactactcgtagtcgtagcaaaacgaacaccattacaccaatattcatgcaaaagttttcaaatcaacgcctatttgcagagatcaacacacgtgttaattaattcgttggtcttccactgcaaatctgcaagtcgacggctgtggtctctcctatgtcctatctaggctagttagctttcacgggtttccacaaaagcaatgtgtagccaagcgagttggcagttaacgaaacatctacttcgatctgatccctagtttaacaaactgttcaaacttcaaagcgtgtaaaaggattagatttgacaaaggtgcattaaccagtgatcagtataccattgtacatgctgcggcggcgccgtgcgtgatcacgctccgagatagcgttactggtttggcggcctgcaacgacgacacgtcaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagtgcccgtctttttatctcagctttttttcccatcttacaagctgatgagactaggggtctttctctgatctgccgagagattaggaagttccggtcggttctgagatgtcaactggtggattggcctttctttgctctgccccatcacgcatgctctttatcttcagatcaacagggtaaatgatgagtgctgaactgctgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaaacatggagcatatggccaacttaaatttcatgcacgaataatatagaataaatagcatgatattcttctacatgtgtggttactattacaacatatgtccacacatgttctcattcaggtaataataacctaacttaaaaggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggaactcggctgattttgccacaagattcttcatgaatcacgttcgtgtgg

SEQ ID NO: 22818 - DNA, 13461 bp, Oryza sativa
caaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcatcagcgtgtacgtgtgtgatggtggtgtacgtgcgcgcatctatctcccgtgtaatctaaaaacacaacacctgcatatgtcatatctgctacctacttttctcgcgaacgaaatcggacggcacgcactgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcatcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtactaagctaaagcgcgctctgatgggggtgatattatcacatcccgatcccgcgatatcatcagcgcccactcactcacgccgcgcacagccgcgcgcactcgcgagcacgcgcgctttacgctttttcttacggcctaaaccgtgtgagcgagcgcgcgggggtgagcgagcggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaaattaatttcataaaagtataaatatattatttttcaataaatatttttataaaaataagaagttaaaattgtgttttggagatcgtgccgtttaaaaaacgatatcctttacgagtacggagagagtataacacgagtacacgaggcgcggcgcgcgggcgcggagcggcaccggaggtgaattcgccaaaacgtggtgtggtcaaagagaccgccccggccttttggcggacggcgacgggtagctatattaatcgatcggatcaaggcgctgctacgctttttacgctgctaagcgcgtcgcggctggcgaagccttgaagcgaccgtgatgccccccgcgacggccaggtgtttaacgagttaggctagcgttgcgcgcggtcgccgtcaggttgtgcttgactgtccggtgaataccatggagaggtagccaaagggaaattaccagcaaggacccctgatcgttgccagtggtcggcctcacacacgtgccaatcgagaagagatgttgtgaccaagttgaagcctgtgctgctgtgcccaagtagcctgtccgtccatgtgttattgtgttgtactactaccatggtgtgtactgctactagttgggcacagtcagatacatcggaccaggagattcggagatcgcttcgagctggatggactgctagcatggtgtacaggaaaagcgacgtgaaggagcatgtccgtttgacttgagcagcagaaactatatatatatatgcgattcggcgaaggcctacaggctacaacttgacggaggcctacaggctacaacttgaccgacttgaatgcatggtaggccatgcgcacgtttcggcgcaagtcaactgcacatatggcaacgcacgagtacgacactcttaagacaggtcaactgtcctaggccagggcttgtcccaatgggcacctgagctggggccatatgtgtatcttgtatctcatcctaaaattttaagccatgtgacatcgaatgtttaaacacctgcataaaatattaaatatagtctaaaaaaataactaattgtacagattgcgactactttgcgagacgaatattttaagcctaaatgctccaatgtggtgctacggtaaacatgtgctaatgacaaattaattaggcttaataaattcgtcttgtggtttgctcatagatactttaattagttttttattagtgcccgaacactaggggtgggcattcggtctgactgaaaatttcggtctcggtcttcggtctttgaaaagtgaagaccgaatttcaacgcaaaaatgtcaggaccgaaaaattcggtctcggtctcggtctcggtcctgaccgaaattcaacaatattttcatacatgcaaagaaataatgaaaatttttaacacaaaaatcacaaaaaaaaattataagcacttatgagttaagactgttattaggttgcatgcctagaagaagtagggatgtaaaaattatagtttaatcctatttaatatagtggattgtaagttgcatttacacttttttgataaatcgatcttttcgatctattcggttaaccgaggagactaactaaattcaccgaacaaaattcggtctttcactgcctaggatcgacttgatgaccgaatttctcggtctcggtcttttcggttcggtccttttctgcccacccttaccaaacaccctatataatacccaatgtgacatgccaaaactttacacccctaaatctaaacaccacctatatagcagtattgtgtagtatcctactgtagtatggatccatatccttttccattactgcacagtgcatagcagtaacaagctaacagcagctggcatgtgggtttatgatgtgtgaggtctacctgtcagctgtaactgttgtatagcaataaatgcgtacaattcatgtcatgctagtatactactctgttaaaaaaaacacattcatcccaacatgtttgtccagattaggattggtttttttttatggaggggtatgtgttttgcatggatgtaaatgcactgtattgttctaaaatctaaaatcttaagtgtacaaaaatattgcatacattcttagatagatagaaatattgcataccacttacatctcttgaaaggaagatatatattggttcaacctaaaaggccacgcatagatcgaacaatcatcacaacatagctatatttttaggaaattttattttgtgaaagttagaaataagtcataatcaacctgggactcaatccaccaattcttgtatgtggctcatattaatcacatactcaagcaagtatattcatgctaaagtttccacatattcacacttcatgttttagggaaaaaaataatcacctttcttttactaaaaaaaaatcacccataacctttgtcaagtcgatgtactagcacgtctacatatgccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagatttgaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtggtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggcaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaatcaatggaagggcagcagttcgcttggggaagggaggagggagggtggaggaaagggccatggacagcgcaggaagacaagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgtacatgttactttttctgcatatgtacgtcagctaattctgtctgatgctatgtatcttacagtactgagcctgtgtatgtcgtgctttgcaggtctgaagagaagtggcaagagctgcaggcttcgttgggtgaactacctgagacctgacctcaagcgaggcaagatcacgccacaggaggagagcgtcatactcgagcttcatgccttgtggggaaacaggtaacaacccatttgcaaatcctttcgtgatcgagctcgatcgcgtttaattttgccatgaatgtgtaactgattcgatcgatcgcattattctctgtggcggtgtaggtggtcgacgatcgcgcgtagcctgcctggcaggacggacaacgagatcaagaactactggaggacgcacttcaagaagggcaagccgtccaagaacatcgagcgcgcgagggctcggttcctgaagcagcgccgcgagatgcagcagcagagccagctgatgcaaaccggccagcagcagcagctcggccaagacgacgacgccaccagcgcggtggtggacgacaaccttgcggaggtcgcgccaccagccgccacctcgctgacccacgacggcgagctccagataatgcaggagatggcgccggacatggacgacctgctgtactaccacccgggagacatgtcgccctattcctacgacgacctcctcggcagcggcggcggcgagtgcggcgccgtggcggccagcgctggcgctgccgcctcgacgagcgagggctcaagcgaggagctcgacggcggcgccgccacgtggggcagcctgtggaacctcgacgacgtggtgcacgacatgatgatcgactgcgccgccggcgccggctgctgctggggtagcttccctccgctacaggataaaggcctcgctttctactagctatagcttaacgattactaaattgctagctagctatagctacaagcctacacactctacaagtagatgttccttttggtcttgtgcatcgatccaaactgatagcacacagcagcctgtgcgtgtggaggaggtcacacgtagtgactatgcaggtgagagcgagaggccattttgtgtacacgaagtgttggtggataaggatgcaacaccaactatactccactttgagtagctagctcgcctcgatggcatgtttggctcatttgagagcgctttttctaggagaaaaaggaagggaagagtttttttctttgttttgcttttggagaaagaatataggaggactgcaggggggaaaatcaggtgttaaaagtgcatctgagctcttgaaatttgacagttgtccattcgaggccatgtacttccaggcaaattattctatacatcatggtgagaattcattcatagagacgctagtaaggaccttcttatagtacttgtggtaataggatattactcttagggtttgctaaggggcgagcactcgttggcagcgaatgtattccaacaaactccacgtttgtcggggtgttcacgagagccacagacacggactctactacccaaaccccatcggatcagagtttcagggtgaggaacggggggagggggttcggaagtggatgatggctgacactggtgggatgggaaaggatggtggggaagatgggtgccaaccagttaagttgcacggagttgtggattgcggcaggaaagggcatggtgcgagggtttggtagtggtgttgtcgactaaaggaggtggtgaaggggtagaggttggcgcaaagaattgacatggtaaataggacaagctcaatagagggaaacctatcgtggggctcgttggcgtcgagtttcccggtgttaattttgctaagaagaggaaaaatggggcgggtgctagagggtgagggaggaaggtcgccttagtctcttgtgattggaggaggtcgtctcaaggaagaggataaggcgggggaggtttggggtaatcattgattctaagacaaaattaaaatatatttttatatttgtgaatgtacctttgatgttgtctagagggagtgaatagacacacttcctaaaattcactttgcaacaatcagtataggccgaaacttccagtgcgcgcatgaggacctacaaaacaagccaagcaaccttaccttaaaactttcggtttctataatagaacttatagtcaactagtccttggcaacaaagagcactcaatcgaaacttctagtctatatatgtactagaactttcgggaccaacaaaaagctagaacccagtgctcatgttgcgtaagatgactctcatctgtagatcaagcgatcgatttgagcacttgagtgacaattaaaccattctcgtgcatcctcttcatgtacagcatacctggaccctaattcaaaatcaaaattaaagttaacttaaatcgctttgacacatttacaaattctttctcttgtttttaagggtcaccattcgtcaatgaatttcttgaataaaactaatgtctacttatttgttaaatacaccaatccattaatcatttttgacatcaattagtcaaaatcctcttagaggacctagatgcacttcaaatttaaaccaacgtaatttccactattaattcatctatctatcatagcggcctccatcagtaccctcctaaccaccggtccatccccttgattttgcctaagtaagtgggataagtacttttattttttttctttatttaagaggacatccctcatatcttttcatgccatttaaatagttatatttcttaaaaaaaatgagagcatagataaatatgtgatatgattctataaacatacaagtttaaataaaaggaacaaattaaactctgcgtgtactattcacaatcacatttttttaacttgtatatgttgaatttaaacttgtatatgagtaaagtaatatatcacatattgatatatgatattaaaattattactattttgcatggttgacatgtacaacaacaaacgggaggcgacctcctcgagggaaataaaggttatctcctaactcgcgtacatttccatttttttagaaatcacctatgtacgaggagaagtgaaggaaaagcactaaagcagcatggtgttccaatgagtggtccttaaattaaaatcttcttttttaaaacgggcaaaagacttacacaccaatatattagtggaaaagagagagatttgacgactatgatctaccgacaggggcgggcccaaggggtagtccaggtaggcccaagactatcctaaaatttggtccagagacccctaggtattcatttttttggcccatgaaaaaagcttggcccatcaaacaaagaaaaccctaactcctcttcaggatggccgtctcccccgtgcgcggcgtgcgctctctcccctcccactcgacggcgtcacggcgacagcgctcccgcgacgcgagccggcaggccggccgccggcgcgactccggcgctcctgcccccgccactcctcccggctggccggctcctgcggtcccgccaggtgcacgcgcccagccgtggcggcggcgccgcgccggcgcccgcacggacacgtcctctctccgtcccgccgcgccttccggccatcgcctggtggcctcccgcaggccacagtcctgctcccgtcgtcccggcgtcccgctcccggctcccgccccgcccgagcccgacggtcgacgctgccagcggctagcacagcagcgcccagtcggcagccgcccaggccggccggcggccggcgccactccatctccggctcttcgcctctccggactccggtgagcaattccacagtccctctcccccttctagaatctagagactagagttctagtagtaaaccaacaggcagcactagtgtactacccctttatataacaattttgcattttttgatggttcatggttgttaggagtccaggagattgaggcatggagaagtcaagcattgcgttgctttttcaaaagcatgaagcaaaaaaaatgcttgtgaacttcttgcaaaaaaaaatttacattttgatttaggtaatatttaaacttatttgttattttctacttgtattgaaccatttagagttatatactgtatcgtttaccacattatatatcgaatcatattgtattgcattcgaattttttttggctaggcctaccctgggttcaaatcctgggtccgccactgtctactaacacatatcatggaggttacatgggagagggagggcacactaaattaactagggaaaaataatcgaactcctgagaacaacgaggaaaggagaaaaaggagaaagagtaagttactaagtgccaagaagatctcctagggattgggcaacaccgcaacccaaagcttctcttattgcacgatgcgatcaaccaccatctccgtcgtggaaataatcccctctaagacatgagcattttttctagccacaggtgccaaggaggacgagggagttgaacccctttcttgtgtgatcctacagttgctggcaagaagactcccaccaaactggaagcagagcctgttgacagggtgatagcctcttgacagggtgatagggaggctaacctggcccggttgaacagcaacttgtgctaaacttgtggtgcgaagacacactgcaccaagatatggtcacctagatatctattgattatctctatacaaacaaatcattagtgtttattattccgatgatcagacgggctagaacaatcagcaaaagataggatatgtgcattcttctggtgcatatatatgctttcgggcctgtaagatcactagcactctatataccatgtgcatttaaacttatatactctgcggcaaaattaattatactactctactttaggggtgtttgccttatcaatatatattaaagcagaaaagtagtgagaatatagggagatgagcttctttttcatatggacaaactgaatggaagaactttcttttcctagagacaactgaatagaagaaacttcaagtgcaccgtttgcactctccactaataagaatctaatcattaaaaaagaacaaaaacgacaatatgcacttggtagtgctgttttttttatcgcacatcagtttgcatgttaatttcgtgaccatatttttacttcctccgttctcaaataaaagacgtttcaaaatgcatacattcgaatcttgaatcttaaatcactactatatatgtacaagcgctaagatttaatgtcgtaaaaatgacattaatagatttgtcataaataatatttttacggagtctttttttttgtttttttataagcttgtgattagaaaaatagttatcagacatgtgctggagaatgtgctgaggtagttcttgatatgttcccattgctttgttatgtagttgggtaattttactatccttaataaggtatgaggtaccatattttttagtgtgaaacttgatatctccatatactagacatcttgatatatcaaatttttagtgtaaaatattggtattacatgtactttcttaactattataaaatttctctatatagttatgtgctatgagcatatgatatacattgtcaaatgcatatatagcacacaagtgacaaatatgtttatagtgatacatacactctccatctcataaaaaaacaaatctaatactggatacagattcataataacatgatgtatcacatattcacattttgtactaggcttgttggtttgttttttaaatagagggagtaagtagagtgagctatatgatcatttagttggtcgtacatacatactgcattatatttcattaacgtgatgcgggctacgattatcatgtatgaatgtcaaaactccattatatttctacgattgtttgtcccttttttatttagatgctttaataatcgtctgtacataggatagcttataagttatttctaagatctcgtttagcatcgtttatattttgttacatatatttttcttgctttacttaaacggtatgaaccaaacctgcactatttggtgtataactacgagtgtcgggatcagctatatgttaagttaatatcaaattatgattgttcaattgaaaaacaaaaacatattcgatttatgtagtcgtacatttaaatcacaaaagaatgatatactaaattatgaaatatataaaatatttacaaacattaaattttcgtgtagttccgattaatcgctgaacctccttccaataaccatatttcgggccaagcccatgtgtgagcaggccgaacactggtttcaagcccatcaacaccgcctccacgccgacgcccgcaaccagcccaacccagccaaaccgccaacttagaaaaacggagcaaagccggctaacttacctcttctttagggtttgtgccttccccccaatccctcacaacgcagccgccacaaaacccttctccccgcgcgcgcgccctccgctccttcctccgcccagctgcccgccgctcgttcgccaccgccaccgccgccgccgccggttggtcccatacttctcttcttctgatctttccggcatagtcgtagccgcgtggtggtctcagaagtaaatctcacccctgtttcgacgaatttctcacggttttgtcctgcagctgcgtcgatcgaagatgtatctccagtactacatcaacgagaagggggacaaggtgtacaccaccaaggttcgtataggctttccccttgcgcttacttgtttgattagtgattattactgtatggtttgcgatgttagtccatgcctgagaggtgtgtctcctcgttgcgttgcagaaggaatctcctctcggtgttcccacgcagtctgctcacccaggtacggtcacttcctctgatttctttatctgctcttgggtcataaaccaatctatgtgctgtttgttttagtgtaaataagaacttaacattcggtttgtatgtcaatctcattgttggcctaactataaacccgcaaacagtttgaagcatgaaaggtggtatactttttgttgagattttatagtctcgttttgtcatgcataccttgagctatcaaagggtgcttagaataggactggctaattagtgctggtctgctgggaattttgctgagcacgaaggcattgcctaaccagagttttgaatctgctggtgtgccttatactagtattttgggtttttggaactgattctcagatgatgtacggacattttttactaagtagaacagtttttttattgttcttgacttaggctgtgtttagttccacaccaaaattggaagtttgaagaaattggaacaatgtgatggaaaagttggaagtttgtgtgtgtaggaaagttaaaatctgatggaaaa

SEQ ID NO: 22819 - DNA, 4552 bp, Oryza sativa
tcgcaatttacaggcggaatctgtaatttgttttgttattagtctacgtttaatacttcaaatgtgtgtctgtatacgtcaaaaaaaaaactggcgatgaactaaacacggccttagaagattgagcttaaagaggtcatagctctttgttcacataagccaatctagtgattgcgttccttgtttagtttcatcaagtgttctacatgtatttttgagggaaaaaagatctctgaggttgtgcttgtgttgcagctcgcttctctccagatgacaagtactcacgccagagatacctgttgaagaagagattcgggttgctgccaacccaaaagccagcaccaaagtactgaaggagaaacctcggaccaccatgttccatggatccctcgaagcgaatcagtcttgcctacctcgctatttacctgtatcactcaaatgatctgatgtatcgcgatgctatctacgaatcgtacttcctctcgaccatattagtatgatcatgaaagtcattcaggtgtcttcgcatgttctgaactgttggcatgattataatctaaaaagtatgaatctagactgttactagtatattgtcacctttgtgctattaggaaatcatatggtggttagctgataaagcaaggaagcaataactgccattttattcaactgagcaataactgaacactcgtgagttgctactttgctttcatgtatagtactggtcataattttaaatgatggctatatgtcggataaggcattctgatagctcgcatggcttacgcggccattgtgtccaacggctaatcagtgatgccggtggtggcggcgtcgctcttggcttcggtaatgattgtagcagatgctatcgccggtgagggatcgagctggcggagcaatggactgttgataccagagctggagcacacggtgacggactgtcgtgccagcacaaatccgcataaccacagaacgtttcactgacactgaggaactctccctgctgatggacctttcctttctcatccatgatccatcaactatcccattttatgaaatgacctcgtctgattccttttcaatgagcatttattcattaccgtgcttgaacccacattactttgcaattcatggaactggaactgagatttcgcaaattgcattcatggatgtgcgaatggaactgaagtttgcattcatcatgaaaattatgatgatgatcagtctgcttcctagatcagaaactgtggtattatctgtgtgtgtgcagacaatttagaagagaagaccgcagagatacaatagatgaacatgacaaagtacagctacaaaatatatagtcgacatttgtcacgaatatacatggattagcagtaaagtttttgataggggcaaaatcaatattgaagatgaaagtggggggaaaaacgaaattgtccttagaaagggacaatttcctagaaatattggcactactcagaacagtacggtaggtcaggtcgctagtgtccttgttttcaatggtgctcgcaaacttctgtgatagaacacaaagttcaaacatgtacaacctccaaaatcgacttctgtggtagaacacgatgttcaaacatggacagcctccaacatcgagaaaatggaagtaaaaacgtgtctaagaaggagcactgagtaaagtcctataagattctgaaacaagatggttacgatctagactggcctatgcatcactaactagcataattacatctcaccttcaaagatgattttctccaaaacgtccatagtaacagtgatggatatgccacaagttccttgggggacaaaaaggatgtattgtgtgtgagcgagtggatgtattgcctagttaaaagcagaagaaatgtattgcctacatctaatgagttgcaaagtgagcagtaatcatctgcactctattttacatataggaaaacctttcaaactactctggagaagaaaccatctctacctccctggaggatggatcatcatcttcatcttctgagatatcatctccagtgctggttatatctgtatagtttgcctgtctagcaaattgccctcgcaccctcggccttgtttcagcaagtttcttcctattcacgtacctcaccttcttgtcaaaacaacgttccttccttttcagcctgaatttggcaagtgctgcagctctccgttcagaccgactacatgtttcctcgggcattggtgtgcttgatgcctgtggccacatattttgtgttggcagttgatttgattgaatgctcataccagcaggattatactgaaatggtggcatcatagatacaccatgacattggggataaacattatactgagggagcaacgtttgtggtgtatgcacttgagcgttgtttatgttcccttggaaattttgcaccggaggatgtgtcataccgtggtccatcatccctgggtaataaaagggaaaatgatatacaggaggagttcctgaagcatcattttggccttcattgcttcgctccagatgcaagttagaggaagaaaagcataccacagggtattgcactggcatctcaaaggcttctttatcccgaatatttacatcagtgccagtgtcacttctgtcagttgtactagagaaattacccctgtgatccgaagagtctaaccgatttccacctttttgtagttcgctgtcaaatgagctggtagttggggtgcttgacttaacataagctagaaaagcagaagactcagcaaccctcaagttagtctttattggacgtgaaaacattactccgggagatgctggcataaaagcaaaggcataaaccttagaaactattcttcaattgggggatctgctaaatcagctaaaggaaatggtttaaggctcaagatacttacaagcttggtcgccgccttcagtagagactagtaaaccctctggtgtgcctttttgtttaggctcagcatcagaaggattagactgcaaacatatcaagaaatgcaagggcatttaacaagtagactgatgcaaaaaattcagcatcttatcatcatcaattgaacatatgaggcaaaaaggcatgctctagcatctaaacagaacacaaaggtagaaagatactaaatagagaagtagtatgttggacagcaaaatataaaaggataactagtacttgattggttacctcatattcatgttgattcgaggtgcttgtttcttgattaatgttttcttttggcttatcatctgtgtcatccgagagaagagtggtgctgttggtattggcgtcactaggttccgataacgccaactcgaaattgtcattgaagaagtttttctccgacaaaccaagctgccaacaccaacattcaacttaagatcaactcatacacgctacagcaacgccacagccatctcagcttagagcatgcttttcaacacagaatttgaagatgaatcaacatagtcccctttaccatccgccttcgccgccacacatgggtccagaggttcagcagctcgttcatgcgcagtggcttgaccaggtactcggctgccccgagacgcaagcacttgacaacaacagagacctcgtctctgttggacatcactgcataattcgcatcaaagatgaggatggtcactacaacaaccctacgagcatgggcatcagaggaataggaggacagcttacttatgatggggatgtggcgcaattccttgttcctggcgatgtatttgagcatcttgaagcacttggagacgggcagatcgacctcggccaagatgatgtcgatctcccccgcctcgcagttgagtacgttgatcacctgcctcggagacttggcgcaagtcactgaaacaaaaacaaagacgtatcattccatgcgagaaggtgtgatagaactgctaattcatctactaaagcaatcttaatccttaattataagagcaaaccaaatactaagcagacaaagctgaactgaccttggtatgagcagttgcagaggaggcggagcacctcccgtgagctacttgggtcgctgtcgcagagcagaatcctcaccttgctccggtccacgaactgctgccctccccctaccgccgccccgccgccaacgcgatccccctcgccggcgcccaccataccccgacccgcacggattccccccctagccacttgtcaccagctgccgacgcgtccgaatcagcacgaacagcacagcagccagcagcagctgccggcgcctagactagacgacgcaggaggacgaagcggttgttggatctgcgggcggcgcctcctcctccatatcccgtgccgtcgccagtagtatcgcccccagaggctaagcagtgtgctaccgccgccacccgccgccgacgccggcggcgtcctcctccgccgcgcgttgcggtccggcccgcaccattatccgcgcctaatctattcaggaggcggcggcggtggtggtggcggcgttggtgtccgctctactggcacaggatattttcctccccctacctttgctt

SEQ ID NO: 22820 - DNA, 5447 bp, Oryza sativa
tgtgtcgcgtactcgcgtcgcgcggtgcgggtgtgcgtgtgcgtgtgccggtgtcaatggattcgtcacgggacgggacgggacgagccgcgagccgcggccccgtgggtgggagggccaggttggatggaggggaagagccgggcgtggttaagccagatgggcccggcctggcggcgtgtgatttcggtgagaaaatatctacgcctacctggcacggaaatatcttaatcgcggatgcgattaggggcggcgggcgtggtggggccgtggccgtgcgatacgggagccgccacgcgcgcgagctgggggccagcgaacgaacgccagggagacgcgctactgtagtagtactgtggaaacgacgacgcgagaggcggagggaggtggtgccgtggtggtgccgtgggagtgggagcgccacgcccacgtacgtgcggcggcgtccacggtggccgcgtccccgccctccgttgcggatcacgacgaaagccgcgccagcccaccgcggacgtgccaaggcggagaaaaatccagagggaaacgcggctctcacgttttcacgtagtacagaccttgatgggcagcatggcgatacggtggtggctgggctgatgagtaaaagattttgagctaccggacgagacgagtggccggtagagagcagcagctggatggggggtgttttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcagcgatgctgcaaaatgggtttagcgttaacagcgctgtcgtttgtttactgatctgttaccagcgctgtaattcagtaattcagcagaatggtaaacacaaccaagatttttgattgcagctctgaactatggccaggcaaaacaatcattttgacgaagggtgtttcctccagttcactggctgtatttcttccaccgagaggagtggatggttggtatcagtgacgacacaacaacatctcgatctcaaaaatctggaggcaggctggcagccagtagcaggagcttggagtgccgatgtcatcagtctcattcacaggacgcactaatcatatttattgctaccaatgaaatcatacaaaatgagttattagctagagtagtgctgcatacaggcttgaaagtcacccaaagctactactatcagcaataagttgttctgacagtggaagtccccatatatattcgcctttattctatgacattgacacaccacaaacacgttttggcaaaggtatttatctacagggaaggagtggcgattgctcctgcctccgtcagcagagggaccaagttccctcctttgtgcatcgccatggtatctgtttgaaagacatcaatgaagatcgacgttaaaatagtgtagaaaaactctggcctaagtgacccttgttctagcgattttcttgttcagaaaaaagttaaacagcgataaaaatgcatgaaaatgttgttggtccgatgacattagtatcacaagttcacgacaaattaagaacaaggaactcaccgtcacagccaccaatatgtttccctttaatgaagacacaaggaacagttctctgtccagtccaatcggcaagagctgactgcagctcagacccatcaccttcgtattatgaggatgaattagttcaatgataaattacaatgtatgaactaaagaatagccaggacattctaaaattgactcatgtaataatatatgatcttttttctacactgttttaacgtcgatctagtcctccctactgagtgttgatgtatcagagctataagtgggtccctgtagtttcttctctgttcggttgtttagttctcttttatgcactatttgtcagaattttgcaaatgcatttctctttttttttcttctctttaaataaccggccggtttctttcaaaagagtgaagtttacagccattttcagcatttcaatttgattaaactcattattgcaaccagttttgctctaaactcaactacaataaatccaatgatatctaaaatagatgcagcacggcggagtaatatgttgtatatagattggagagcaaagaagacgaaatttagcatatgttagtatgtacaataaaaataaccagaagaaagaaaataacagaaaaaaaaataatccactcactttccacatccaattcaacagccttgtaacttgctgccagctctgccagcaatcgcttcactcgggcgcagaaagggcaataagtcttgctatggccagtccaggaagaggaatgacacgaagaaagatcaaaattggagtttaggacagcataggtcacaattttgcagaagtagggagataatcatgttaaactctgttttatatgattgcttgattggttttaatttgcatgatgtaatatggttgtatacagacaaaaggtaacaattatttctcatttctttcagaagctacttaaaagttgagcgcatatcaaatcaactcgttccacattatacctgtgcattccttacaaacaaaatatttcgattccatcatcagcagacaacgacgtgatacattggtaacattgctacaccaactaattggtatgcattggctggtaacttgcatgaatatggtcactatttagctccagaaagttcagcaaaataaatttatagcaaaaggaacatctttggtattgacctttttcatgtgctatcagcttagtgattatcacgaaatttaagcacaaattcagcagaggtttatcatccttgctgctacatcatacacgcgagtgaataaaaaaaggaaaaggtgtgagagagacctgaagacgacgacgggggaggaggcgacgatctccttggccttgtcgagcgccatgaccggcttgctgggctcctctagctgctcggagtcggaggggcgcgaggaagacgaagacgactgtgccatccccatgatgcccgacctccgttttatggccgggcagaaggaggctgggtgatttatttacttatttttatctgcgtttccgcggcagagtcgaacgcaagcacgtcaagctagccacgatttcgaacgcaagggggatcttttatggccagtaccgtgtttgcctatttgggttctttcaaaaaagaccaactttgaattggatatttggaagaatcgttgctttgttgaaggggcttgccttgaggaatggcaggcgccagcactgacgcagctacgaaaccaggatgccaaaactggtttttagtcgttcaaatgtgaggcgaaatatacggcgaaaggcgatactagtattttagtttttcgattatacggcgaagaaaggtgagtactacgtagtacttcttccatcccataataaaagagattttaagtttttatttgtattgtttaaccactcgtcttattcaaaaaaatttaaaattattatttattttttttgacttactttattatccaaagtacttcaagcataattttttatttttatatttacaaaaaaatttttgaataaaacgagtggtcaaatagtacaaacaaaaacttaaaatcctttatattaggacggagggagtagtagtttattagctgttcaaacttcaaacaaacggcaaaacagatagtcgccgtgcctggtttttcttttctttaggcacagcatttgactttacagagaaccggcgagatcagatgagcgaacgtgcctacggagtacctattaggcccatattcagaggcgaggggccgcgacgaatgagatgagcgaacgtgtctacctgttaggcccatatacagaggcgaggggtcgcgacgaatgagatgagcaaacatgtctacctgttaggcccatatagaggccgaggcccggtaaagagagccaggcatgaggcccacagcggcccagacaattttagtacttttcctaccgactgacgaatcccttcttccaaaagcttaaacctcgtgcttttcagaggttagatggaatgtaggattgagcccaaccaggtgagtctcttcgtcttctcagtgccaaatatagcctatatgaacgtctcctcaatgccaaatatagcccacatgaacacatttgcccatctccacacacatcacacatttattcagcccatcaatctatataaaaatagtatgctacctaaattatctccaaattctagatagggctgttaaaaaaaatttctccaaaaaagctaattgttatttatttcttctatttcttcttaagattgtcttctatttctctatttcttcttgagattgtacctcctgtcatgttaatcaatttgttaatcccgcagcatcgcggggcattctctagtagaattaatgatttacatttttttttttgaaaaacgagaagattttttcggaggccatctccaattctccattccaggaacgtgcagtttccgcggttcattcgttaagatcaatattttctgtacgcatgtttttgttccaagacaattttagaagaatacttcaaatagtagtactaaaaaagcgagtgtagatgtagttcctcgacgtccaatcgcatcaacaaattccgcgccggatagcgagaggaacacattgcttttgcttcacatctcaccattgcccacgaaccaaaaattcatccgaaggcacgattagatctgagagaagccgagacacaaactggcaaaaatcgacgacgcaaaagtaaatcgaaccgaagctaaaaatcctattggttgatcatgagcgacaactcagtcccttagatgttctttgaccatgcgatcatctccgcaggagtcattacaggtctgtaggactcatcaccgttgctagcgaccaacagatcgaatcaaattgtaacgaagatctacataaagaacaacaacaaaaaattgattttatggcgactattgtttcgaggggtgttcggatgtatgtaacagccgccgagtgccctgcggcgagacgcatccgagggcacgattggaaggcgagctcaggatacaacagggcgattttgcttcaagggaacgagtcgattgggaaccgattagagactaatcctcccaatgaccagatgacgaagcacgaacacaatcaccagattcaccacaaatccaaaaacaaacgaatcgaacacagacgagacgagcaaaaacgaaaagagaaacgaaggatcgaacactgaaggcttctgcggcggcgatggtatccttcggtggaggggggtggacgcattttataggctcgggcgttgtcagatgctcgcggagcaaaccctaatgggccggagagagtagtg

SEQ ID NO: 22821 - DNA, 3258 bp, Oryza sativa
  unsure (1)..(3258): unsure at all n locations
aacacttgcatatggagctttggaaatgtcctccatgcttgaacacatgtcacccctgacttcctccaaaagtggaccgaaaaatgatgtcatgtactgctccatgctgctgaatgtttctgggatcttagccacctgcgacgacacatacattccatgaatccacagcctctttttatggcaataggcaaaatgagttcacagaggagttaagcaacataagagcagtcatgctaattccttagttccattcttagtgtagttaacattttgatttatggcatttcaactgcaatcattctactctggctaaaaagggggtgtaggttgtctccatagcactacacaagcagaaggtaaatctgaaatctactccagccatctaggtaagtacaattcagatactaccagacaaagcataaacagtgaatcacttggcacagattcaaaaaaaaagggctagtgcttctagtgtgctctaccagaaactggaaagcacaaactccaaagcgcaccagtggtacgatttgcagcgccacccattatttcactaataataagcacaataaacttcaacaagcgcatcagtggtacgattgcagatttgcagccacccaatacttcgcttattacgcgcaattaccggttctacacaaaattaaccactcattcgcgatgcgtgaacccaaaaatggccccatcacaagagagggaaaaaaaaaacggccccaagtcccacccaatcgatgacgcgaaattgacacgcatttcgtcagatccacgccgctcaatggccactcacgcgagtgccaccggtgcgaattcgagaggaagaggaggaggaggaggaggctgcggatgtcgcgagccagcggaggtggtggcgtcaccttgtcgcggagcaggtccttgttgaggatttggtccaccgaccacgagagcaccacctcggacagcccctggctccgccactgccacagcgagtcccccgacgacgacgacgacgacgaccccttccccgcccccgccttcatcgccgcctggtgccacccgccgccgccgtcatcgtcgtcgccgtccctgccgccgtcgaacgcgtgggaggaggagggctccgcgggatccgcctcgcgcccccagtctccgccgccgcggcgccgcatttcgccggcgaccgggagaggaaggaatcgccgcctcgcgattggtgggtcagatttgggggctaaattggagtaggttttagtggatttttttttgtttggtggatttttttatcctattggagtataataaagtatggatcgatctgtccccctgcacggctgcatccaacggttgggcggccgtgattcggacaggctagctagctccagtgacgcgtagtaccggcacaagctcagctcagctcagctcagccggtttggtcggctactcggctgagttcgttccttgcagttgggaaataacctaccgtacaagaagcacctaattaatcaagtattaactttcttttaacagtttaactatttaaaaaacgagaaacgcccagaggtcttccagctagctcaataagatggtgggctagacgacctgggtttgaagtctcaccccttataattttttaatattagatccttccctgatattcgtgttttactatttgaaaaacatgcatgtaaaaaaaaagatgagctgggaaactcagctgccaaacacagacttgaattgagatcacaaacacatggcagtataaatgcaacttttgcattcatataggagcaagtgtaataggattattacatcagtcgatgatagcaattgccaagttagatttttgtcgagatggaagagagagaacttaagaagagagatgtgtgggtgactaagagcaaaaataataacgagctataaactgactataaatttatacgaaatagtgaaacaaccaaaaataaaaggtgttggctctaatgcaaaatctagctaacacgtgcttcaggacaaatactttaaatacagtaggtgagagagatagtgagaagaaaatatagaaacaataatatagttaatttattatatatatattggttttaagatggactaatagcgggtagtgaactctactactccaacgcattcaacgcagcaatgtgggcccaacgaataggaacaaggaagaaagcataggagagagattaacatgagtaaaataaaaattttgatcgtgctattgcagttagctattatagtagtaccttagagacggtaaattatctctatctgatgcggatgaaaattatagcctgctgcttacttcattattaatcttgctctaaccatcattagattgaataacaaagattcagatcgcacaagagtattgttcatcatattaccgtatgtacatgttgaataggggtagcagcgccggggggtctccaatctggcagtggatcccacatgccaatatctaccttcttcttcccttctctttctccacagtccacatctttccccttccccatccccacccacccgacggccctcttcccaaccagtgcatgaggaggcggcggctcaaggctagggggcgagtggatggggagccggcggcgccactgctgtttcacgcgacgatggccgacgctagacgactacgagcacatgaggcgatgacgggatcaactccttgctagcctccctcaccgtcgcgccctccctcccttgccgtcgatggtgcacaccggctccgtcgccctccttgtcgagttgcgccgatggccgacgttgaagaaggaaggcgacagcggccagcagaggtggcggcggctggcaggggaggcgatggccggcagggccagcaaacagcagcgagccaccgagccggcgggcagcaatgaacgacgacggatacgaggagtgagactgtgaanaaagcagnatgtggcgcccgttccgtcgtggcgcctggcgggaggactattcttaaaaaccctatttgcgaaagctgtttctttgcttgtggtctagtgtccgtgccatctcagatctcaaatccccgatctatcatcgaattcaatcccgaatccaaatccttccaaattaatccctccgcaaaagtctatttcgcctcccccgggttcgatgggccgaatccctctcggcccatctcccttcccgtctctctctctctctctccctcgctctgcccgcgcgtgcccgaaccacgccgagcgcctcctccctcccgtcgct

SEQ ID NO: 22822 - DNA, 3017 bp, Oryza sativa
accgcgagccgtgaggctgcgtgtgggcccgccgcatccgcgtccaccgcgaaccacgcgcatgcaccgcgccccgctccacaccctagcgccgcgccgcgtgctccctccgcacggtgagccgagccgctgacaagcaggtcccaccccggaccacgcaagatggactcggtccaccggcggcctctctctcccctccccgcgccctattgggccgtgtcctcttgggccggccggcccatttaactcggccgagccgccccttttctctcgggccgcgccctagccgcccgagggaagtctacttcccctccctcttccttttctttttccaaaagggtttaattaaatcctttttcctttagaccaaaaatccaataatcttagaaattcaatatcttcccaactgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagaccggcagtgcgaggatttcgaggatcaagctcaagatcttgagcaaggcaagccacctttgaacatcttgagcctatatttgaacttaattatgttgcttgaaaaatattatgcattgataggattgcacttagtctgtttgtcccgtctgcaaggcagattggcggacctacctaatttgttgcatttgatccttccattgttaattgttatatcatgttcccttgtaaccacctagttgcgcctcgatattcgtgcactctatgcgagtatcgacggtcgccttcaaacttaaaatctgagtaacttctcgggtaaaacttgggttttacaaaagacttggaaaacccgacacctgggtcggtgcttgcgaactaaatgaatttcaaacaccgcggaccggggaacgtaccgggtgtacggtttcccgctcttgcactaaggaccgtttccttggaatttcatccgaacataagacaagtactaccacatgggtggaatgggacacccctggctgagtaactagcttatcgggggagccttgatgccgagagacatgtggattcaacggggtggtgccggggaggacccctgggcttcctggcatatgatggctgggacctaacctgatgttggtctgggacccctcttattgacatatggtgaacctgtgtcggcttttaaaatgtctcggcatgaaagcctcaaggtctccagacgtggccgttctgtacgggctgggtgatccgggttagtaatgtcgtgtgggtaaagtgtaccccctctgcagaggttattaaactgttcgaacagccgtgcccacggtcatgggcagatgtgaggtgattcctagcgtagttttgtttgactactactttgtgaaattgctgttgtggaatgggatcgatgtttagaaaatctgcggctgatgggatcagctaggcccgggtggccatttgaaagctgttggccgggtgccaaccttgatcaattcaaagactgatacactgcacatactccgaccggacgagacgcactgtctcattcgtgtcgtttgagaagcactcgcttagttgtttcaaaaaggagtttaaataaaatcaattgcaaaaacaacagcctttcctttgaagcctgcattaaacacttaattcccatggcttgctgagtactcctatactcacccttgctctatataaataatacccccctccagttgctggagaagatggagtggatcccgctgatgaggagttcttccaggagtaagtcagctatgatgagttttagggtttcggtctattcccaagtcacgcatgtgatgattggtctaagtcttggcttccgctttcgcttttgtaatgcagttgtgagctcgggatctgtccgcagcccaacatgactgtactcctactctgtaataaagagacctctgttgctgtgatattctgtcttcctgtgataccagcactgtttcctaggactggtatcgattaacaggttaatttagagtgtcacgagctagttccgttcgggactagttcggggcgtgacacaataattgttggtcaaatacttttgtagttgaatcttgaaatatgtcacgccttatattatgggatagagagggtagaggcttatttttaaatttttattagaggaaggttcaatttttttaaaaaaatatagataccaatatcactgacgtttgaatggtacgttcgttcaccatggtgctgtttcgatggtttctgataatttcctacctggctagctccatgcatgaacagattcagtcttttttcttttggatggaaacgttaatgaatattgaaatggagatgatgactccatgaaggctcaaatggctcatatttacactgtcaacacctattgactttgattaaaaaaaacgcctatttgacattggtgatctgatcctggttttaaactttttatacaaaccatacatcgagagcctggagttgcatggattgtgttgtgtaatctcgaggaagaagataaccatggtcattaatccactcattaatccactcactaacagtagcataatcatgggaaggctggcgccaatgcaactgctcgtgctctgcttgatctccgtgacgacgtgcgccgccgcgcacggcctccggcgaggtctagaccagcaaggcatgcgcggccggatcctcgccgacgcgacggcggcgccgccaggaggcgcggtcgtgcccctgcactggtccggtgctcactacgtggcgaacttcaccatcggcacgccgccgcaggccgtgtcggggatcgtcgacctctccggcgagctcgtctggacgcagtgcgcggcgtgcaggagcagcgggtgcttcaagcaggaactccccgtgttcgacccgtccgcgtcgaacacctaccgggcggagcagtgcggctcccccgctctgcaagtccatcccgacgc

SEQ ID NO: 22823 - DNA, 2960 bp, Oryza sativa
ttcctcggcgcctccccaaagctcgccggcgccggcaagagcaacccgccgacaccgttactcggccagcacgcgtcgaacacctccgacgatggctcggacccctactacacggtgcagctggaagggatcaaggccggtgacgtggccgtcgcggcggcatccagcggcggcggcgccatcaccgtcctgcagctcgagaccttcaggccgttgagctacctgcccgacgccgcgtaccaggcgctcgagaaggttgtcacggccgccctcggctcgccgtcgatggcgaacccgccggaacccttcgacctttgcttccagaatgcggcggtcagcggcgtgccggacctcgtgttcacgttccagggcggcgccacattgacggcgcagccgtcgaagtatcttctcggcgacgggaacgggaacggcacggtgtgcttgtccatcctgagctcgacgcggctggactcggctgatgatggcgtgagcatcctgggaagcttgctgcaggagaacgtccacttcctcttcgacctggagaaggagacgctctccttcgaacctgcagactgcagctcactcacctaatggctgcgagatttgctcctgtttcacgaaaagtacttcgaggtaccagtatctcactgtactaaatcgttttcaatcgttggatctagttggacaggatgtgcattgttaaatccaacgatcggaaacgatttggtatcgtgaagtatcagtatcttaaggttctttttattggaccagagcaaatatcaatggctgctgcttcttcctggaagcatatatatggtgattgatatatgtacacatgtatgcagtgaggtgtgtgtgtgtttgtgattattgccagaataaacgcagctatagacggcatgtgctgcggtatgttttactgtgctcttcagtgtgtgtcactcactcacctgcgtgtgcttgtcatcataggctgatatgatgtcagttatatgtgaatgtgagtgcagacaatatccagtccggatctggagttcatgtgtctaagggttcatcaaatggattcattttgtctagcatagtttcctgtggcagaaataatgctatgaatgctgttctgtaaaagtaaacataccataccagtggagtgcatacagagtatggcttcatacctcaatttcaagtggtgatacatattaacagcttcagaaacaaacaaaaaaatgattattaccgcagtcaaccctaacacacagaaatcagtaatcaaacctttaaaatcaagcaggtcaagtaccacatggtctaaaaaaattgaaacacaattgtaacttgtaagacatcttttcacggcattttcgcatattgtcaggagactttgtttaagatatataatcttgccttatgactactgcacggtaagaacaaatatgacaactggaaatcttaacagcaacataaggatatgtttgacaaagacaccttgcattctgaaacacccatgcactggtgcatggatgctcagacaaagaacttccacaaaagccgcatcacactgccctactcgaggtaaataatcacatatatgtagcatggagagtgatcacaaataaacataaaattatcatggcgacatcagacttaaaagtacaggagcagaggcattgtgaaacatggtactccctccgtccaggattataagagattattccctatttggcactcattaaggaagagaaaaaaatgcatctagtaatatgtggaagtacacattggcacattaaataagctgcagaatgtacttatttggagtaaactattgcttttggcaggaaaaagagcatctaaggacagtgacttgatctctgctgtactggataaccaaaatcccctgaatcatggacaaaccaaggcgccattatccactataattgtggccagagggagtacctttgttgctcggagaaattttcctttcaagaagactcgaaagaagaatatgtacgctttatagtgcccaggttttagcaaaatgccaagaaatttgatcaattttaatcatactgcagacatgtgaaaataccatatgggcaaaaggatagtggttcaacaattctaacacaaggatctaaaaagtaaatgaacagattcactcaaaaaagagtgctagtaaaagtatgtcaagcttgcttattactgtaccataaaaaaattgcacggatcaaagtgacaaataatcagccttcagggttcacgcagagatgggttacctttaccgcaaggttgagcaaagtgagttcaactaacagatatgctcaagagtgagcgattgccatagcgcatagaagttttatttgcaccagtttttagtttgaaaaacgactactgtaatagtgtaatttttttcaatatttttgtagtattttaaaaatatcctcataagtggagtactatatctgtccgaaaataactttattttcacccatccttaatacataccaataaaaaataaaaaaatactccctccatgccattttaagtacaaccataagtttccgtgttcaattttaatcatccgtattatttaattttaaaaaaaaataaaaaacataagtcatgtgtaaattactatttatattttatcatctaataacaataaaaatattaatcataaaaaaattcaaataaaacgatcgatcaaaattggacatataaactcatgagtataatgaagcgggatcctctaacataaggtcacccccgacgtggtcactgacaagtgggcccgagagcggggggggtctacatgtcagccactatattcctctgcctttatgtcagaggatcccaatccgcttaaaatgggatgggtgagtaccaatagatcctcaactttatcaaatcctttatctagtctaaacacacaccccaccaaaagtacagtgactgattggagaagc

SEQ ID NO: 22824 - DNA, 3543 bp, Oryza sativa
agctcgccggcggcaagagcgccgccatgacgccgctcgtcaacacctccgaagactcctccgattacatgatccatctggaagggatcaaattcggcgacgtgataatcgcgccgcctccgaacggcagcgtcgtcctggtcgacaccatctttggggtgagcttcctggtcgacgccgcgttccaggccatcaagaaggcggtgacggtcgccgtcggcgcggcgccgatggcgacgccgacgaaaccgttcgatctctgcttcccgaaagcagctgcggcggcgggggccaacagcagcttgccgttgccggacgtcgtgctcacgttccagggcgccgccgcgttgacggtgccgccgtcgaagtacatgtacgacgccgggaacggcacggtgtgcctcgccatgatgagctcggcgatgctgaacctgacgacggagctgagcatcctgggaagattgcatcaggagaacatccacttcctcttcgacctcgacaaggagacgctctccttcgaaccagcggattgcagctcactctcctaatcaatggatgatggtgcttcttctcttaggaaaaagttcgtgtgcttagctagatataggtggtgtgtgcttttgtgacttttttatgctgtgactgctttagtaatcggtgtgaggtcctggttttattagatcttgtgttttcatgtctcggtgaattgatgtaattattaactgtagcctttaagtaaaggccgggattctatctcattacctaaaagtttttagctagtaacagtagttagctttgctgttcaaattggccatatattcatgcttattgtcagaataacgctgccagtgccagtcggaatgagctgcggcatgcttatttttgctctccagtgtagcattgtccagtactccattaagtttctctgttcattaatacacgacaccattcagttttgagaatattttgattttttttttagaattacatgtacacttacaacgcatgcgcactcacccctatgaacacacgcacgcaaaccctacccctatgataccattgaaaacacaacgccgttaaatcctagaaaattcgctctcatggggagtcaaacccagaacctcaggtgctactgaagctcttgtaatcactaggttacaggctctttcgcaagaatattttgattatttgtcttaatttaaattgttatatgaatttaaaagatataaattatgcttaaaagtatctttcatgataaaataattttaagaaataaatgttaattacttattttttttaataagataaatattgaaacatatgtctaaaagtcaactgtctaatatattaaaaaaagtaagcatttttctggatgaaactctatagtgtatcggtttcacacctgctttacactggaagaattttagagcgttttggtataaattgcctacgagattttataaaatttgtgtgttccaaagaaatcctcttatattggtgcaagtaatacatggtttcacctgcgcttgatcgttcttctattttgccatataagagtattgttcttgtgttgatttggcccctataggctgacaagggcgctgactaaatgaaatgggcagggtgataagaattaagaatacaacagttggaaaagaggcaaaggaattaagaggaagcagaacataaacggcgggatctggtgttcgcgatgagtatttgtattcactggagtccgatcacaactactaccactgatcactaggcccatgttattaccaacatgcgagataaacattgcgcatgtcctaactgaactttttgttgggatcggtaaaaaaatgctcaataaatcaaccaacctcaacaaatttaaatttttattatataaaaattgggaaactgtgcgttgtagttgtagatggtcgattactagtctaaaaatgatagaattgaacgctcctttcatttgttaatttctctataatcagaactgttcaacttgagttgctaacaaacacaaatctcaaccatgtaatttttaagaaaaacaagctggttaaccggccagctcccacgagttgagtttcgttataaatttatgagttgctacgagtatttttaaccttttccaattatggtttggaaatattccagcaacttactatcgaaatttaacttttgtgacacatcactctctttttttcgcctaaacgataccactctggcactatatacaccacgcataatataagcctcgacaatggctgtggcgtggtaccaacaccatatttgccacaccgttgatttttggaaaaactattagaggtttatttttaaaatttctattagaaggttcactttttttaaaaaaaatatatccttattgcataagtgacgttagattgatgtatcagttcaggattgaagctaccatttgagtggtttctgacaatttcctatatctagcaccatgatcagatatctaacaaacgctactgaatcccattttgagttcatgaatattcaaactgatggagatgatgactaaaaagtggccagtaattacagtgtcattgtctgtcttaaatcttaattggtcctggtcattgcatgaaccagctatagcccctatataatcactattcactaccaccgatcgtgtgatcttgaggaagaacataatcacggtagctaatccttccctgtcgaagtaaccatgggaaggccagtggcaacactgttcgtgctgtgcttcatctctgtgacggcgtgctcgctctcggagcaggccacgcgcggccgcctcctcgccggcgtcgacgcgacaccgccggcggccggaggcgcagtggccgtgcccatctacctgtcgtcccaggggctctacgtcgccaacttcaccatcggcacgccgccgcagcccgtgtcggcggtcgtcgacctcaccggcgagctcgtctggacgcagtgcacgccgtgccagccctgcttcgagcaggacctgccgctgttcgacccgaccaagtcgtccaccttccgtgggctgccgtgcggctcccacctctgcgagtccatcccggagagcagccgcaactgcaccagcgacgtgtgcatctacgaggcgcccaccaaggccggcgacacgggcggcaaggccggcaccgacaccttcgccatcggggcggccaaggagaccctcggcttcggctgcgtcgtgatgactgacaaacgcctcaagaccataggcgggccctctgggatcgtcgggctagggaggacgccgtggtcgctcgtcacccagatgaacgtcacggcgttctcatactgcctggccgggaagagcagcggcgcgctgttcctcggcgccaccgcgaagcagctcgccggcggcaagaacagctcgacgccgttcgtcatcaagacctcagctggctcttccgacaacggctcgaacccgtactacatggtcaagctggcagggataaaaaccggcggcgcgccgctccaggcagcgtcgagcagcggcagcaccgtcctgct

SEQ ID NO: 22825 - DNA, 367 bp, Oryza sativa
aggcaaggggcaagccccctttctctccttccttttccccttttcctcccgccggcgtcatcctccctccgccctgtcgccgatttggccgctagccggagcgccagctcgctggcttgaccgtccaaaggcggtcccctctccaaaccgacattgccatcctataaagcccaggcgccctccctctcttctcctctcgttgtcccatcgcctccactccattgacgccgcctcccgtgctctgttcaccgtcgccggttgtcgtcgcgcgtgtccgaggagccaacacgagcgatgacgcggaatgggactccgggcgcgccctcatcttcctcttcctcggcccgaggccgaaacgatcacgttt

SEQ ID NO: 22826 - DNA, 997 bp, Oryza sativa
cagatgtgtcatggtaagtgtgtagaatttctttggagtctttgaaagaatttagcttgctgaaacaggagagaaatactaagttgagccttgtcttgcagatgtgtctcaacacatttgataaagcagctgaccttgatgttctgaaccatccgattctgaatttcttttattacttggtatgtcttgattcatttatttcctacttggtatgcttttgttcgtttatattgtcaaaatgttaagcattcaacttatgcagtatgacttacgacaacttttagattttgttatgactaagcaaattatgaaggtatcgagatgagggcagaacttaacaaaggagcatggataatgtgatgttgataatatagtacagtttgcatatgaagaacaataccatatctgactcaatgcggcacgaatgccagctttgtattagagggattttgcgaatattctaaaagaaaaataaatcataccacgggatagctccagaagtatcatatatatttgtttactgttcttatatactaacaaaattctctaatttttttggcagctggttgagatcgtaccttcagctttggtgctattcatcctaaggaaactgccaccgaaacgggggatcacacaatatcatccaattcattagagcagccctggcagggacagaagaggttttcttatgagtagtctatacagcgtggtaaatacagaaaaggcaatgtgaaagataccacacttgctttcgagcttgccccagcttttgtaagaggaagcctttagaatctcagggtaccatcgtgtgtaaaaatgcaatctggtgttgttacagatttagaaagtgttaacttatatatatatatatacctttgttcttcttcacagtgttttccctctgtacacatcactgcaactgtgcctcgcatatttgtgcatttttacctggcgaaaagactgcattttcagtacttgtttcacccaagctcgagga

SEQ ID NO: 22827 - DNA, 1096 bp, Oryza sativa
tatggttgaacctaattttctagtagctccagtataaattactctgattaatgtaactggttaaaatcaaagcatcttcatgcagtgtccttctaggtttctagcgagtctctcattaaagctcttacttaccttactcgaaaaacatgtttagctgttacgtgtttttcttgcatatatattccatacaaggacaatgagctaaactgcacaataaatacacctttgatgattagaatacaaatgccatcaatgtttgtttagtttttacactagtaaagtcaaccttaacatcttgcagtattcattattaagaaaaccattgggactgggctatgtcacatgacctgattacgggtattctatctgaagcacagaaacaaatgtgcatgcattcttttattcctgaatttatttgctgaatatggttctagtttcgcagaataactttcagaaacttttcacagtggcataatcatgtatattcttcttttacttccctccactcttcctattttccccttgtatattttatatcagtctattcatgtttacctcactatagcatactgaatgttaatgtgctatcaacttttccattatgtgcagtttgctggcattaatggagttctgtactacactccacaaattcttgagcaagctggtgttggtgttcttcttgcaaacattggacttagctcctcatctgcatctattcttattagcggactgacaaccttgctgatgcttcccagcattggtattgctatgaggctcatggatatgtctggaagaaggttagacttcatattttacatttttttttgtgattacatgcatcacttctaagtgaaagtattatgctaaccattattctgcgttgtttctcattcaggtttcttctccttgcaacaatccctatcctgatagtagcactagctatcttgattctggtcaatattctggatgtggggaccatggttcatgcctcactgtccacagtcagtgtcatactctacttctgcttctgtgtcatggggttcgggcctaatccaaacattctatgtgcaccgattttcccaccaccgttcgtggc

SEQ ID NO: 22828 - DNA, 924 bp, Oryza sativa
gtgccgatggtgaggttcgccatgtagagcggctgggaccagtagatcggcacgacgccgccgccgcctcctgccaccgccgcgtcggcgaggaggcggccgcgcatgttggcacgctctacacctcgccggaggccgccgccgtgcgcgcgcgcgagcgaacacgccgccgagcacatcacgagcactagtgttgccactagccttcccatgattattatgactactgttagttagctaatgagaggattagtgaccgtgattatcttcctcttccccaaatcacactatacaaatcgagactcgaggcatgggcttatataagaacaaggagtccaggactaaggccctgtttggggagcttcttctgctagaaactgccccaaacagtccacagcttctgagaatatgtagttacatattctgaaaaataaactaagaagccaaaagctggagaatctgggttttagtgcttttccagattctcagaaactggctaccaaatatctgcttctcagaatttaaagctccccaaataggctctaagtcaccatgagtcagggttcacgaaactgatgggtttaaccttaaactgatcaatttttatgagatcgctggttatcagtttgtcgttattagcatgtttttataccgtactgattgaaagtcgtcaatttttttaggttttcgataaaccaatgaaaaacgattttcactttgtaaacgaaaaggtaaaccttctcaagaggcattaacactgtaattacgagccacttgagccttcatggtgtcatcctctccatttcaatattcattgacgttcatggagctaccttggatattcctcagaaaccagcgaaactgcgtgccattgagacgaaattaagcttcaactctgcacatatctatcgttcaaccgtcact

SEQ ID NO: 22829 - DNA, 1832 bp, Oryza sativa
tgctcgcgttccagggcggcgccgagatgacggtgccggtgtcgagctacctgttcgacgccgggaacgacacggcgtgcgtagcgatcctgggctcgccggcgctgggcggcgtgagcatcctgggaagcttgcagcaggtgaacatccatctcctcttcgacctcgacaaggagacgctctccttcgagcctgcagattgcagtgctctatcctaaattcctaatggtatttcttcaagcagttcatgctgcaaataatacgtgaacctacgagtttgtaccgttgtacacttgtactacgtatcctagcttcctaggcaatatgatgtcagcttaatgttactgcaaataatatgtatatcatggtactaccagtagcgtatcaaggatttagggtataggtggttgaagcatccgcgtcaacagtacaccatcaaatttttaaaaaattaattaagaaaaaagtaaaaacgacttataatataaaatggagtttaagtttgtaaaatcaaataagtttataagattaagaacagaattttcaagacatatctgcacgtacgttatttatattttcaaactaaagtattttaaagtcgttgatattcaaacattgaaaatgtttgaccagcttttattcaaaatatcaaatatttataaccgtgtgagcatcatgtacgatcctataggctgacaaggatcctatatacgagctcggttgaccggctagttcaaatttattacagcggatacaatagcagattataagccaactataaatatattttaaggagataaaagaggagagaggagagcagtgagctatagatttatagccagctataacacggactccaagatacatgtgtgtatgataggttggaccatgtattaattgtatacttatatgtttatagtacctattgtataaactagctattagattgactataaataatttaaacaatagttggctaaactgctaagcttgctcttactcatcaattcatggcatcgtctcgataatactaccacttaccacgcgtaaatgcgtaatagatggcttgaccatggccgtggcgtggcagcaagaagccgctaccatgtctaccacaccgttggttggaaaaaaatattactcccaccatctcataatataatataagatatggttaaacttaaacttggtacagtcttcaaaactaatctttgacttataatttttcatgtactataaggtttattgcaacaaaattataattgacttaaagtaaatttaaatgtcaatataatgatattaagtttagcaaataaaatttaatttatattacaatatatagcgcccgttccgtcgtggcgcctagcgggaaaatttaattcttaaaaaaccctaattacgaaatttgtttctttgcttgttgtcagtctccgcgccaatctctgatcttgaattccctacccatcgtcgaattcaaattccgaatccaaatctttctaaattcaaattcctccgcaaaagtctagtttgcctccctcaggttcggtgggccaattcccctctcggcccatctctctctctctctctctcacacagccttcccctcgctctgcccgtgcgccgcacgcgcgtgcgcgtgcgcgtgagccgacgccgagccgagcgctctccccctctctcgttctctctctccgctccatccctggcaagctccccgccgcgttttcgagttccccgcacaccgttgcctcgcgcgcgcgcccgccggtgccgcccgtgccgcgcctgcgccgcctagccgctgctctaccgcgccctgccccgcgagccag

SEQ ID NO: 22830 - DNA, 1145 bp, Oryza sativa
atatgtatttggcctaatttgagaagaattgcgccggcatggataaccagaagtcccatccctgaaatcctttattgccgtcacctcctaaaggttgccgttcaccaaggatactagtttgcctctgtgatttctccctctgaattgatccagaataaggaaacctcccattgcctgtttgaggagtactgcacatggtttcatgataacttctagtacgtgagtcctgaccagaatgatgatttggatgttctctaaacacttccagataaccataactgccacgggatggtctgttgccattgtgccaatattgattaggaggagcaacttgtgaatagtcaccactataggacttgcgttgctgaaagtgtgttctatgcatgtcctcttttgtgtgacacacatttagtcgtgaatcgtggccattgcttctccttgtgtttccagaacctggaaagtgactccatctcattggtcgactgttgccagcagcaattatgtcatgcctcgatgaccctgatgaccatcgatttgcattgtgggcactcctctgacaagtaaacaaataattgtaaggatttcaaaataagagaactttttgcaagaaatatgtcagcatgttaatcttattaacagctccaattgccaaaggtgtataaaggacattattcctaaataacatgaactgctcatgtgactgaataaaggactagaaacaacaaaataattagcttttaggaaattggggtcacaaagaacaggttctaacaagatcagaaagtatttgctactggcaccacacccagcacacttcaaggcctgcattgcttcaccaggagcagcaggacagtctctcctcacccatatgtgttggagggaaccatcgcaagcttttagtaaccatatgtccctaataaacatgataagtcctaccttccgacaaaagaaaatgttccactttattacctgttctctttggttcctctgctctccctccttggttgcatgcataattatttctgctaaattcttgtcgtcaagggcattaaagaaacatccacgtcgttttgagtcatggactaattctgcccatattgaattgcttgccagcaaagtggctccatttccaaggatccaaaggc

SEQ ID NO: 22831 - DNA, 5281 bp, Oryza sativa
tgtttttttaaaaataattctatagaaaagttgctttaaaaaatcatattaatctatttttagagtttaaaatagttaatactcaattaatcatgtgctaatggctcactttattttgcgtatcttcccaatcttctcctatttccttatcttaaacacagcagacccgaaaaaagtcaacctagacatggatgggatatattttagaccaacgaatctgaacataagcataagcatgtttaggttggattttttattggacggatggagtactataggttatcaatgttagtttagttcaaatttaattatttattggagctcacacgtcacacgaggtccattctatgagctggatattctagagttctacgttgtacaagtctgaacaacttcttcttcctaaattaatttatattttctgcggagaatgcaaacttgtaaaggtgttgtgtcatttcgagaaggagagaataagggaagataacctaatcggaattattataaggtatttttccactttgggactaatggaattcatgctccaaacgcaagtgtcttcttactccaattctagaaagaaaaccatggaagtttctattgtggcctagtggtggcatttgtgggctattagtttgttattcatatattactaaatcataggcaatctaaaatagttatagtaatgtatattttaagataatgaaatttatttcagaccttgtttccaagaaattatagttaattattacagtgtttgcaacttgaaagactatgcattgccattacatatcacaatttgatactctctccgtctcataacatagtaacctactattgaagaagacacatactaagaatatgaatctgaacatgatgttgttctaggaaataggatatgttctattcagttcaagattgttatattttaagacggaaattagataaaaaaaattaatcggaacatcaccctaaagacagagacagcgttatctatagttggcgaaaaatctacaatttgcttgtatgtaatccttgttctcatcaaacctgaaaacaaactcctcgaaatcaatgcctgattgttcccgccgattggaactttgctagcaacatcgaaccgaaatgaaagatatcatcggcgattaactgtattgcaaatcaaccgctcgcctaaaaatacctgcaaaacgtgcagaatatagtcttgcccttctgaaaaacacaattttcacatgttccctccagaattacctttgggattttcttttacaagaacactgcagcctctagagttgatttaccttgtttgctttacttcgttcttcttttttttttccctatcaagctccattatttgatcgtcaaatttccacacaaactaagtgtcacgtgaaatatttcaaaccaaattatggccaaatgggacggaaactagtgggtgagcgacgccaaaaagatttatcataccgtgtggcctacattgcgtcactacaacgttgctttcagcagcacattgccatcagctttaacgtattatcctcagcagcagcttttgtgaagtgaagcttccttagccacagccccatgatttttatttttttttcctttttgaaaacccgcccgcaaaagctcaatagtgtttggcgtcaataacactagagccaaggatttacttataaaaataattaaaaaaacttatttataatcatttgtaaaataagtttgtctaaaggattatttataaaatacttctccatcccataaaaaaacaaactcatcgtcattattctaccaatccatttagagtggagttatcgtcacctaggggcggaaacccaaacccatggataccctctgagtctccccttcaattttttcgtcatggttaatatgatagaatgtgctaaaggtttcttaatagtattttaacatagtttaatattgagttaatgtatttatgccggtgtactcggtatgttgagtccccaaattttttgttcctggatccgcccctgccgccaccccacggttggcggttatcgcgaggtatactatggttttaaaatccggaaaggttagcgcaggtgatatataactaggataataggataatcgtacggttttataaattctgggaggagtaaatttttaaatagatttaaaatgtaaaaaaaattccatgcccccagcccactgattaatccaccgccacgtcgctgtaacttcacctgcggatatattccccctcccgtccacctcaccccccacgcgcggcggcgcgcgacggcggcgggcgcgcgccgacgcaacgctgacgtcgccccgcgcgcgcgttcggcgccggcgcttgcttactcgctcgctacgttctggctctcgcaggcatggacgcgtggctctccgctgctggcgacgaggagatgaggtgtcgcgtcgcgccggcggcggctggatgctcgcgtgcgtgggcacgcgtgtgctgcggcgctagcgaatgggggtgagattggattggattggaagcgagagtgacgttcgctagctgggcatctgctgcgaacgccacgacgagacgagcgaggagttgtccgtgctctggagacatctgaaactctgaatttttctgaacatccatatgggttctgatcggtttctggtcatctggattattttttttttctgtcatgcctggaccatttcatccaaatttgaccgaatttgagcataaattgctctctgcgtttagcaactggagctatgagatacatctaaaaaccggtgttttggttagctgttcagataaatttgctcttagatatggtttctgccgttaagcaagtaaccgggctttcatttagattaattatcatcactgattaattaattgattatcaacttgattataagattatattaatttttttacaaataaacataataaatactccatccgtctcattatatagcaacctaagattgaatgggatatttcatagtacaacgaatctgaacagagagactcagtcctaggttgctatattatgtgacggagggagtattgtaaaacaagtaatctaaataatacaatcgaagaaagttttttgagaaaatgtatttttcatgtggagctaataatcgaataagctgaaaagaacatggcttctgtttttggagaaaaaaacaacatgcattaattcacataagtttaaaatacatgaaattcagcttgctaaaaaacatatttaagagcaaaaacaacagtgggcagcaatcatattccaaatgaactttgcaaattattcgtcgaatgactaggatgtgtcactctgtcactagatgggttggcccatatatgccggcccacctgcgagcctgacttgttcctactctgctcctctccaatagtggcctcttgcaaccggtcatggccctccaaatatctcgcccaaaaactcaaatcacaaatgcagaatctctctgttcagaggatgcatccgagagctagcatctttccctccctgcagtgcattggaccagggtcattttcagacctagagccgtaccaaaattgagcccgctgactgttgcactctcattactttctccgttctaaaaatataaacatttcttaattatttaataagtattaaaattaaggaaaactatcgtctttcagttgtctcggtggtcgaattttaaattttgaattatttagattcacctcccaagcatctgatcagctgaaaatatatgaatttccgcgtaatgaaatcagcgcccaaaaaaaattacattgccatataaattttaatttgacaagtaaaaataattatattttaggacggaaagatgagctccaagctcgtaaaatggacagcaacgtggagagggagcatggccactatcagcaacaggaaagcaaatttgtgtccatggtcattggtccatggatagctctgaagtgtcctcgccataactatgcaacagcgacctttgcgatggcgttgcccggagcaaagacgaaggagacggctctctggattagtgtgaacacggttgacgacgggtcactgtatacgagtgtatgatcgctacgctacgagctttagttccttccaaagtactgtactttgtggcaatgatctcgagtcgatcacgtagtgacactgttgctgtacggattacaaacgtattgttgcattgaaagatgttaattagaagttttctcatgggctcatggcatttgatatggttaatttgcagtttgggttacatgtctgacaggcaatggcgatacctgtctttcttgggcttttgtgaggcccaatgtgcagaaacagttaatcacggcgtgtttagttccaaagttattcttcaaactttcaacttttccatcacatcaaaactttcatacacacacaaacagtcagctttacgaagcagattcagaaatcagaactagactactagttaatcagttcgatcaggactgttcatatcaacttactatatgaaactagactgctcctcccagaatgttaacttaggaaaaataagtatgtccaatatagtagttttgatttttttttactctcatatgtagttaagaatgaattaaaatgataacattgtagtaccaaacaaggcaagcgaacgcatgattctgcacagtaacacactgacaacttggctacactgcctacacatacaacacaaggcctgtttcaaatgcaggaattttatctgatttctaaaaattctataaaattcctgcgtttcaaacagacttcagataaaacgattttatgctaatacttatgtaatgtaccagtacggggagtactggagtttgcatacatatcatgcaaacctacaaattgtgtaacgtgccatcccggccggccggcgccgtctcagttgccgccgccgccgctgccggcggcggtggcgccaactctgacatccgggttgcgcaccgtcttgagccacatcccggcgagcacccgcgacgacaagctccacacgacgtccggccgctgcctcgcctgagacgacggcgtcgtcgtcgtcgtcggcgtccgcgctctcctgcccgcggcgcgcgccggcccgtgcgcgagcgcccactgcattgccgtcagcttctgcctctccgcgccccagctcgcgcggccgccgccggcgccgcctcccaccgggcaccgcagctgcacgccgccgacgtgcaggctcctcaccttgaacctcccgccggtgttccccgccgggccgagcagcc

SEQ ID NO: 22832 - DNA, 2112 bp, Oryza sativa
ccgccttgcgcaccgtgacggcgaggcggaggccgtccatggaggccggaacgccgcggacgccggccacctcgacggacaggaggcacccgcaccggcgcttcccgatgcgagagagcacgcgcaccggcttccactcccatatcgccgccgccctcgtcttccccccaacctcggccgccgccgccgccgtaaaaccatacctcctcgactccaccgacgtctcgccgccggccggcctcctccacgacgacagcgagagccggcgcgacgaccgcgccctccgatcatccctccctccatccacaatcctcggcccatcgccaccaccggacctcacgatggcgaccgacgccgctcgccggtggatagcgtccggccgatcgaggtactcgcccaggtcaagcccagagctcgccatcgcctcgccaccggagcccgccatgtccgtccgtgtcacgacgcggagcgcgcgcactgtggcgttggcgcgaagggtgggggggttgaaaaaggaggcgcaactactccatcggacggctcagattcgcctcgttggtcggatcgacggccaggagcgctctgggcgttcctgtttcgtctccgatggccgcggctcgtccacgacggtggcgacgcacgcgaggtcgagcgagtgatcgaattgacgccacgggatttgggtcatggccgacctgtgacttggattagtagagaggaagctttacgacttgggcaaagttgatgtgatcaggtgttaatgcgagcaaagcaagcgagcgaggggaattaatgggcgttggtagaagaagaggaggaaaatgaaacgcggtggttttcgatcgccacggcgatgggagctactgggatgggagcggtgagcgtgtcgtgttgctgagcgagctcgcgtggtggtgatgactgctagctgccgaggtaaccagagacgacttacggtttcctttaccgtcggttaattaccacaatgatagtcccataatcctaccaagtttttctttaaaaatagtaatacgttgatcttggtagtcggttttattgtcgtgatacggtaaccccttcgatccgctatttctcttaataatagaataatatatggcctttgcttaaaaaaattaaatgaatcggcaagctgccactttcattgaatagagggggagtaaactttacaagtgtcagagaaaaaaatcaaggctcaggaacttcagtccgagcaacaaaaaagaaagccaactaccgacatctctcactcctgccaagaaccacgatttggcctcctatttaattttagccagaaggctaccatagctccttttgttgaaaggttttgcagtttctttcgttccagatttcccaagctaacaggggcgctagcatgcgcagggctttctttggagcgtcttttgtatttgcggtagcctcccaccccttcgacctttgcttcaaaataagttacaacgatatgttataaacattattcactcgatatagagttttatttcatatatgacaaggtaataagtttaagaacttcaacataaaacaaatgaaatacatcttatttataagtctccattcaaaattagcaaagatctacatgacagattcctagttagtttcgacattttttttttgaggggtaacgggcaagagctctgccaatttcatttaagaagaagagagaaagacaacaaaggttttgtacaaacccagattacaaaaagaatcttaaggatccttcgagagtagaaagtttggggagaaaaactaaaatttttagaaaatgtaaagaaactataatagtagctagtttcgacatgcagcatgtattacttcttaggccgagtttagttcccaacttttttttcaaacttccaactttttcaccacatcaaaacttttctatacacacaaactttaaactttttcatcacatcgtttcaatttcaatcaaacttttaagagtaaagtccatcaccggtcctaaacttgtaccgttgtgtcatctccgtccctaaactcgtaaatcgatcgttcacgtcctcaaaccttgttcgactgtgttatccccgtccctaaacttacagatcactc

SEQ ID NO: 22833 - DNA, 15264 bp, Oryza sativa
ataaagtgaaaattactgtattataatttaataaaatgggggtattctattattttttgggtatgcgtaaggtgagtaaaaaaataaatttattttggacggagggagtacgtgatatttccccttgcaggccgcggcccagaagaaacaggctagcagctgtggcccactcgggacggcgagcccactcggatcagatccccccctcggcgtcgcgtcgcgtcgccaccacgcgacgcgccgcgcgcggccgggctgctcctctcctctcccacccacaccacacaaaacgcaacgcgccgcacgcttcaccaccgcgcgcgcatccgcgtatgattttttcccccctttccccacagccacgagaagatcgagatcaacacgagcgcgcgcgcgccgacgccgacgcggcggcgagggcgccgcagcccgcccccgcggcgtgtggccgtgtgccaccgtgcgcgcggcgcggcttcgtggtggagcgggcagagcgcgccgcggcttgcggcagcatccatccaggtctcggatcatcatcctctcttcgcagcttttgatcgggtttgtcatgttttgattcttcagactttcagcgcctggcctttatatcacttctgcagttccaaaagttctggtttctgtctgaatttctgattgctgttaccaccccaaaactcttcaccatcgaagagatatgagataatcacttgcacaaaaaaaaatcacttaaaaactgcagaaaataaccacaattaacaacaccagcacagagatatatgcagaaccaagaggggttcttcgggtattattgatattattattagatagcagggtagcaaaccaaccacccaaacgaacgaacgaacgaacttatgaggttcatacatatacgatgtctttagaccacacatttatatgctattaggtactaagagagtcttcttccaccactgctatagggtgattactgataaaccatctagtcttggctctcttctctcaaatccacaactatgtgttgtgataaacagatgaaaggctcaggagaacaaactgaattcttgggggtgccaggcgacaggagttcagtatacttggggtgcctccctcagggctacattcaggctgctttccaccgtttgccacccaagtccaaagttgttgctttgcatcattgtgacaaattcagcataatcgatttgaccatcctgaaaatttaccaaaaaaaaaagaacaagaaaaacataattactgatgagatgttcagcaaggaagcaaaaataatctcaatgacaccttttctgttctgagaaaaacataacttgctttcctatgttactaagcaaatataagtattcatcttatgataattcaacagtatatgccaaataattgaggcccttttgaacatatgggaagtcttccctcagctgttcagtttatcctcaaacaaagaggacaataagttgggggtgaaagcgcaaaagtatgaaacctctaaactatacatttttaaacagcctgtaaataacatcattatagttgttcatatcggatccaggtcttccactgcagaggatccaaattggttcatatctattgctgaaggtaatactgaaagtgaaacatcatttaggaccaacttctaccacatacatgctgctattctataaccagtgccatcaaattcttcacgagtagaacaattagctactgaacagcaataactaatactagcacactgatcttatagcttgaaaaacagtacagaacttacattgttttgatcaacctccagaatcatctcttcaaggaaagtatcttccatgttacgttccatgcaagccttttgaagcttgtcaactgtgataaaaccacttccatctttgtcaaagtatgtaaaggctgccatcaagtgtttctcacgttctattttattaagagacactgctgcagcaataaactcttcccagttgatggtggaggtggtgtcatcagcctgaagtagtactcaaaaaggttaaaatatataaaacagttctgcaatgaagacagtatttcatcacagatgcatgacatactccatttcaactaaaccaatggtttaagtaatcttttgacatgaatgtgttggccccgacttttcacacacattcaaaacaatacagaattctgaaaagcagcatgatcaaaaggttgacaaacaatatccagtctatatactacagataccatgtatatggtttaagtgtgctacagtacattttgcatcgtattttgcaataacagtgaccacttactgcttccattaagtcgttaatttcagtatccttgaacatgagctgtatcttttcagtcccttaagctcaccaaatgtaaccacacttctgtttttggtgtccatagccttgaacatttctcttaacccaacaatctcctcttctgaaagacgctcagcaataatctggatgaacagcaagtaagaaacatagattactgcaatctgtaatatttttaaatatgagaaatagatagacataatagtttaagtaaaaattgatgccttaattaatctcatcctgattcctagcatctcctacttttgtatcatagcaatttatgaaattatatctgggtcaatttagaatagtaaatttaggtgcaccataaaagtctgtaactctcaacttggaagcaatgctggaacaggtacaataccgacaaaagatcttcgtatatgataacaataaacaattcaccaatgaagaaaatattactgagtcagatttaaaaacaatttcagtgctgtcaaatttttaagatcctacgaggaaaaatctgaactgcagcaaatcaatttggccatgatggcatgatgtacacaaggtagctttgtttttattcttgtagaagtagctatgcttctggaatttaaaaaggttcacacttctgttagatttagtattaaaggacagcagtaatagaataatgatttccctggaaattgtgaaagcatttaatgatgcttcaccatgatgacaaaatggaaacaaataaatgacttttctatgacaagatgaaacggtaaaaaaaaatatacctggagagacaatttctttaacctattcattgcagaaaattgcttgagacgaggaagtacacttggatccagagctcgattagtagccactccattatcacatatccatggatgctctgaacatataatagaaaaactgtaagaaactgctctttgtttactcttgagatcttactatagtttcggaacttatgaaatttcgtggataacaaaaacattggtccaaaattattctacgaggtactaaattgaataaaagtgatactaatgaacgaaatattaaatatactaacttagcacttcatgggctttcaaacgctctgatggataagggcagagcatcttttttataagatcctttgcactgtcagatatcctgggccaccggtttgatttaaaatcaatacgtccatccagtactttttcatatatcccgctttgtgtatctagtaagagtgaaagaagtccttttagcaattcactaaaaccaatgaagcagaattttgcaaatcttgtcaaatcaatcacctgcccaaaatggaggaacaccagtcagcaatacatagagaatcactccagcagtccatatatcagcctctggtccataacgcttctccaatacctctggagcaatataatatggacttcccactacctctctgaaaacctgacctgatttgtggatagatatgaatcagttaggaaaaacagccaaaggaagcatagattgtatgcaagagtaacaattacattattatttgtttttgttaaagctgcattataaggaactacaacaaactaatgtttccaagactaaattactggtagaaaatttgattgggattgtttttctactctgccatactttcaccttactcgctctttgtacggaactatttacatcataactaaataagttagcaggatatcaaacagctgattgctaacatgactaaatatagaaacaaccccattgaatatacttattgactctgacataatacctggtctgaagaacacagatagaccaaagtcaattgctttaaccgagaattcatcgtctgcgtccagtaagaggaaattttctggcttgagatcccggtgcatcactccatgtgaatggcatgtttctatgatgccaactataatttttataagctctgcagccttccgttcactgtaatgacctcgcttctgaatcttgctgaagagctcaccacctgcacagagctccatgacgatgtgcacggcctgctcatcctcatatgtgtccttgattgtcactatattcttctggcccgaaagatggtgcattatctggatttcacggcgcacgtcctcgatatctgacacacatcggagattactctttaagatagtcttgcatgcatattgacaccctgtgctaatctcagtgcagaggtatgttttcccgaactgtccctgtccaagctcccggccaagagtatagagctcccttacatttggagtcttgtatccaaggacaggggactttaggttcagcccttgccgcagagcacccgctaagctggcccttgacgagcccgagtagcaatcctcagtatcattcccatcaacgtaccgagaagcaaaacggtcattctgaaaccggttgctgttctggtaattgttcccataggttccattttgcaagaattccccattcccacaaaaatgtatatcctgcatgatacaatatgcaagttagatatctacaacacttcacagggatccggaaaagcctgctaaaaaggagaactccagcttaatttagtactcattcagaacttgtacttattgtagtaatacagtaagagtagagcaagaccttagcctaaaactggacaccccaacaaccagactctatgttatcaaaacacaaccaatcgacaagtaactaatcacctaaacaattgtgatattatccaaagtttcgagctctcctaagctcctacgagcagcaaattccccaaccttctatagctctatgcatcctacaccctcaccaaattcagtacagtttcctccaaaggcatctccctttaaaccttcctacagctcacaatccccaacccaaaggctcccagcaccaaaatctccaccaaaaatctcctcctggaagaaccacttcacttcacctcctccaatccacccaaccccaaagccatggccagccaaaaacaaacgaaatctaaatcgagacgatgaactcgctacaaaatgtatatccaagcgaatcaagaatcgccaggacggggctcacctgaagccgcttcagcctcgatcggaggagcaagggaggcaaggagagccggggggagcggcacagggaccggagccggattccctgcctccctaggggctaaattgcaaaatcgataggaggaaaaaaatggagaggagagcgctgaggagacggaggtggcaggagaccccccttttatacccccggccgggggaggagagggtggttggtcgcgccacgtcagcagggcctcgtgggggagggggctggacgcatcaacggccaggatttgtcgatcgcggatgatggaaacgttgatgagcggctgggatgtcatggtgaggaattgaggatacactcatacacgccatttggtaagcttttttttttttgggttgctggaaggcaatggtgaagtggtgaactggtgattggtgtttcttggggagtcaggcgatgcttaatataaagatggtgatctgctaccgggattttagccagatgtgtccgcggcgttgatgcggtacaatgatgtggcgtggagtgcgggaggatgcaggggttcaacgacaaaccgagtgttacgtggaaaggtaaaaggttgtaacagaacggtaaaatgacaaatgcctttctaagctggatgcactaatttggtatgtttcgtgttctaattacatcgcgacataaaatagccaggtttcggatacgttatcgttgcttttaggtacgataaaacatttatgtaaagagaagaaatcattgcgtcacggaaaaataatgatgtgtcctgataagaaattttggtccgtggtatatttgaacggatggttctagatgtttcagttaattgatatagcgtgaaagtttaataaattatatctaatacgacaagaaaccattaaccttacatagggtgtggggtttttcgttatttcagcagcttagttacatcaaaccctttctcaaatgtataaaagaaatgtctcaaacttatatagttaatggcaatcacgtcttaagctagctttctttggtatggataaattttagggtgaagtatattttcaacccttaaaccttgctcgaagttaatttatttttcgccttgaaaaaaaaacaggtaaaaaaacaccctatgatgttattttagatgttttattggaaatagaggtggtttactaattcatatgctcgtatcgtgcaaaatttgtcgatgtaaatgttatttaggtaggcccatgactatggctgtgttttttagcctaagttcacaattcacctgcctcgtttttcacgctcatgtttcccaaattgctaaacaatgtgtttttttaaaagaaatactataggaaagttgttttaaaaaatatattagttcttttttaagttttttatagctaatactatctaatcatgcattaatccattgcatagttttgcgtgtggataggaggggttcccaacaaaaaaaagtacacaccttataaaatctacctaaatggggtttctgtaagcgaaaagactttcatagagaaaatcaccttgaaatatattatagggtttcacatgtccagttttaaaagttgcaggggaaaaataatcaattttatagtttaaagtaaaaaaaacagatttgacccttatttttaccggaatggaaaaggaagtattaccctacagtatatgatgtgggtaatttttgattgatgccaaatggcgccatattgattttttgggtagttgaatagtaaaattgatagttcggtttgaagcccaatggttagtagaacatttttttaataatacatagcacaatcctaaaactttattcacccgtaatataaaattctaacatgctcatttatattgccatcgtgatcgtaccaaaacatgcatatatgacgagcatcacgatgacagtggatatcgcgatgtacgtacatgtacactgctgccatccatcgccgtgagcttacgctcacggggccgatcgaagtgacgctagctaagctccagcttgagcagcagtgagcgcgcggcttcatgccccttgcacaaggcaccaaattagatctgacatgcattacaccatgccgcctgccgactgccgtgtgtcacgctgcatgcgagatggtacgtactggctagctcgatctcttcgtttcgtcgtcactcgcgataaaatatcgatcgtctccgctgatttccgaacaccgtacgtacccaagcttgggtgagctctcgctagcttagagcagatacagtagcaaattataaatcaactataattataaatcaactataaacttctaaaggtgcaagtgggtttacccacgaatatgcttatagacaaaaatagtgcgtaaccgccggtttgactagcgggttaactatgaatttgacttataaatgggtttatagttcgatccacttatatatttagatgcggcaagccggaccgcaatgcgaaaacccataaattattatttatttaaactcgcggatcggcccgcttgcacccctactactataaacacatgtcgaaaagataaaagaagagagaagaacaacgagctacaaatttatagctaaactataacacagactctaaaacgtaatgtgtgtatgatatgtgagaccagatattaattatatattatgtatgtttataagtaaatattatatgaattgactatggataatttaaattaaaagtagtagttgttgcctatgttcttacagtgttttgcatgtactaccagctatatatagctataggtgaagcgtcgatgttaccatacctgatttctgcttggttaacttaattatggcctatggggccccgtttctttcattcatatgtgatttaatttttggagggttaggtgaagtgttgcgttttgtgtccaattcgtaccacaagtccactacacacatgcatgcttgttgaaaaacatgaaggtcgatttaccactagctagtagtaccatctagttaaaaaatctcgaaaaagtaggagtaccatttttaataactcgactatatatgaattctgtttaattgatatataatactactaatcaataacacgccgtcacaaccataaacattaagacaaagttaaactaactctcacaaacatgcatggctagccatatattacattatctcgttctttaattctacataatttgtgccgtcaatccatctatattttgacaacaaatatcttttaggttatctagctagctagagatgtggtttttagttactgcaccatcactcgtgtcggcggcggcggtggtaggtgggtgaaggaggcaggtggtcagggcgtgtggcgggtgggcggaggagtaggcgtcgacggcggggaggagaaggagtaggcccggcagtgaggatctgcagcggagtaggaggcagtgggggtgttggcggcggtcacaggtggacgtcgacagtgtcgctggcaggaatctggagcgaaggaggcaagcgggtggaggagtcaccgacggggatgggtaggcggaggaggagtcggagtgcgcaatgggtgggttacgcgacaggtgggaggtccaggctattggatatgacgatctgatggttaatattaaagcaagaataatagtgggctgtaaaaatgctgaatgttgaggtggatgatagatgatagagatgagaagcgggctgtaagcttacagccggcttagacacaggaactaagaaaatcagtgagacagacaggtggaccatatatttatagtgaagagctaaccactatatgagtgagctgagagataggctataaagatctatacagtcagtagctggctatattattagccttgctcttagcatgtttgtcagatgtgtctgctatatcatgaactaagaaaatcagtgagacagacaggtggaccatatatttatagtgaagagctaaccactatatgagtgagctgagagataggctataaagatctatacaatcagcagctgactgtattattagccttgctcttagcatgtttgtcagatgtgtctgctatataaaaatcgagaccactattacaaatttaagtagtagagatacaattataaaaacaaacctgccccaccttagaaaaaaaaaactttctgtgaaaaagaacgaaactacatgagattgaggagaagatcatgttttgccttctgcccagatcgtcactactttaaccctaaacaaatctttggcgcatctaaaaggcaaaaacaaaagacacaactatgtgctcaacacacttgttttcctaccctactaatttaatgattcctcctgttgcatttatccatccacgcaagcaagctgcaggtactaaccatatgtaactccgaaagcacctgtgttatactaagataattaaggtttaaaactaacacaacttgctagacactacacgtactacatgacagtgaatcattctttcatagacaaggttaatattatcgctatgcgctcttgacagtgaacatcatccaacccgaagctaaggttaattgtcaccatgtgcttcttcagttctccttttctgtgacgaccatgcattatactttttctatccataaatccataataaacttgtctcactagttcaaccggcttatgtcagatgaacctgtcatccaatttagttgatttctaccgttactgtgttctaatgggaaaattggattggctacttaatttcttgattttcgttagcatattttaaaattgttaaactttgcatttttttagaaaaataaagtaaatttatttatttattcaattattaatgcttcattttgcgattatttttcattttgcatgtgactaataagccgttctcatcctccgattagaacgtgaataaagtatgttagtactttctttaacatggtccatcaataaacaggaggtaaatgcgatgattttttaaagccagaggtaaatgatttttcagagtttagagagagagcaacactttgcactggcagaagagtggccgtagagattgcgtgctggctgggccccgcaatgggcccatgggcccacaagccgggcaaaaacttcgcacgagggactcatgcagagccgttcattcactttcactggggcccaccagctcgtccggtgcgtgaaagcctagtgggcggcgttccgtggaccgagtacggtacatgggcccagtgttgtggttgtacggtcggatcggagaccatccctagcccatactgaattctgtatctccaaaagtttctcaaattctcatccaaatcaagccaagtagccaactgtttcttatatgttgtcaaatttcaccgcaagtcaccttaccgcataaaatttctcaatgtgtttgtacctcattttgttaccgcaatatattttttcacttcccattgtgaatagggcgaaaggtaaatgtttttgttaaacttctataggtttgattaaatttatataaaaaattagcaacatctacaacaccagataagtttaactaaatataacattgaatatatcttaacaatatatttactatatttttatataaacttactctctccgtttcataatgtaagtcattctatcattgtccataattcatataaatattaatgaatctagacatataacatccatatgaatatggacaatactagaatgacttacattataaaacggaggaagtagataaataaaagtcaaaagcgactcataacaaatggagtagtacaagacactcagaaggggatacgtacagacatgccgtaaatcaaaaggaaaaagtccacttagactcccttaattattcaccgaatctaattcgtgacccttaactgtaaaaccggataggatgactctcgaattattgaaaccagtgcaatttgactcctccagcggttttggagagcggttttgcttacgtggcgctgatgtggcagtgctaacccggttttcattctatgtggtgcttatgtggcatttagaattaaaaaaatatatgtgggacccatctgtcattcatacacaaaatatatcatgggacccaccgatatatgggcccacgtgtcatcctttttccttcccttcttcctcctccttctctctcccttctctctcttctctctcccccttttctcttcccccttgggaagcatcggtggcggcggcggccgggggctggagtggcgacggcagcgtgcgggcgagggctggagcggcgacggccgcgccaccgcctgccccgtctccaagcaggctcgtcgccgctccccctctaggcccggccggcgcttggatccagcgcgaacccggatgttggaagcaagcagtaattatgcatgtgccacttaattgaatgtgcaaatgtagatgaaatcgatttttttttgactgaaatgaaatcgattgtgaaaatggatgaagaagcacacaaacctgtgagctgcagctgctgacgcagcgggcaatccgggagcagacagtggatctcgacgatctcctcgagctcgtcgatgagcagcacctccttctggcatttggtcgccggccagtggcggaggaagatgtctcgagcgacggatgctgccgcagtaggagagctggcggtggtacgtgtgcacccaccgcgtccggtgcagcggcagcagcacacgcgccatgaacgcccggtgctcctccttgagtggcacggcgaagccgttgatgatgctgccgcagatctcgagcagctcgccgacgccgcagtggcgctcggcctcctccggggacgtgtcgtagacgaaccggagtagcgcggcggccatgatgcgctgcataaacgcgcgctcgacggtgagcttggagtagagctggtggtagacgtacttgaggcggtcgcgctcgcgcgagtcctcgaaggcgaagagcgccacgaggccggcgaggaagctccgatcgacgtggttgcggagcgtcctggcgtccgcggcggtgagcacgtcgtagacgaggtggaggtgcggccacgatcgacgggagcagcaccatcacggggacctcgtcgtcgagcacgtcggacggcggcgagggcgacgacgggtaggcggacggcggcactgcccggaggcaggaacaagttggcggcgaccatcttgaccagcgccaccatcacccggtggtccagcccctgcggcggctgcttcttcccgctcgccacgtcagcgccatgtgagcaaaactaccctctaaaatcgatggaggagtcaaattgcactggttttaataattctgagagtcatcctacccggttttacagttaaggatgacgaactagatttggtgaacaattaagggtgtctaagtgcactttttcctaaatcgaaatgacacaaataagcccatctacttgtaaaggcccaaggcccatgtggccgtgcacctacaaccaaccacgtcatcgatccatactcccccatttcaaaaccagaatccaccgtccattctcatccaacggtggagcacaaccctcccacggatcgcgtccctcctccccgtcgtcacaagccacgtcatcgatccgcaccgatcccccactacccaatcccacccctccatttccaatccaacgctccaaacccaacaccccacggatcgcacccctcgccttcacctcctataaatatccgcacaccccaagtgtgtctctccatctaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcccctgtgattccgtcattttatatttctgtttcctgtgatgtgaatttgtgcgaagttcgtgaaactgcctttcggatgaaacgaattttgttttcgtggaagttcagattggttgtgcatttaatatttggggaaatttgtagtctgccaagtatgtgtaatcagcgtgtggagttgaaaaatgttggtatagagaacacaataggtcagaagacgacgcggcgtgagtcgtgacaatgcggtcgcctggagtgctggaccatggcgaacctgtacagtacagctttggtgggtacagtacagcacacgctatacggggtgcgacacggccatttctgccttcaaccgtcccaatctttttatttcgaagtaaaaaccgcttctcacggtttatcgaaatatgtctgaaccaaaaaaaaccaatgaatttcagtcaacatcatacagaaactggctcataccaattggttttcacaaatcaagtactaacggtttcacaaaaatctcataccaattggttttcacaaatcaagtactaacggtttcacaaaaatctaccatttttcacgaaattccatcggttctatgaacatgctcatcacccaccggcattctacctgcatattgttttcttttttcaaacacagcagcacgcacacttgtcattacaattgcacataggagtactactcagcatttccatagactgaatagtcgtatgttgagattactgtcaccgttattgaaaaaataaatgaagttaccttaaaaaataaacgaaacaataaaaataatttatgaatagtttttcaacctgttagcagtttagaagctaatattgagaaatgtaattgatatacacttaaaaacctcaaaatcaacttaaaattgactttcaaaacttaaatttaccgctgataacaccagaattcaaatatgggtaaaggcatctggatttgaccatctcaaattgtttatcaggattctccctaaacgaagcaggagggaacagcagtgattaatggaacagaagtcatccatccatccactgatccccaccttctctctccccgaagcaatcgaaatcggcgcggtgtgaaaccaaccacgccggtggatccacggcggggcgcgcacccccgccaccgacgattgccggcgacgcgccgaccccgggagggagggagggagggagggagggagaccccgcacctgccgcttgccgctccgctgttcccatcccgctcccacctcggcgcccgcctccccccaccaacatctcctctcccatacttctcgcttccgctccacgcctcactgcctgccgctccaccgatcgctcgctcgcttcccgcgatctcgcctccgagagcagatctggtggcggggcgtcgggccccgtcggccgatggtttccgccgcggcgcaggcgggcgtggtcgccgcgtgcgtcgtgctgttcgtccccatggggctcgccgggtggcacctcagccggaacaaggtgctcttcttctccggggcgctgttcgtctcgctcgccgtcggggtacacctctcgccttacctcccttccctcccgcacctcctcctcgccgcatccttccacccccatcccatct

SEQ ID NO: 22834 - DNA, 2189 bp, Oryza sativa
gggcgcccttcgagagcaacctcacgcggctgctccacgaggatctccgcctcgcgccgcgcacaccggacgtgctcgtcctcggatccggcctctggcacatgctccacgtcacggacgccgctcgctacggcgacgcattggcgtccgtcgtcgatgcggcgaagtcgctccggtcgccgctccccgtgccgccgccgcacatgttctggctcggcctgccgctgctggtgaaccacatgctcaacactgatgccaagaaagtacacatgaacgacaccattctgcaagcctacgaccttgaggtcgagcagagggggctcttgcagcgcgacggtggcccgttcctactgcttgatgtaggaaagctctcccgggggtgtgggcagcaatgcacggctgatggaatgcattatgacggcgatgtgtatgatgcggtcttgcacatcatgctcaatgcattggtgatcgagtcacaacagaggatttgattgattgggttcttgaagcaggtgtgttctcacaccctgttcttttggtccagtataatacaggggtaagtaggaattgttgtgaattaggggtgttcttttgatcgcttcaacattttggtcgcttgccagaatccatagttggattcctcaaccttagaatgtaatttaagggaatcttagaacaacactctttttctccttttctttttgggctaaatggcaagccgagctgttgtgttgtatactgtttctaggtaacaactgaaaatgatgattcgaaaatgtaggagaggaaacattctggaatgctaaaaactagtcatcctttttgtttgcagctggagatattctgtgttacaaacacacaaatgttttctgaatcatgtctattgctgctatgacatgttcagtgtttctttttggtccatgaaaccttcaaatttatggtttgtataagtctaggatgcatataaaatgcaaaattgaaccataactgtactgctatcctttgtcaacatagttctttccaatgggcacaattgcatcacttcatagcaataattatgctgcataaggatagtggttgagtaagttgtagtatctgcacgattctctagctatatataatacttgcatacgggtcatggatgcatcatgtataattgagcacacagttagaaatttacaaatacagcgacataatagtaaagaagattatgccaaaaatgcaaaagttgtttcaatgcattatatgcagtagctctatgctcagtcacattgacactttctgtgcaattggaaccacgactttgtgttagcttcatttagtatttcacactccattgcactccccatgaggtggttttctttacaaacttttaatcaactttagattaaaagttctgaaagatatcctacaaacagggcttatcgttgttcgtttataacactattacagtagtctgtgtttttatttttcacactacaaactagtgcaaataaaacttttatggcctaatggcaatctctccctctgagcatatctgctagctgaactcactttgctcaaccttgcagtaaaggtaatcgatgtttgcctgaacttctaaaggctgattgtttgtcactttgatctgtgtaactttatggtacagtaaatggccccattcatagaaaagaagaatgcaccgtacaccctaaacgaagcagaagggaaccactctttttttttttggtctaaatgacaagcccagctgagtatatcttttctagatcacaactaaaaatggtgattccaaaatgtagctaaggatatattgtggaatgttaagtactagtcatcgttttggcttgcaactggaggtattctctctgttacacacacataaatgttttctgaattatttgtatttctgccatgacatgtttagtgtttctttctggtccacgtaaccttcaagtttcttatttggataagttcgagatggatagaaaatgccagattgaagcttaactgtactactatcctttgtcaacatatttcttaccaatgggcatcttagaacaacactgccttttttatttttctttttgggctaaatggcaagccgagctggtgtgttgtatactgtttctaggcaacaactgaaaacagtgattccaaaatgtcggaaagggaagattatggaatgctaa

SEQ ID NO: 22835 - DNA, 737 bp, Oryza sativa
tgaagaaacaaaataaaaacttgaacagttgaatcagaaagcagaaacaatactttgttcgcccaaaaaattctacgctttcttttcctttttattgagctaccttctagtcttttacatattgcttcccaggttggttcctaggttctccctactgtcgaggagccaaaaagatttacacaccacgtgcttgcttatacacattttggggatataaaccaaaagggggaacactatcctatacagagcaaaaaaaaaaaggactggaaatctatatgtctgtatctgatctcaaaagtctagctatctgcctctgcactttcagctttattttctgcattgccctggccaggttctgctgcttcacccaagtccccttccgtccatcgctgttcaggaacaggcgcttcatttgaagcaactcccgaaccgtcaggctgcgcctggcaatgaggttgttctgcaccttcgagtgttacttcagtactgcccctgtttggtgaacctgacgtgttgctctggtggcatactgcttcgcacaagtcacctgacatccctctctgctcagggataaccggttcctgggaagcagctccagaactgtcaccctgtgcctgacaataaggttgctctacactttcaggccttactcttgtgctgtcatttggtgattctgatgcttctgccttatagctgtctgttttcatctcacactgctgctcggaaacatcttcggg

SEQ ID NO: 22836 - DNA, 388 bp, Oryza sativa
  unsure (1)..(388): unsure at all n locations
ttgtaaaaattctataaaattcctgcgtttcaaacagacttcagataaaacgattttatgctaatacttatgtaatgtaccagtaccgggagtactggagtttgcatacctatcatgcaaacctaccaattgtgtaacgtgccatcccggccggcggcgccctctcgctgccgcccgccgccgctgccggcggcggcggcgcccactctgaccatccggttgcccaccccctcgagccacctcncggcaaccaccccccaccacccccccccccccactccccccccccccctccctcaaccgcacgcctcccccccccccccccccctccccccccccccacccccccccccccccccccccccccccccccccccccccccccccc

SEQ ID NO: 22837 - DNA, 853 bp, Oryza sativa
gtttaggtcctccaactggttcagatgtgtcactccggtcactaaacttagatttgaatatcatttaggtcaaataggatggttaaagactttatatttaaaaataattcataaatttttcataggaactctaaggaaggcaaactttatatcaaacttgtagccctggacgcgatctacaacttggtaccggaatttttttttattgtaagtcattttttgtcccaaaatgtaattttaaaattaaaatttcaaaatctataaacatgcaacaatattttgggaccctaaacagtgtttaattcaagaaaatttcaactacataagttgtagatcgcgtcgagggctacaattttgatacaaagtttgtcttcattagagttcacatgaaaaaattatgaattattttttgatataaagtttttagaccgtcctctttagggactggggtgagacaactgaacaagttgaaggatctaaacgagtgatctgcaagtttagagaccagaatgacacaatcgaataagtttgatgacctacatggtcgatttgcgagtttaggaactgagataacacatcggtacaagtttaaggaccaatgatgtactttacttaacttttaattttggcgtgaactaaacacacccttatcctcgtccctccaatcctttctagcaaggtaaaccctgaagacgagtcgctattccaccgcggatgcgaacggcacaaccgtaacatatctctccattcacacgtgtataagtaagttgcgagtagtaggctacagtagcaagagtactgtacgagtaggacagggacgtgatatctttgtttggatttcgtgggatccgtt

SEQ ID NO: 22838 - DNA, 3325 bp, Oryza sativa
tccctttccccctttttttcgctgcctagggtttgcggcggcggcgcccgctcacctcctcgccggccggacggcgcgaggaggaatctctccacccccacactcctcgcgccggtgcccctccctccccctccatcctcctcgcgtttcgcttcccctcttcgcactactccgactcccagcacggaagcgccggtgtcgatggcggacgatgccggtgccggtcgcactcgcagtcgcagggatccttccgatcgccctacgcgttcaggccaatttctaatcagggctttgctacgaggcgaattggaggagcggtaattttccattctttatttttcttttaaatctcctccatgctctgtcgttgttttttcccttacaatgttgttgtgtaggagtagtttttttttaattggattcataacattataaatttgcatgttttaaaaaataataacattataataattcatataatcgaaacaatgccactaaaactcctatgaaagccaaatgggagcggttgggtaactccgaggcgctcaacggatcttgccgtcgtgccatccaggccccaacaggtgccctcaggctgagatattgaactatatgctacttttagatgtggcaattctagggggagttcctgtgcccagcacctcaaaaatcatattttttagctattccattccttcaacaccccttctggtcctttccagtttccatccctctcatcgcattcctcctgtgtttctagggatctctgtctcagacctttctccaaaaatcaacggtattgtcattcaaaaccctcccaaccgcgtctggtatcctatatcgctctgggcatcttccgcacctaggttgcaagttagaatgtggcaaactatatgattttggtgggggcagatagtttgcatggagcagtgtttcagttccatagttcgttaattcaggcagcttggccagagcagcattcgacaacatcttctcaactctgtcaggaattacaatggatatcgcttagcaaaaggcctctacgcttgccctaaatgtgccaccaacaacccgctctccgccccccccccccaaaaaaaattttttttttcatggagctccctcattaggaacaagaaattatcgcgaggctttactctcctcaccaaccgtccctcctcaagcccatgctcctcctcggagaaaaccgatgcttctgctctgctgctgctcgctactgaccacaaggttaaacactgtagagatccagttgtgtgcaccgcctgtcgttgccctggccaccggcaggacaactgcccctcctttgttgcttcaaactttcctttcgggggatctgcagttgttgcttccacgacctcttcctccgccaacctcttgcctctgactccctcgcctctgcgccttcgccaccacctcgccaccaccgcaacctcgctacccctcttccacccgcttctcggctaagtgggtccgcaaagccaaacaagcacaacagcagtgacggatcccctctgctcccttcccaaaatccatccaatctactgccatgcaaccctccttggctccgtctctctccctaaattccttgctagcctttgcttttgaaaccctaacagatgaggagcttctcaagtttcttgcggtagaagttctggaggtcgctatccgctccaatgtggaccaccatgccgttaacagggaggcaagaaagggaaaggctattgttcatgcatgtgcgcctcctggtggcccctcatccccttcctgggatgtgtttatttcccaaggtacctcgactgctctgtgatcctcatcccttgacattcctctgatctccttttcccctccacaccctgctgctgctgctggaggtattgttcatgctggatctagaggtagcggatctggatctttgaaagaattagaatctggagattctgtttcggatgactccaatgcccccactcatcctagaggaccgggtactccggaaccggtctcgagctaagcggatgccttggggattactaactttgtggatgttttttccccgtactcggatatgagacttggtagtcactatgcttatgctttcatggtcccctcttctcatcccccggctggaaacatttgcagcgcgatgagggaatacctacctgacatgcatttctcccttcatgccttttgtcatggtgctatgatggttcatttcaatttgttgcaagacagagaggttactgctccacgcccaacttcacgtcccccacacatcccatccttaggccttagctatgccgggctgccagcaagggcgtcaacggagcaagcggcagtggacgacgggtccagcgttggcgacacagcatggagggaggagggcgatggacgtgccgttgggtggccagctctatgggcccatcctgctggagttcgggatgcttccggcacgttcctcgctcgattggagttcatctctgcagcgggtggagctcgccgctacagtgggtggctggctttgaccttgggtgttggtcatcgccggcaagctgtcgatcctccacaccggctttatttttctcttttttttcttttcttttgtttttcttttctttccctccgtgtaaattccttttccaggggtgctttcgttcgtatgaaaaaatagtaaacaaaaacacttgataacatggaacaaacgtatggcatggcatggaaccacttttgagagtattgcagtagcatcgatctaattatatgaattataatgttattttttgaaacggtaaaatttataatgacatgaatccaattaacccttttttgttacagttttgcttttgtttcaagctgtagcaactgacacattttctctttcctcgcattctgttgatgaatcacagcactgcagacgcaaggtttatcccacttacaccaataatggaggatctatttgtcaggtatgcttattatcatgtctttcctatatttttcttggctagcttaatgctcgtgtgttgcaacagattctaaaaaacattcattgacataaattaaaatcataaacaatatattacaattgggcataaataatgaaggaaatataaatatagaaataataacatgaaactacaaataactttggccggaataataattcaatatcagaaaaattatataactaaatccccattttttttttcatttagctataaataattcaatacagaggaaaattataagttacaataatttttagtggatcaaatagtgttaaaactaatagagtaaatttcagaaaactgcc

SEQ ID NO: 22839 - DNA, 920 bp, Oryza sativa
  unsure (1)..(920): unsure at all n locations
gctcaagctggggttccagctcatggacgacgccggcctctgcctctacacccaggcggcaacggagaaggtcgacgtcgtcgacgacgtgtcgccggctcttgccagagctcacaacaagaactcgttcagcgtcgcgaggacgtcggggcccaagctttcagcatccgacgcggccatctcgccctccatgagagcctacaagcagctcatcgataggctcagcgtcgacgagcatggagatcctgtgacgtcgctgatccctcggaagctcgccgacgacgaactttccggcgacgtcggcctcccggagtacgaggtggttgacaagggcgtccagaccgtcaaagaggtcgtccactaccatgctcaccgcgacgtgcttaaagagctcgactccattgccgagcanatcgaggccatcgacgcgctgatgaccaacggcggcaaaagtcgccgacgtcgccgaagatagtggatcagaagcagtgcctcgacgcggatgaggagatggtgaccgtggagtttctaccgaagctcgaggtagtcgacgataagggcaggaagctgaagcagcccatgacgccgagaagcgagtcggagaagaaggcggcggcggcggcgccgccggtggtgccggacttggggccgggccttgggacggcggtgcaaacgcgcgacggcggattcttggtgtccatgaacccgttcgacttgcctcttgagaaaggagatgcacccccgaagctcccatgcaggtgtcgaggccgttcgtgctgccgagctccatggccgcgactgggttcgacgtcctccagaagatggcggcggcgggcggcgccgactaggtccgggacaaggtggcgaggctaggcggcatggacaacctcacggggaagacgcccgagcaggtgggcttt

SEQ ID NO: 22840 - DNA, 6966 bp, Oryza sativa
tcgatgcccatgcttctggaagagatcattcgtccaacaacgctgttggaatgcaaacaaaggaagaacctgcatttagcaggaccctttacgtgcagagaagatcagctcaagcaaatgaatgctggccatggaagaaagcctggtatgccgaacgcgcagagtagcgctggtcatacgtccaacgccaaatgagacgattctcgacacccggtgagagctgtacgtgaagcaccgcatcccaaataaggagaaactgggagatgactgggatagtgagggcaccgcggatgtcagagacataggagttgttcgccagaccagaagcaaccgtgcgtgaacctggaagacgctggggaacaacgaagaggagatctggagccaaggacgccaccgagcggccatcgatccattggtcggaccagaagagcatagactcaccatttcccggcacgaagaaagtggatgccgcgaacatgtcggagacggtctgcttgactggggacttcaggccatcccagcaggggtgccctgagcgctgaagccagagccagcgaacacgcagggcaaatcctgccaacctgaggtcagggatccccaacccaccgcaagttttgggacgacagacgttcgtctaggacacccgacactgcccccatgagccgagtccatacccgtccacaagaaagcacgacgtttcttgtcaatggccttaataacccagactggaaggccgatcaccatagatacatggatcggaatggaggagagaaccgactggaccagcatagaacggccagctagagtggtaagtcgtcccttccaaggcggaagtcgatgggagactttatccacaagcgtttgcaaaggctggcttcggcaacttgcaaacggacaacggaatgccgaggtaggtgcaagggaaattagaaaccgagcaggggaagtagaactgaaccagctctaggttctcagccgagcaacggatcagagtaatcgagcatttggctcttgactaggtttattaatttttactagagaattaaaggttcaaaatgtaatgttatcctcaccgttgtaggtaactgtatcgatcggtgacgtttgtgtttgaatggaactcctagctccagtggctcatccatttcacagttatttcgtgctcacttattaacgattattcgaagttaacatcaatttattcagtcctatgttctcgtggttcgtccatgcaaaccaatcatctgcagctactgtccctatataaacctagctagtactcatcaacttcgatcacaatcaagcatcaattcctcattagcatcgctggttgatactaaactaacagtagccataatcatgggaaggccagtggcaacgctgctggtgctgtgcttcatctctgtcacggcgcgcgccgccgcgttccgcgtgcacggccgcctcctcgccgacgccgcgacggagggaggcgccgtcgtgcccatccactggacccaggcaatgaactacgtcgcgaacttcaccatcggcacgccgccgcagccggcgtcggcggtcatcgacctcgccggggagctcgtctggacgcagtgcaagcagtgcagccgctgcttcgagcaggacacgcccctgttcgacccgaccgcgtcgaacacctaccgggcggagccgtgcggcaccccgctctgcgagtccatcccgagcgacagccgcaactgctccggcaacgtgtgcgcgtaccaggcgtccaccaatgccggggacaccggcggcaaggtcggcaccgacaccttcgccgtcgggacggccaaggcgagcctcgcgttcgggtgcgtcgtggcgagcgacatcgacaccatgggcgggccttccgggatcgtcgggctagggaggacgccgtggtcgctcgtcacccagacgggcgtcgccgcgttctcctactgcctggcgccgcacgacgccgggaggaacagcgcgctgttcctcggctcctccgcgaagctcgccggcggcggcaaggccgcctcgacgccgttcgtcaacatctccggcaacggcaatgacctgagcaactactacaaggtccaactcgaagggctgaaagccggcgacgcgatgatcccgctgccgccgagcggcagcaccgtcctgctcgacaccttctcgccgatcagcttcctcgtcgacggcgcctaccaggccgtcaagaaggcggtgacggccgccgtcggcgcaccgccgatggcgacgccggtggagccgttcgacctctgcttcccgaaatcgggggcgagcggcgcggcgccggacctcgtgttcacgttccggggcggcgccgccatgacggtgccggcgacgaactacctgctcgactacaagaacggcacggtgtgcctcgccatgctgagctcggcgcggctgaactcgacgacggagctgagcttgctgggaagcttgcagcaggagaacatccatttcctcttcgacctcgacaaggagacgctctccttcgagcctgcagactgcactaaactctcctagctaatcaatggctgctgtgctgctacttaattactttcaggaagcaggagagtgcaggctatatgtatgtgtacttctgaataacgcagccatatatgcggcatgagctgcacgctgctcatgttggtgaaaataatacccccattcttattattctgtggcgatatattctggactacttcgatttcaatctctgttccatgtttaatactttaatggttcatcaaccactgtaggaattaggatgctctcctacagtttttctttcaaaaaaaaatgtggttcatcaaccaagtttcgtcttacagcttcagaaacaaactgcatgcctcttcagttatcttagcaaaacacagagaaattaaatcagaccggtagcttcgagtcgatcaattgttgggaggcattgctaagaaatctaattagtcaatagtcatggattacgagttacgacgactgactaatataccaaattaatcaccaaatatgacaagtggaactctgaaacagcaacatttatgcttaatccaccttgcatttctggatcacgtgctggagacgactttttccaccagaagccgcttcacacgtaccaccacactcgcactaacaaatcaaatattcgctccattaaaaaataaacaaatgtcgcataaaatgtgagaaattctgataatacgaatctggatagattcttaattactataaatttaaacagaccaaatttataataatgctattatgtatcacatcttgtactacgtttatttattttaaaatgaatggggtagtagatgaagtagactagaccaagcatgaagccagcaaatcagggtaaatgtggtaaggaaaatagatcctctaacttgctattctctaactttaaatgactaatatatccacagctcatgtgtgtccaggctgcccttatcctttctttttgggcgcgtaaccgccgaaaaccacataaaattcacctcgaaaaataggacatttttcatttaacttgtttcaataatatttataataagcttttgtcaaatctaaaaccttttgaacggaacattctcattttatctttacgatactttttttacaattgcacagtacaacgcagacactcacaacgcacgcaaaccctacccttatgagcatcttcgaagactaggccggcaaatccatcctagagattgatgaagtcaccacaagcgcctcgctgtcaacagcaatccatccttgagattgacgaagtcaccacatgtcacgccccgaactagtaccgaccggaactagcccgtgacgctccaaattaacctgttaatcgataccagtcccaggaaacagtgctggtaccacaggaagacggattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcagcaagccatgggaaataagtgtttaatgcaggcttcaaggaaaggctgttgtttttacaattgattttattcgaactcttttctaaaaacaactaagtgagtgcttctcaaacgacacggatgagacagtgcgtctcgtccggtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccataacagcaatctcacaaggcaatagtcaaacaaaactacgctaggaatcacctcacatccgcccatgaccgtgggcacggctgttcgaacagtttgttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcggaaaaccgtacacccggtacgtcccccggtccgcggttttggaaattcatttagttcgcaagcaccgacccaggtgtcgggttttccaagtcttttgtaaaacccgagttttacccaagaagttttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacagcagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaaaataaagccctattaatgacctctatgtatgccattagatagatctcgagatttgaggaattttggaagttgaacggagtcaaacggatttacggttgggaagatattgaatttctaagattattggatttttggtctaaaagaaaaggatttaattaaatcctttttgaaaaagaaaacaaaagaaaggaaagagggagggaatatagacttttctcgggcggctagggcgcggcccaagagaatttggggcggtccggccgagctaaatgggccggccggcccaaggcggcccaagacgcgcgcgcgcgggagggaggagagagagagccggtggaccgggcttaccacgcgcggtcccgggtgggacccgcttgtcggtgacacggctcaccgtgtggagcgagcacgcggcgtacgcgcgcgggcgggggagggacgcggtgcacgcgcgcggttcgcggaggaacggttgcggtgggcccacgcgcagcctcacggctcgtggtggaacgcgcgcacgggaggggctgaccggggtcggcccgacccgatctcggccgagctggcgccgacgtggcgtctacgtggcgcctacgtggctgccacgcgggccggcgggaggaagacgaaggcgccggccgcgaatggacggcgggcggcggcggtttctccggggcgccttgcgacgatgaggggcgacggggcgtacaccgggatgacgaggaagaaagagacggagcgagccaacggcttggattcgccggagggagtccgtcggcggcggatttcggcggcggcaaccggcggagagcaaaagggggaaacggcgacgaggtcacgaggggccaattcccggcggtgagaacatctacgcggctacgggaatccgttgctagcgtcggattgggcggagctacgccgagcgaggccggcgacgagcgggtgctacggagcacgggcggcgacggcggcgagcacactgcgagcggcggcaacggtcggggcggcgccggctagctacggggaggctactcgagctactaccgaaaactaagggggggagatggagcgaggagggagaacggagggaggcactaccgagatgaggaggggcgctgtgacgagaggccgacggcgcgggagtaatctctccggcctcgggtcggggaagaggaggaagacgagcgcccggagtccccttccgcgtccacgaacgcaccggatttcccgacgcttggcgatgaacggcggaggcgagacagagctcggaaggcggcgacaatggcgatgggagggagaagagagggagggcgcccggggctttaagggcggcaatgtcggtttggaaccgacttgggcggtcaaggcgcgagctggcgctcggcgctcgcgtccaatcggcgacagggcggagggaggatgacgccggcgggaggaagaaggggaaaaggagggagagaaagggggctcgtccctttcttctttgggaaaaaggaggggagcgggggcgtcgcggca

SEQ ID NO: 22841 - DNA, 9397 bp, Oryza sativa
ttttgtctttgcaatactaatccaatatgtctaatacaatggcatgataagaagccgttgatatatctatcacccgccgcaatacggtaaatattaaaagctatagcctagccatggtcaaaggtacggttggcgacatggctgaaaggtttatttaagaaaaaaaattctaaagctatatacagtttttactatagaacggtttaaaccgaagaaaacattatccattcggatgtaacaacatcagtgatgtctgaatgatacttatatgtataattaaacctttatagtctgaatgacaccggtattttttagagaagaatgacaccaatatggtgcagttgttgtcaatggcttttgagatagaatgtcctagctacagggtcgaggcgtgacctatacgaacaggtggtcagaaatgttaaagaaaacttctgctacgtagccaaccaaaagttgccatgttgcgcgttcaacacatattctatagagatccatgtgacgactacgtacatgatagggtttaccatccgatgtaatccggacttccctaaccaggtcgaaaacacaaattgctagtttttttttgttaattaaaaaatcaaactgaattttaaattttcagaagctagatttatccatgttttttgtttttatcgatttatcaatggttactgtaaaatccaaagacaccgctcatgaacggtttttattctcactatcagaattgtgaacccaaccttgctccatgaaggctcaagtggttcattcaatttcactgtcatttcgtgcccactaatcctcgacgagtctctctcgcgtaccaattaaacgatgaggcgttgacatccgttgctttgtttttattttcagttattcagttactacgtacaacattacagtgttaataattaacccatcttaattactcctggtttagtgcatgcagccaatcatgtgcagctacgcttcctatataaaccctacctctcgacttcgataccatgcatattaccatactcattagctcgagacagtaattaatcatcatcataatatataatgggaaggctagttgtaacagtactgttcgtgttgtgctcgatctctctgacgacgacgtgcgccgcggcgcttcgcgggcacgatctccggcgagccatgcgcggccgcctcctcgccgacggcggcggcgcggtcgtgccgctccactggtcccgcgagctctacaacgtggcgagcttcaccatcggcacgccgccgcagcccgcgtcggcgttcatcgacgtcggcgggctgctcgtctggacgcagtgctcgcagtgcagcagcagcagctgcttcaaccaggagctcccgccgttcgacccgaccaagtcgtccacctaccggccggagccgtgcggcaccgccctctgcgagttcttcccggcgagcatccgcaactgctccggcgacgtgtgcgcctacgaggcgagcacccagctgttcgagcacacctccgggaagatcggcaccgacgccgtcgccatcggcacggccacggcggcgagcgtcgccttcgggtgcgtcatggcgagcgacatcaagctcatggacggcggcccttccggattcgtcgggctagcgaggacgccgctgtctctcgtcgcgcagatgaacgtcaccgcgttctcgcactgcctggcgccgcacgacggcggcggcgggaagaacagccggctgttcctcggcgccgccgcgaagcttgccggcggcggcaagagcgccgccatgacgacgccgttcgtcaagagctctcccgacgacatcaagagcctctattacctgatcaatttggaagggataaaagccggcgacgaggcgatcatcacggtgccccagagcggccgcaccgtcctacttcagaccttctcgccggtcagcttcctggtcgacggcgtgtaccaggacctcaagaaggcggtgacggccgccgtcggcgggccgacggcgacgccgccggagcaattccaatctatattcgacctttgcttcaagagaggaggggtcagcggagccccggacgtcgtgctcacgttccagggcgccgccgcgttgacggtgccgccgacgaactatctgctcgacgtcggggacgacacggtgtgcgtggcgatcgcgagctcggcgaggctgaactcgacggaggtggcagggatgagcatcctgggaggcttgcagcagcagaacgtccacttcctctacgacctggagaaggagacgctctccttcgaagctgcagactgcagctcactgtctcctaattaattcatggcaatggccgctgctgctgcttccttcaggaagcagttcttgcttagatttgcaggtgtgcatacttatattgtcagaataacacaaccaggcggcatgctttgcttctcaacttcagtagcatcgtgctcttccgcttacgtgcttgtatcctaatctgattttatgtcagatttatgctaggtagtctaaataatattcggtggtgatttttttttcgaaatccaatctttattccatgtcttactccctccgtcatgaaaaaaaacgaatctagtactggatataacatattatagtacaacgaatatagacatattctaatactgtatgtccagattcgtagtactagaatgtgtcatattcggtattgtattaggttggttttttatgcgacagagggagagggagtatggtttattaacagtatttgatctttgtgactctgtccaacacggctgtctatgtcagcaggtattgtacgacatgtaccaactcagcaagttttatacaattataaatattagcaagttttatacaaataaaacatatgccataccagtagagtgcagagagataagtatttgaacttcagtcaaaatgcatatataaacatactgcctctggttttttaatggacgttgatttttaaatatttaaccatttgttttatttagaaaaagtgtaatatgctaaaatacaagtcatgtttaaattttttaatgttaaaatatgtgtcaccaaaataaataatatttatataaattttttgaagaggacagatggttactcactccgtccataaatataaggtgttatgtctaaaatagcacaaattaagaaagagtaactagtactagtacgtctatgtagcttgaaaataagtatttcatccgtcctatattagttgccgtggttatttagtatatgttaaggtttgagaaaaaagactttagtacccctcattaaattttgtatgtttagatgtaggagggtggttgagagtaaaaagaaataaatttgaattaaaagtgattgatgagacaagtagtattccattgtgacaagtattttgggacaaagtttgaattctaaagagacaagtaatttgggacggaaggagtacattattgacacaataaacaaagtagtactccctccgtttcagcatttcccacattcatattgatgttaatgaatctagataacatcaatatgtatgtgggaaatgctagaatgacttacattgtgaaacggaggaagtagtacactagtactagtacgttctcagtagtacgccatccgtcccaaaatgtaagtacttttggactccgatacgatttccaaattgctactttaaccaacattatccacaaaaataaaacattttgaataaaaagagttgtatattattatagtttgtttaaggataaatctagtaacatcaattttacatgatttatcttttttattattttgctattaatagtcaaagttaaaaatgtttgacttgttactattctaaaactacttatattttaaaacggagggagtatcttttttttcctttttgaaatggaccgtgcgaagtagtacgagtgctagacattctttgtatttctttagttctgataaattagcatcacataggttaatcatggattaattaggcttaatagattcatctcgtgaattagtccagggttatggaatgggttttgtcattagtctacgtttaatacttctaattagtgttctaatatcagatgtgacagggactaaaatttagtccatgatctaaggctgtgtttagatccaaagtttggatccaaacttcagtccttttcaatcacatcaacctgtcatacacataacttttcagtcacatcatatccaatttcaaccaaaatccaaactttgcgctgaacaaaacacagcctaaatagggcctgagtgatggatggtggaggctgacaggctgtgcttgcttgcttcgggaggagacaaatccactattgccctggacatacccagggaataaaatccctcgtagtacttctggacagagggagtaaatgtcataagtaaagagtcaacaatattatgtacttaaaaaaaagagtaattaattacatacagttactgagttaagcttgggctgtgtaagtccggtttggagcatatattctgctcaaccacagttccaaagttaaaacctcccccagtttgtaattgtagctactagtttgtcatattccaaatattcctatggagcaattgccattatgcaggctggtcatgacatatctaacctgctccattacagacgaaggtataggttacatttcgacaacatcccattcttaatgttctgcccaaatagagaaataattctggtagtatgttattatgtgaatagatagaaatacgttcacattgccatttcattcagtgcccactatagatcacgagttcacgactttaacagagatgcaaaccatttttattattaaaaaataatcttgcatgcgtctctatctcacttcaacaaaatgtccgacacaatgaggcgttgacatcagttttattcagttacggttggtgtcgaactgtcaatatcttaattaatttctcccggttatgctgatgcacgcacacccaatccgctgcgctgcatccctgcagcatcgatctaattttccctatataaaccatagctgcacatctcttcgatcaaaatcacgatcaaactcatccttgcgctcttgaaacagcagttaaaatcacgatcattagctcgctgattgataactaacagtggtcataatcatgggaaggctagtgacaacactgctcgtgctgtgcttgatctacgtgacgacatgttcgctctcgacgcgcacggcggcgttccgcgcgcacgacctccggcgaggtctagagcaagccatgcgcggccgcctcctcgccgacgcgacgccggcaggaggctcggccgtgcccatccactggtccagacacctctacaacgtggcgaacttcaccatcggcacgccgccgcagcccgcgtcggcgatcatcgacgtcgccggtgagctcgtctggacgcagtgctcgatgtgcagccgctgcttcaagcaggacctgcccctgttcgtcccgaacgcgtcgtccaccttccggccggagccgtgcggcaccgacgcctgcaagtccatcccgacgagcaactgctccagcaacatgtgcacctacgagggcaccatcaacagcaagctgggtgggcacaccttgggcatagtcgccaccgaaacgttcgccatcgggacggccacggcgagcctcgccttcgggtgcgtcgtggcgagcgacatcgacaccatggacgggacttcgggtttcatcgggctagggaggacgccacggtcgctcgtcgcgcagatgaagctcaccaagttctcgtactgcctctcgccacgcggcaccgggaagagcagccggctgttcctcggctcctccgccaaactggccggcggcgagagcacctcgacggcgccgttcatcaagacctcgcccgacgatgacagccaccactactacctgctcagcctggacgccattagagccggcaacacgacgatcgccacggctcagagcggcggcatcctcgtgatgcacaccgtctcgccgttcagcctcctggtcgacagcgcgtacagggccttcaagaaggcggtgacggaggccgtcggcggcgcggccgcgccgccgatggcgacgccgccgcagccgttcgacctctgcttcaagaaggcggcggggttcagccgcgccaccgccccggacctggtgttcacgttccagggcgccgccgcgttgacggtgccgccggcgaagtacctgatcgacgtcggcgaggagaaggacacggcgtgtgcggcgatcctgagcatggcgcggctgaacaggacggggttggagggggtgagcgtcctgggaagcttgcagcaggagaacgtccacttcctctacgatctcaagaaggagacgctctccttcgaacctgcggattgcagctcactcccctgatcgatcaatggcggctactgctgcttcttgctggaagctttgctgttcaagcttaattccattccatgtttgtgttgtgtgcgcgtgtgtgtggctgtgtgcaggtgtgcaatgttcatagataagataacgcagccatggcgcgcgcccaggcggcatgagctgcagcatgctttgctttactctccagtgtgggtagcgtagctagttctacttcctgaatctataggctatacgtgcttgtgtaagaacgagatcctcttgtcgaactccattcatccttaaggaaatatccctcgtttttgcatggtgtttcaattattagcaactttttctaaaagaaaaatagtaagatagatcaatatgtgatatataactccaaattcaacttatatatatagaaacaaagataatttggctcacctgattcgggatataggtgcgcagaggcgaactcaaaacaaaaattatcgggggtccaatacgtactaattatcttttttttacttatatactagttatcatcatataatttagttagaattgaatagtttacccggggttcgaggacaccaggaaaatgtacctaggatcgccactgggtgcgctgaaaatgagaggttgtcatttttaacaacatgtataaaatgagagtatgtccttccacttttgatcctctgcagtatgtagtactgcaatccacatgtgagctctacttgctcaaagtcccacatgtcactggctcctattacaagagcaattatatagaggagttgagttcgcttgtgtccagattgatatatcagtcttatgttaatttaaatattattcagttgtgatgtgtgggctttgatttcaaaattgaatcttcgttccatgtctaatggtttatgaatactcttgcgttacatcttcccaacactgttggcctttgtcagcatagatcgttctacctgtgccaactgaacacaagtcaggaaaaattgtcatgaagtctcatgactctcactctcatgtgcacaagccatcaacttcaaactttcagagtcaataggtaaataaacatacagctactctcagacgataccttttgcttcaactcgaagtttgccggcagtgatctgcagaacattccgacgctgatttcgggaagtctgttttcaggtttgaggatataggattaataacggttatacagattttgggtaactgtttatttctgtctttaggttggtttccatcaattccattataaataatgtatataaacatatgctaaacagattgctcattcagttatcctgttcaaatagtactaaaataattaaatcattttccccaattcgtatatgctactattagtttctcttattcctatggagcaatcgtcatgatgtagattggtcatgatatggcaaacctgctccactatagatgaagtctaatatttactccctcgctccaaaataaattaacctacacatcacagtgctacgaatctgcgtggcgaagacaaaaggaaacttagctgcaaagttgccgcgttgctgaacacaataattccacgtgaaggctcaagtcaatcatccatttcattgtcatttcatttttgcccactagatatgaacatctcccatccctagtgtggcagaagccagagttgtagacactgtttccatgcattatcttcgttttaaaagaagaagatctcgctgtctctatctcatacggagtataccaaaatgtccaaaacgattaggcgctgacatcaatttatctagctacgttacagtgtcaaactgtcaacatcttaattactcctggttatgcttatgcatgcaccaatcagctgcatctactgtccttatatctctactattataaaaattaaaaatatttttgccggcgctttgatatatcatctgtgtatgagtcggttttcaaattcgttcacttttgaaaatacatatccgtatttgagtcgtttattaagttcgtttgcttatggaaatatagaagagtcgtataagaaatctctttaaaaaatctcgcatgctaacttgagatgatttgactctaattacaactcataattttaagtgaattctcacagtaaattttaccttaattaaaccgtataacaataataagattaaaataactttcacccgttgttacgcatatgtatttttctagttaaaaaaacgagatttgaaggaagggatgttctctgtccccatataaacccaagttacccctcgacttcgatcactaatccttcctctcgaaagttgaagcatgcatcagtcataatcagttaatcacgacaattagctcgctgattgataattaaccgtaattataatcatggcaagtctagtctcaacgctgctgttgatgtgcttgatccctctgacgcgcgcgcacgaactccggcgaggtctggagctcgccgacgacgcgacgacggcgcggccaggaggcgtgaccgtgcccgtccacttctcgcaagcgttctacgtggtgaacctcaccatcggcacgccgccgcagcccgtgtcggcgatcatcgacatcggcggggagctcgtctggacgcagtgcgcgcagcactgccgccgctgcttcaagcaggacctgcccctgttcgacacgaacgcgtcgtccacgttccggccggagccgtgcggcgccgccgtgtgcgagtccatcccgacgcgcagctgcgccggggacggcggcggcgcgtgcgggtacgaggcgtccacctcgttcgggcgcaccgtcgggaggatcggcaccgacgccgtcgccatcgggacggcggccacggcgaggctcgccttcgggtgcgccgtggcgagcgagatggacaccatgtggggatcctccgggtccgtcgggctagggaggacgaacctgtcgctcgccgcgcagatgaacgccacggcgttctcctactgccgggcgccgcccgacaccgggaacagca

SEQ ID NO: 22842 - DNA, 2667 bp, Oryza sativa
tatatatatatatatatatatatatatatatacctcatatggggcaccatggtatcaaatgcaaaaaatcactcaaattttttaaaattttcaaattatgagtatatacctagttataataattcgattcatacctatacctatcaacaaaacaactcaaatttaactttatttcacaatccatgattacatacctaactaaatatatgtatggatgctatatacctagaatcaaaatctaacaaaaacaagttcaaattcagttcaaacttgctttgaactagttagtaaagtggttaatgttaatacctaagtaattgaaaaagattcatactcatttgaattgggtatatactcaatttcaacaatggtgcccgggcaccatggagcaccaaacaaatttactatatttcaccgtatattttcccaagtaacgcagctagctaggcagcatgtgtgtgctgcgacatgctttgctttgctctccgagtgtcaacgcattttccttcgtgaacctgcgtgcttgtatcctagggtgatatgtcagttctatgttagtgcaacaaataatatatttagtcgtgatctggacttgatttaattccatcgatcattcacttgatcatttcacttgatcaagtgaattcacttgatcatttccatatgtaatatgttttatctccttcctcttattagtgatggtaaaattaattgctctattaacatatggttacaactttagaagcagattgctcattcagttatcctgctaaaccacagttccaaaattaaatcattttctccagctcgcagctagtattggtaagaggtgaaaatggtgcgaatattttccaaccacccgcccgactcgaagctagcgagaggaatatggaagaaaaaatagaatatccgatactatccaagttcgaatccaaatccgttagaaagtatgggttaggatacggaaagacatgtatccgcccgtatgttctataatataaaatatgtatgaaaatctattataaatgtacctataaacatgataaaagattgttaatccctattttacgagatctcacatgtaatattatatattttttctcttgatgtatctcttttaatactttaattaatttattatatttaatatttatgaattagatatataaatagatatccgtttccgaatccggttcgaaggaaataatagataagcgatatgttatacggtaatacccgtactcggctccgaacttaaaaaaaataggttaggatatgggaatgtcataacccgaccgtacccgtccgttttcacatactagtttctcctgttcctatgggagcaatcttcattatgcaggctgctcatgagatggcaaacctgctccattatagattaaggtatgcgttacactttgaatatagcccattctgctcctgattggaatttgtattttgtaatcttgccttgataaagtccttggtgtgaaattatgctatctttagcttatttttactttactgacgcagattccacatgcacaatgataggtgggaaatacatgggagcaaattaagatggtattttgatgttcttcaaaagagaagggtaggtggggagtgaggagagataggtgtgtgggttagggtttatagatgcaacttttcagttaaaaaattaacagatgtttcacacattttcagttaactgatgaatatctagtcccaactttataagtcgtttggtgtaaattatacaatatcacaactctttgtatattatgacaacaacactctctcaccccctaacacaatggcttggcaacaaccatggcatgtcaagaagccgctattacttttagaaacatagtactaacgcatatgctatgctcttttacacgcgcttgcgttcatccttacgaacgaacacacgtacactctatacatatgagaactcctgatatgcaatttcggtaatttcgaaccccaccagcaaggcaatatctcagccaaaattttttgtatttctctctttttttgtgtgaatttgatcaaaatttattcaggtttagtcaaattatgttaaaatttcatataattttggtgcgaaaatcccaaaattttagaaattttggtgctaccgaaattttgaggaaaatcaaaactaaaactttagatacgctgaaccgatatatcttaagatggtaagtgtcacaccctgaagttcttctcccaagcctaaattaattaataaatggcctcgagaaattacctgtgtaaaagcaagagagaaaccctaattaaattaatgaaaataatcatcggaaatggcatgcggaattttccttgagttctccatgtcaaaatatgctaacaagatttttagtggaattttcagagctctaaaaataattttaaccaattaaaaatgagcacaagcattatttaaatccctggaaattctttttcccctcccttctcctaatgggccgccggcccattctttctcccttcccctccccgctgggccggccgaaggccacggcccagctgagccgcgcacctcctctctctcccggggtcgccgacaggtagggcccacctgtcgggcccgtccccaacctccagccggaggaggaggttggcctccccaaccactgcccccgc

SEQ ID NO: 22843 - DNA, 3116 bp, Oryza sativa
gccgccgctctccactgccagccgctcgccaccgctgcgccggtgccgcgccgctgcgcgccatggccgccgggccggcttgagccaagcccgtgcgcaccggccgcgcgcacccgccgccgttcgatctacccgagggtagatcggggccgtccgcctcgccgcccacgtggctgccgcgtggccgccacgtcggcgccacgtggtagaccctcctccctggtcccgtgggtttggtccaccatgagccggcaccccgagccactgccatgtggggcccgcatgtcggcgccgcccctctctctccagggttaatttttgcgcaataaatcatttaagggttttctgtttatagtaaaaacacagtgaatcttctaaaattcatagaaaattcatctgtgctccgtttaagcccattcaagtctcagtaaatcaagaaaaatgcaaataacccattaaaatggttttgttctctgtttctgtagtctcatagcctgtttgtattgtttactttgtatgtcgtttagattccggctctcccgatgctccggtgtactttgagatagtcgccgaggttccaccagcagcagagtaaggcaagtcatgcttgtcacttgaacatgttgatcctatattgcaaatgctctatcgttttcctttaaatactgcattgtttttcaatgttaccatgggatatttatctactgtctcagccatgttatttattacctcgttcctttgttatcttggggttataacatgattagacgttggattaggaattgcttagccatgcttagctcaactagcacacaatggaggaatcacattaatgcatagacttcaggttctagtattgttgttggtttagtgccaccactctggtgatggttaattaaaatatattaaatggtgggctgtgggtgcatggtattgatggtcgcatccatggcagttaaggaccgattcgcgggaaaccctggaagaattcctcgtacttaccacaagccagcgtgggcaacggctgggcttgtagtgtagctttcctctagctgacgcatccaggcaagggtgagcgtgatggagttcggatgggccctgcgacggcctatgcggctttcggattcacctaagcacgagaggggactgcccactgccttgcgaggagtgggggtgaaacctgaggtgtggtgtgtttggttagagggggttatgcgaagggtcctgtcacggcctctttccggtatgtcatggtggcatgttggcgcacgggaacgtgtcgtggggttgtgtcttgtgggtacagttgtacacctttgatcagagtaaaactattcgaatagccgtgcccgcagttataggcggtcaaccagattcaccgtgattagtctcaccctaatttagtctgatggaattgattagttcaggtggatggttgggcctgttgcaacgtggtgtagcgttggacagtggatggttaatattgattaattattacaaatgttttactgccttcaactactgtttataaatgccgctttgtgcaaatgaaccactctagctatcatttggttatatcctgcatcataccctccgttccggtatgacttgctgagtacaatgggtagtactcagttttgctctacttttccccaaccccagagtttgagtatgcgtcagatggtggctattccgaggagtaggcttcgtccgtgccgttgaggatgcctgtggagtggtgttcccgctgcaatccaagtcaaggcttagctccagttatcttttatatttccgctgcatttatgtaagacttttataatgtttgtaagacgtggatctgtatgtcaactttgttgtttgtttaccctggctgatcctggacagggattttaatgcacattctgcttggaattctattcggaaatttatgggcgcgacagtaattaagtcaccatgactaccttcgttattgaatggggtatcgcctattacatttactacctgcataaggtagaaaaccgttgctacactactgtcaaacaccatggcctgcgacgtggctaaaaggtttagttagaaagaaaaagtatattagaggttataaatttctattaagaacgtacctaagacagcttcacctatggagccaacccaaagtagccacgttgctgacgactcaagtcaagtggatcatcaattccactgtataatttcttcattcaattcgacgaacacacgtctctatcttgcatataccgagaggtccaaaacgatgaggcgttgacatcatcagttaatgacttaattcggtcacattatatatagtgtcaacatcttgcactagcacataaacaattttttgagatggtcacgaaaatcaaattttcacgtacgaacgcttaagccggccgtctacgacaataaaaaatcaaaccccaccccaaaaccctagatccgccgccatctggtcgccgttgtcactcgaaaccctagcctgctgcttccgcccaagttatcgtcgttgaggtcgttgtcgttgcgggggagggcggctgtcgccggatcggcgcgggggagagccgtcgccggatccgtgcggggaatggtcgccgcccacccgagccctccatcactggagcttgcgccggattcgtgcgggagagcatgggggagggtggagggggccgctgtgcgccatcacctacgcccgccgctagtacccgttgttggtagggaggagatgggagaggaggagcgggagtgggaatggggagagagaggaagggagaatataaaaagagttgtaagaggagggattttcgcatatgggtcacttaagtaactgtattaaaaatggggtcgattttttagatgcggaccccttctaaaccgcttgcaacctatggaggtgctcgtccagaaaaaataagtgttaattagtttgtcctggttatgcatgcagccaatcagctgcatcaattgtccctatataagcctaccttacctctcgacatcgatcataatcacgaacactaatcagccttcctcttgaaacagcaattataatcacgatcattagctcgctgattgataactaacagtggtcctaatcatgg

SEQ ID NO: 22844 - DNA, 2423 bp, Oryza sativa
atgagccaatattacccgatacaattggacgggataaaagccggcgacgcggcaatcgcgctgccgccgagcggcaacaccgtccttgtccagaccttggcgccgatgagcttcctggtggacagtgcgtaccaggccctcaagaaggaggtgacgaaggccgtcggcgctgcgccgacggcgacgccgttgcagcctttcgacctttgcttcccgaaggcggggctcagcaacgccagcgcgccggacctggtgttcacgttccagcagggcgccgccgcgttgacggttccgccgccgaagtacctgatcgacgtcggcgaggagaagggcacggtgtgcatggcgatcctgagcacgtcgtggctgaacacgacggcgttggacgagaacctcaacatcctgggtagcttgcagcaggagaacacgcacttcctcttggatctggagaagaagacgctctccttcgaacctgcagactgcagctcacttatctcctaatcgatggcttcttgatggaagctgttcttgccttagcagcttagctagctttgctattcaagcttccatatttgtgtcattgtgtgtgtgtgtgtgtgcaagtgtgcgtgttcatagataacgcagccaggcgcccaggtggcatgagctgcagcatacttttctttgctctccagtgtgggtagcgtcgatctaccattttctacttcctgaatctatagtataggctatacgtgcttgtgttggaacgagatcctctgtaatactgagactgacatgtggccccagttacgcaaggcccacatgtcagctgcttctattacaggggaaactattttgatccctcgagaagatgtccactcattatttgcatgccactaaatggttacgaaagaatttgaaaaaatttaagaagatgtattaacatatgatataacactaaaatatgtaagttcaaattcaacttctacatcttgtaacgaaaaaaacagtatataaacaatcagtattacagcttcttaaacagattgctcattcagttatctgctcaaacagttccaaaattattaaatcatttccctctatttgtatctgctattagtttctcttgttcctatggagcaatcgacaatcgtcattatactggctggtcatgagatggcaaacctgctccactatacatgaaggtataagttaatactatagccacagtattctcctcctaattggaatctactccgtaaacttgccttcatagactccatgatgtgaagttctgttctcttttgcttattttactttactacgccgattccacatgcacaaggataggtgggaaatagtgagtggattctatactctcgatggaacatcctctcgttatttgtatgtcatctaaatggttataaaaaaatctgaaaaaattcaacaagatatattaatatatgataaatcattccacacaaacattcaagttaaaatttaacttctgcatgttgcaacgaaaaacacaattaaatttgttttttttttgcaacttgtataagttcaacttgaccttacatgttcataaagtaagttatcacatattaatctatcttgttgaatatttttaaattcttttcataaccgtttggatgacatgcaagctcgagagtttttgtttcccgtgggaaatacactagagcaaagatggtgttttgatgttcttcaaggaaagaaatatacttcagttttcggtgtcctggggccaccagaattaggacttacaaaataaaataggagaaaagtcaattcgtaagcattgcatgcaccaaaccttttcatagcagctccaacttctaaatctaactttaggagtggagtttggcgtggagctatagagcggcccaacctgttccccccctctaattcttttttttttcgatcacttaagcttgctctgctccttttttaagacgatgtttaaattgtttggttgtcatctagcttcaaaagagatgaatcgggcatttaactttttgctactttataatcacgatcattagctcgatgattgatagctgacagtggccataaccatgggaaggctagtgacaacagtgctcgtgctgtgcttgatctatgtgacgacgcgcatggcggtgttccgcgggcacgacctccggcgaggtctagagcaagccatgcgcagccgcctcctcgccgacgcgacgccggcaggaggctcggccgtgcccatccactggtccagacacctctacaacgtggcgaacttcactatcggcacgccgccgcagcccgcgtcggcgatcatcgacgtcgccggtgagctcgtctggacgcagtgctcgccgtgcagccgctgcttcaagcaggaactgcccctgttaatcccgaacgcgtagtccaccttccggccg

SEQ ID NO: 22845 - DNA, 5944 bp, Oryza sativa
gttgaattacggcgccaaccactctggcgccccaaaaaggaccatttctgggataagttttttcaggggtctatttgcgaaataagttttttaaaaggaccaaaatgtgaaaaatccagcaaaagagagtgcaatagggtatcttatgaacttgctcagtttgctaaacggacggcacattacgcggtttggcgcgatcatgccccgtcctgtgttaagcatgtactgcaataagagtgtaatcctattacttaatcaataaagctatatgttcccgcaaaaaaaaaagagactcaaatgaataaggtactcattttgcaacataccgattcgatcgtcaaatccgcgccgctgcgccatctactcaccctcgacctgtcatcctccgccaccttcttcgactgcccagaggtagatctacagtagaagggagggtcggtgtcagatgatactgacaactttcgataaaatttatacgaaactgattatccctatattataatactataatctaaacataattaacatactatgaccattgataaacacgtttatatatgacagcagcaaatcgattttatcccccgcaccttttgccgctctttctccatgaccgatccgtcgttccggcgctaagcacatgcatctccccgtcttcctggacgacccccgccgcctcctctcctcctccgccgccgcctccgcctccgcccggaccctcgcccgcctccacgccctcctcatcgtctcctcctccgcctcccacaccctcatctcctcgctcgccgccgcctacgcccgcgctggcgacctcgccgccgcggagtccaccctcaccgcaaccgccgcctcatcctccatcgccgcgtggaacgccatcatcgccgcgcactcccgccgcggctccccggcatccgcgctccgcgtcttccgcgcgctcccgcccgccgcgcgccccgacagcaccaccttcacgctcgcgctctccgcgtgcgcgcgcctcggggaccttcgcggcggggagtccgtcagggaccgcgcgttcgacgccgggtacaaggacgacgtcttcgtctgctcgtcgctgctccacctctacgcgagatggggcgccatgggcgacgcggtcaaggtgttcgtccgaatgccgaggagggaccgcgtcacctggagcaccatggttgctggtttcgtgagtgctggacagccactggatgcgattcagatgtacaggaggatgagggaggatggtgtgaagggagatgaggtggtcatgattggggttatacaagcgtgcacagcagccagaaatgtccgaatgggagcttcagttcatgggcatctcttacggcatggaatgaggatggatgttgttactgcaacaagcctcgtggatatgtatgcaaagaatggactacttgatgtggcgtgccgagtttttggtctgatggtgcaccggaatgatgtctcatggagcgcgatgatctcaggttttgcacagaatgggcaatcggatgaggcacttcggttgttcagaaatatgcaggcttctggtattcagcctgactcaggagcacttgttagtgctctgctagcttgctcaaatattggattcttgaagctagggaggtcagtacatggtttcatcgtgaggaggtttgattttaattgtatcctcggtacagcagccattgatatgtactcaaaatgcggctccctagcaagtgcacagatgcttttcaacatgatcagtgatagagacttgatcttgtggaatgccatgattgcgtgttgtggtgctcatggacgaggccaggatgcgctcactttgttccaagaaatgaacgaaactggaatgagaccagatcatgccacatttgcttctcttttgtctgctctaagccattctggtcttgtggaggaagggaaactatggtttggtcgcatggttaatcacttcaagatcacacctgctgagaaacactatgtctgtctagttgatcttttagcacgttccggtcttgtggaagaagccagtgacctgctcacatcaatgaaagctgagccaaccgttgccatttgggttgctctactttcaggctgtctgaataacaagaagctggagcttggagaaagtatagcagacaatatccttgaattgcaacctgacgatgttggcgttcttgcgttggtctcaaatctctatgctgctacaaagaaatgggacaaagtcagacaagttagaaagctaatgaaagattctggaagcaagaagatgcctggctgtagctcaatagagatacgcggaacacgccacgtgttcgtgatggaagaccagagccatcctcagcgtgaagagatcgtaagtaaggtggcaaagcttgatttagagatgaggaagatgggctacattccgagaacagagtttgtgtaccacgatctggaggaggaagtgaaggaacagcagctcagctaccacagcgagaggctggccatcgccttcggtttgctgaacacaggcccaggaacaaggcttgtgatcataaagaacctcagggtctgtggtgattgccatgatgccatcaagtacatctcgaagatcgcggaccgggagatcgtagtgcgagacgccaaacgcttccaccatttcaaagacggagtctgctcctgcagagattactggtgatgaaggtagcagtttcatctgaattttgaccaccagcgagaccacccactatttacatagtacttaggtagcaaggcagcaagataagttcactgtaacccctattggctattgccgcttttgttgtgcaggctaccgagaaccagcatggcaagaggatgcgtgttgctgtatgtatacccaactgatccccctaggcggggaccatcagaagaagttcagccacgcaaggcggccacgtccgtccgtccgtcacgggggacccggcggcgtggtagtggtgcggtgcccgtcgccttcgccattcccggccgcgggcgtcatctgtcgcggcgaaaacgacccgggaggtggcggcaaaggcttttgcttcctacccgctggggcgcgcgcgtcgccgtgatcggtacgaatctcgcggggggaagtggtggtggcccagacagatcgtgataacgttggactttgcgcgcaggtcgcgttggttggagtggtttgcggtctaggacacttgcttttttccccagtaggatgatcacccaagaccgctgcactgcacctgccccatgtgggagcagcatccagcatggccagttcgcaacgctacaccggtaacaacaagcccttagaaaactatttggcagtttggtgtctggtgctgatgaagtggtgattggggcctcagattagtcttttctgtgtttaactactgtgcatatgacagggaggaagcaaaaaggtttcttcgccgttgacttattacgggtgtggccagaagaaattcggcgtttggtttgctgtgcatatgtgtgagccatggtagttacatgctgtttctgtttccactggtatagtggtattgcccgtttcggtcccaggtgagtctgaactctgaagaccattttatctttcacaagattctgtaataatctggttggtggatgaaggcagtgttttcataaaagattcattaatttcgtggtgggatttagtgtgtccagtgtaatcatacagggttcatctcactgtctgccaacctttgtgttctaatttgaaaagaaacgaattgatattaggttttttttttccttaacaaaaaagtaccgaattggttgtccatgggcgattggctggcgatatgctcagatacatcgttgtcccccttttcgtggggatagcaaatatcggttgtatgacttcctcaatccaaaatgtggtcctttcaaagatggaaaattaagggtggtacctcacacattcgactagtcatatgctggaatctcgtcatgtgtatataccatgaaacacatttctgatttgccatccacattagcttgatatccaatcagttcttgtggagatcacctatatctaggattggtaaagagctataatctaggaaatttgagatttgatttaaaatgggttgagctaatttttacatatttttcatataaaaatatatgagagtgacccatgagtcttgcccattactacccctacctacatcctcagtagaattagtataccaacaactattggtttgtcacggactcaattttgcgggctatccatgtagagattattcatatccatgtttgcccctaccttttgtgttgttaaatagtacatgaacatatttatcaattattattatattgtaggttacataaactttatttttgtttgtggcaacgaaacgcaccaaaaacagaagttaaaaccactagattatagaaatgcattaccaaaggtggaatttattacatatttattggtgttatttctacctgtggttggccctccttttatgttattgcacatgcaattgaatatcttgtcagtttaccatgtgcatttacaattggtgactatgagcagaggacatgacaggaaagcaaggccactagaactctccacttgaaaaactagaataaaacaaaacaatgtaaccttctgatcatcgaaggtaaatctatttgaattgtgcaccctagtgttgaaaatcatgcttgataatgcatcctaggcaatgggtcattcagcaagccggctgcagcggctgcgctctgtgcgttcagcactgttggtgctgagtgcggcacagccgtgaaactagcaactgaacatgtccaatactatagagaccatttaattgtagcaatggaatgtatttataagtatatatggatgtaacattattccctactatctccaataccacgtggccatggtactagtagaagtgatattggataaatctatcacaaccacatagcttttcctgttcaacatggtgttatctctactgagacaacgccatcccaatactagtctaacgtcatatgatattgagtctagtgatagacacggaccctgataccagcgctacgtcaccgttcagctagcaaagaattccattttgtttagaatactcacctaacataagtttcacctatagcctttaatcctcattactaatttacaattatgttattgaaagtaggttcacctatagttacaccaaatggaatcggcaaaaactaaaaaatgtcgcatcattttctcctcctttttctccatgtgaccaaagaagaaacacctttaagttgtataggctacctagccatcgataatgaggcattcatgctgacttcatcgatctatacgtgtgtgcgcataaggatgagtgtacgtgtgttataagcgtctgcgtttatattgtatttttaaatagacaaaatcgaaaaggaagacctttgaaatacaaaatacatgaactcgaaggggtgtaatgctaaaaagtatagaaccctccaccacgaagcggccacgctcgagacgagacgaggtgaccccttcccttctcttccgtgcgtccggaaagcttcggtaggacgcttagcttggccgtcatcattaaccttcccaacctcccccacgcggccgccatcaccaccaccacctcctcccccccacctcccctcctccgatccctttcgcccgctcaaccacccgtcggccggcgatgctccggccgccgacgccgacgcggcgcctcctccagagcgtcggcggtgggagcaaccccaaccgcatccctggcatcccgcccgccgatcccccctccggcggcgtcagctccgatgtcgtcgtcatcctcgccgcctcctctgcgccctcatctgcgtcgtcggcctcgccgccgtcgcccgctgcgcccgtaaccgccgcaacagcggcggagccggcgccggc

SEQ ID NO: 22846 - DNA, 3599 bp, Oryza sativa
tccgagttcggcgagcgggaggaggtccgcgtgatgccgcagtgcggccatggcttccacgtcgcctgcgtcgacacctggctccgatccaactcctcctgcccctcctgccgccgccccatcgtcctcgacgacccctcgccgcccaagcgctgccgcaagtgcgaggccatagtcctcgaggccgtcgtcgccgcctcctcctcctcctcctcctccgccgccaccgccaccggcagcggcggaggcggcggcggtggcggtggccgattcttgccgtagtgtagggaggatggttgtgtccctgacgggtggggcccaggtcggtgtgggtagttgagctgctcctttccacccatggcccacatgtcagtagagagagagctcttgaaaaagttttcttcagaaaaagaaatggaaaggagaataattagaacttgtgaatgaattgtgattctttttttacacctttttgggttccttccagcttctgtcgggggcatgacatcacatacagtcgttgttgatgtaatctgtaaaaaaaaaattatatcagttatggttggggtaaaaaaaaaagatttttactagacctaagtgtcttgcaaattttagcaaactaatcccatctgaaattatatcagttatgcagcatgagagtaatgatacttcccagctgagcagatgcatgccacgtggaggcatccgcagccgttggatgcgagaagagggagcgtgtgaagtggagtagccgggtggtctgcctcaggggcgttaggtcagtgacaataatcatcagtcgccatgtgaccgtgaggtttttgtcttccattaattggaacaacatggaacaaagccatatatcatatcaaagcaactaacagcgcttaaacaaaagcgtacttagatcccaaacctactccatttttactaactaactatacgtgctagcctcacccaataattggcgatcaatttagaagtagaaattttggagacgtccagctcagctcaccggctcgagtgtagcttagcgatttttgtaaacacgacgtgtcaagcggccagctcagtccaaagtcactagtggcagtgggagtatagcaatatggcgacccgctgaaaattccgtgtctcccgcgcataattgcctgtccgcgccgggacggcgcggcgagcgtgcgtgtgacaagtcaccaaccgcagtactagcctcttctccggctgtctccatcgcggcgcgctctccaccgccacggcgccaacagattttcttagagcccaaaaaaactactatattaaatatttgttataaatattttttttaaaaaaaaaacacaatacaagcatagacgctaaaaacgcgtgtacactcatatatacgagcagacacgcacgtactacccgtatgagtacctttaagaaattaaatcaatatatcttgagattgacgaagttactgcggaagtctcgctataccactaagaatagttagccgtaaatatgataaaggaataattagccgtaaatatgatcatactagtttaccttagtcaaaaaaaaatcacatgtttactggttagaatcactggttagtagatgtactcaaggttaaaaaaccaaatcacacacaataatcggaccggatgggttttctaaaacttttaacttattgagaaactgaactgtttgtgttgtcaaattggcctaagaagtgtggtttgttttttttttttgttggttttgtgaagtgtaaaccatggctgtacctccacgaggccaccagacatgtgggtggcacgagcgagcgtgagggagagggaaagacgtgtgcataaataaataaatggcgtcgtcaacggccacctgccgctgcccgccgcacgaaaccgtggtggtccgccgcgacggcgatcaggcaatgacgctacctccagctgcgcggcggccgccaacctatggcttgcccatttcttgcgtatttaaaggtaggggtggacattcggtcagaccgaaaaattcggtctcggtcttcggtttttcggtcttcggtctttgaaaactcaggaccgaatttcatccaaaaaaaactcaggaccggtaaattctgtctcggtcttttcggtctcggtctcggtctcggtctgaccaaaattttcaggagtaagtttgaaatgaaaaattttgacagcacttcctctcttttgagacatttcttcacagatatatatcaaaaaatacaagataatatgcaagaataaatagcacagccgcacaattacaggtgtagtagtagtttatagtttatgctacctgctagtactggagtagtagcgtctttttgttgttgccaatctttattttttaagcaaccactacaaacatcgaccagcggttgttgccctcttggatcaggtacaaacagaacgtgatggagatgttctcttcgattcaatcaatcttcggttccaagacctgatctaaccaactgcaatgcagctttgcaagtggagctccagtactacaagagtttctgaagtctcagctctgaaccaatactcccaccgtccaaaaaaaaaagaaaaatatgaattttttttataattagtatttttattattgttagatgataaaacatgattaatactttataacttgtctttttaattttttttatatttttttaagataagacggatgatcaaacgttagacacgaaaatctagagtttttttttcttttggacggagggagtacaccagagtccaacacagtttctgttgctccagcttgtccccaaactgcacattgctgcatgctgaacccacagcttcccaccatcatgcatcgctttaatttataagctgccactagaactcgaagcttttctgctgggacagtagcttttgggttccactctgacagctaacaaaattgaaattttattcacaaagtacttctcctactcctgaactcctttacaagagtgggcacaattcttttcctgggtatatggaactcaaagcattacctttgctttgcttctccttttctcccctttcacctttcaccatttctttttaccctgtgagcttgggtttttagtacttgatgaaatccaagcatcaatgaaagatgttcagcagagaggaaaccaattcagaactagtactcggctatgctaatattcagaactcacaaccgagagaagaaaacaaactcaagagtaaggcaaaaccagtaacacaactgtgatagaccactagttacagggagaagaattccaaagaaacacaaatggaaaatgaccaaaccaaaaggaacagatgatctacatatcctaagctccaaaatccagtctacgacaggattcagcctcatgatgtacagccaaatcatctctttaggctcactgcattttgatctcttccaagattctttaacaaagcatccatcacaggtttaacccgcagcgcgatttggaagcaacaaaattaccaccagcaatctgattgatcacttgatccgagcaactagtcctccttggcctgctttgctccgacagagaagaactcggtgatgacttcaagaggcatgcc

SEQ ID NO: 22847 - DNA, 3301 bp, Oryza sativa
  unsure (1)..(3301): unsure at all n locations
tgcacttccaagtgcactttgcccgtgaacaggacgggcaacccacgataagccttcttcaggaccatacagtttgatcttctctggatctggagccagcccttcatcagcaagctcatcatcaggtccaattatgtattcctcaatttttgtgtctttcccaacccccagaccttcaacgagaagggccatttctcctgcacagttaattcaacatgagaaactccatcgcatagataatatacctatactgatagcattaaatagtttctccactttctagatcctcacagggaaaaatgctgggtaagacatacaaacctgaaacatcttctcttccacgcaggccttgcaacacacgcttggcctcagccattcttcctttgctcacgagccacctcggcgattcaggtaagtaaaagatggtcaatgcaaagtatataagtgatggtattgatagaacgccaagcatgatcctccaatctggctgtggcatgagggacatgccaaataccatgcagtatgaaaggaacatccctccagacccactgaactgcggcagcgtgtttagcagtcctctgatgtccgtcggggcagtctcagagatgtacaatggtacaagcgtgacagccaaaccgatcccgaacccgtcaatgagcctcgccaagagcaacacatacacatttggcgcccaaagcatcactagcccactaacaaagtagaggacagccgacgcgatcagcatgggccgcctaccaaaagaatcagccactgctccagagaacgtcgtgatgatcgtcgccccaatgagcgacatggccacgatcaggccttcgataaggggctcgctctgcaagttgaattccttcttgatgtacagtaccgcacctgataaagatcatcccaacaagtccacagggtcagcaagaagtcaaaaccatcggtatcaatcaaatttctgaaaccttaccatgcagacagtatcaagtccaataaatacagatcattcatgagatccggacatttgtttaatcctactcataattgactcaaaattctactgaaaaaaaaatatcagttgtttttttttgtgatatcatgaacagagaagaacanctaaaccattttttactgcagatgattccaccaaatccatcatgatctccacaagtatcacaataattgccaccaaacacgggccctagcgtcacataacgacatggcacacaaactatggcagaaaaaaaaagattcgttttttctctaaccacgaacttacctgcaatggttgcattatcccagccctgcagcaagttgccgatggaggccgcgatggcgaccagcacggcgcccgccatggccggcgaatcttaccactgcacaagaaagaaaaagaaaagaaaacaacgaacaccaccatcaacaccacaacaaagaacgccatcagcaacacaaatcttacaacaaaactccccccacccacaaacaaaacttgattcgatctaacaaatcccctcctagaatcaagaacatgcctccccccagagagagaaagaaaccctttctttacccaagtctctcgtccaccgagatttcggatcccctaacaagaagagaggcggctgggaatctggaagggctcgttgggacgccgagatggggcaaatatatggggaattctcgccaaattgggaagcttttaggggagatttggaggagggagtccagggccgagggggggggggtgaggagagtgagtgtgggctgtggactctttggactaccatagattttgctctagagaggcaatgtttttttctcctctaccccttctttgcattgcttaggtgactgacaggtggggccatgcaggttgtgggccaggtggttcagtgagagagggtggtgatctgacaggtgagaagttgaattttggatgtttatttgacaggtgagcattagcagtagagccagccagtgtcagaggagaattattgagctggatgccttcggatccatccttgtgctccatgtaggacaaccaaccattatgtacttgatgctggcaaaaaaattggtattttgatgaattgccatgttcaccacaagaattttgaaagcatactatgtgtggtgtatcagaggaaatcaataccattttagtttttttaaggttgaaatgctagcttgtaatgggatgtgtcatgtgtgctaattttcagatcttaattcttcgattataatacaacccaagttcgagatgcaagacttgattggttcatatggattatagagcaaagggatgcatcatgtgtgccaattttaaaagctattttcctcattttaatctatctccgcgttcaagaaacaagacatgtttggttccaacttttagatagacatgtattcatatgatattttaaaattcctatggaatatctcgttctataggaattttgggagaatagaaacatgtatagtttcttgttgcaccaaattcttattttaccctacaaagtatctaattattagtgttcattattaaaaaaaacattcagttctatatattattccactaaacactccatcggaaacccttctctttgctctataatcaatattaaccaaacaagtcctaatcttaaactcgggatagattataattgaggaatttggatacgaaatttggtacaaatgatgctcccaaaattcctgtagaatgagacattccatagggatttaaaaaaatatgggtgcatcccaaatcatactaatacgggtgcagtcctttgtcctaaagaccacagatatcctataaaattccactaaaatacattaagagttagtttttaaaactatttgcattggttgtggaattacacgagaacttcaaagtgtttttagcatgtttcaagcttatgtttcgttaggcatgagtaagatctaggcttcaagtagtatttcaacaaaaaaaaaaggaaaagggaataaaacctgactgcttttggcgtagcagattggggatctagacgcagccacggggcacatccaacttgatctatggattcactcgtcgactcttccttgaaaatgatatcctcttaggtaccaagttaggattgattgtggtggcaccatcagatctgatttggtggcccatcaatcaccacggcaggcacttcaaacttgctctatggcttcgctcgctgattcttcctttgaaagcggtgtcctcttaggtgtcatattaggattgattgtggcagcgctaacagatctgatctggtggtgcctcagatct

SEQ ID NO: 22848 - DNA, 753 bp, Oryza sativa
taataaaatatattgagcaagtcagcagcttatcaaacaacagcaagcaggttatctatgtggcaagccatatttaaacttatttctttcaacaactatgtgaaaactgaggccttagcccttagatgtaccttttgcaagtctttcaacaatattggtcgctacagcaacctcaaccatatttttggaactctggccaagttcatcaagcatttccatatcgttttcaatatgaatgaatgaataagcaccataaatagggccagggagataactcttcatatagtcttcctgttggacactgggaccatcagaaattcggttatcataaaagttggcatttggaaatttgttgatgccagggtgcatcctatattgtacttccagcaaatgctttctataacccattgtacacaatctctcatagagacttcggccaaagtcagcatctttagcaatctagagtagcagtaaggagacagtatgagcaaagctatagaagtcagaataattattggcaacaatatactcataataaaagagaacatgtccatgtatattatcccataccaatggcataccttactctttaccaatgatgataattggttttcatctccaatcagcagaatgtgctctatccctgggagcaagagaggaaccagtgcttcgcattcttttagttgtgctgcctcatcaataaccaagatgcttataggcatcacgttttgcaacctgaacaactcaaatgaa

SEQ ID NO: 22849 - DNA, 388 bp, Oryza sativa
caaaggaggttgaagtgttcaataattcacagagggtaattgcagcaattaggattggggccggcaggcttctcacaagccgcggccgaattacttgtgttaaacctattcatgcaacatttgcggaaaagaaatacttagatttaaattataggtgcaagatgatcaaaggtgacttgccttgctcgagatcttgagcttgatcctcgaaatcctcgcactgcgggtcttcgggctccgaaactacacgtgaaacgggacaactcaaaaaaaggcgaaaacaaagccctattattgacctctaagcgtggcattagatagatcttgagatttgaggaattttggaggttgaacggagtcaatcggatgtatggttgagaagatattg

SEQ ID NO: 22850 - DNA, 2469 bp, Oryza sativa
tggagcgtttctaggatgattaatggacttttagtatgtaatagattaattaagtattaactttcttttaacagtttaactatttgaaaacgagaaacgcccagaggtcttccagctagctccataaggtggtgagctagacgatctgggtttgaattctcaccccttctaattatttgatattagatccttccctaatattcgtattttactatttgaaaaacatgcatgtaaaaaaaaagatgagttgggaaacttagctgccaaacagagaattgaattggagagatatttttgtcgagatggaagagagaacttgaggagagagatgtgtgggtgactaagagcaagaataataacgagctataagctaacaataaatttatacgaaactatcgacgtttgatgtcgcgattccggtatttgcatagtatggggatcgttggtactaggatatatgcgagactgaggtaaaagagatggatacatggatttttatacaggttcgggcccctgaatcgtcaggtaataaccctacattctgttggccgaagccggtcgttgctcttattcatcataatcacaccagtacaatatttggggtagcctatctaactgttgtcgacatggcggtctgaagttctgactcgtagtcgataacatggtagtcttcctcctcgaatctgtgcctggcaagatcagagacagcgctatgtctctcctaacagtctccggagacaccgtaggggactggccatgcctatctctaaagtcgatatccggcgtcttgtcttggcgcatgttggcttgtatattgtggcttctgttgttccgtgtcccctctcctcctaggtggccttgtatttatacccataggtgtccccttgtccaagtagaactagggaaaccaatatggatacaatccaaatagtccttgtcgtttccatgtaaaactctattcatcattccttatgcagaactcctcctatatctgaaggttgtttccgtataggacatgatatgtggtgggtcctgccgagatttagtcaactactattaggtatgtggtatccataaccctgacataaacagtgaaacaacaaaaaaataaaagatgttggctctcatgtaaaatctaactaacacgtgcttcaagacaaatactttaaatacataggtgagagagatagtgagaagcagtgaaacaacaaaaaaataaaagatgttggctctcatgcaaaatttagctaacacgtgcttcaagacaaaaactttaaatacataggtgagagagatagtgagaagaaaatatggaaacaatattatagttaatttattatatatatgttggctttaagataggctaatagcggttagtgaactctactactccaacgcactcaacgcagcaatgtgggcccaacgaataggaacaaagggagaaagcataggagagagattaacatgagtaaaataaaatttttgatcgtactattgcagctagctattgtagtagtacctaagagacggtaaattatctctatatgatgcggatgaaaattatagcctgttgcttactctattattaatcttgctctaaccatcattagatcgaataacaaagactcagaacgcacaagagtattgttcatcatattaccgtatgtacgtgttgaatagggatagcagcgccgggggtctccaatctggcagtgggtcccacgtgccaatatctaccttcttcttcccttctctttctccacagtccacatctatcaccttccccatccccacccacccggtggccctcttcccaaccagtggatgaggaggcggcggcttgaggctagggggcgagtggatggggagctggcggcgccaccgccgtttcacgcgatgatggccgacgctagacgactacgagcacatgaggtgatgacgggatcaactcctcgccggcctccctcaccgtcgcgtcctccctcccttgctgtcgatggtgcacaccggctccgtcgccctcgttgtcgagttgcgctgatggccgacgctgaagaaggaaggcaacaacggccggcagaggtggcggcgactggcaggggaggcaacagcctaccggcaaacagcagggagccaccgagccggcggacagcaatgaacgacgacgggtacgagagagagaagcgtgaagaaaagcagaggtaggggcaaaagcacatgggtccattgttttgggaggaggaatgcatgtggggcccaccgttagctagtgactttggcttgccaagtttaggccaggggagaaagtgttttggacagtcagatggcgccatctggttaaaaagactgttggcgatgctctaactcataacttcgggtcctcgtgggtcaactcttatccccgcatgcgcccctgcatttactgtctgcaaattgccaccccttcccgcgtatgacgacggccggatc

SEQ ID NO: 22851 - DNA, 3972 bp, Oryza sativa
gtgtgggtaaagtgtaccccctctgcagaggttaacaaactgttcgaacagccgtgcccacggtcatgggcagatgtgaggtgattcctagcgtagttttgtttgactattgtcttgtgaaattgctgttgtggaaaagggatcgatgtttagaaaatctgcagctgatgagatcagctaggcccgggtggccgtttaaaagttgttggcccgggtggccgtttgaaagttgttggccgggtaccaaccttgaatcaattcaaaagactgatacattgcacatactccgaccggacgagacgcactgtctcatccgtgtcgtttgagaagcactcacttagtggtttttcataaaagagttcaaataaaatcaattgcaaaaataacagtctttccttgaagcctgcattaaacacttatttcccatggcttgctgagtactcccgtactcacccttgctttatataaataatcccccccagttgctgaagaagatgaagcggatcccgctgatgaggagttcttccaggagcaagccggctacgatgagttttagggtttcggcctagttcccaagtcgcgcctgtgaagtttggtccaagtcttggcttccgcttcccttttgtaatgcagttgagagctcgggatctgtccgcagcccacatgactgtactcctactctataataaagagacctctgttgctgtgatattctgtcttcctgtggtaccagcactgtttcctgggactggtatcgattaacaggttaatttggagcgtcacgggctagtctcgctcggggctagttcggggcatgacagcagaggtaggggcaaaagcacgtgggcccattgttttgggaggagaaatgcacgtggggcccaccgttagctagtgactttggcttgacaagtttagaccaaaggaggaagtgttttggacagccagatagcttcaccatatatccagttaaaaaggctgttggagatgctttaactcgtgacttcggggcctcttgggtcaactcttatccccgcatgcgcccccgcatttactgtctgcaaattgccacccctagccagtagccgcgtatgacgacgaccagatcgtgcatgcttacgcatgtgctacctgccgggaaatgcctcgcatatactcctacgtaccgcgccgagtcgtcgccgaccgatacgcgttgtttactgcatgggtatatcatgatagcctgcgtctttttttttgcatcgatcaatcgatcatgtgaaaccgtacgtcatgaacttcctcaccctttcgttggttaaacttcctgcgtaatgtcaacaactgaactttttttttgttttttttagttgaggccggggatcaacaaagtgaacttgactgacaaatagtcatgcttgatctgatctgccagcttgatcaacgagttgaattgagttaacatcgatacagggcgatttttagttatatatacatactccctcagtaaaaaaaaataattatagagatgaatatacaggtatatctagattatattcatccttaaaattaacattttttcttgctgagggagtatattttggcgatgccatatgctatagtactccctttgtccaaattataaggcactatctttttaaaagaaaatcaaacttggtaactcttgattaataatcatactaaccagtattatgcatgttaattatatcactatattcatattttaaaagaattttaatgtcatgctaatttcatatttgttgggagcataacatggaataaattaatgatcaaaatgagttattaaagtctgtttaaaaaaaatatagaccctataatttaggacggaggaagtatagaaatctggtaacatggcattgcaggaaaccgctactgcgcctgtcacacgttgttgacacaattatttgaatagacaaaatggtggttatgagtttttgtttcttaaaatcatgaattgtatgcctaggtttattttttcgcgaacgcgcaaaaggattgcgcgtcaatatattagaagaaaaaatttatagttacatgacgcaatcagtcagaccgacttatgtaaagggaagggggaaaaaagcaaaataagaagctggagcttaaaaaactacggcggctaaatacaaactccaagcagcgggaaggggccgagccacgttacactcctaacaagtccctaaaaacggcaacgccagctaaagactatagatggccctcctgagtggatggactccagaaccactgagaccgaagagaacacaaagtcgaaaaacctagagttcagttccttccacagctgccaagagaccaggagcaccaggaagtcgaagctagcgcggagatgctcaggttagcaggccctgaaggacggccaccagtcctagaaccagctgccacgggggagagagggcatcccagccaggaggcgatagcacacagagccagacctactgagcaaacacatagtcgaggaggatgtggttcgccgtctcaagatcctgagtgcaaaaagggcaggccgagtgactatcgatgccatgcttctggaggagatcagtcgtccaacaacgctgttggaatgcaaaccaaaggaagaacctgcatttagcaggaccctttacgtgccagagaagatcagctcaggcaaatgaatgctggccatggaagaaagcctggtatgccgaacgcgcagagtagcgctggtcatacgtccaacgccaaatgagacgattctcgacacccggtgagagctgtacgtgaagcaccgcatcccaaataaggagaaactgggagatgactgggatagtgagggcaccgcggatgtcagagacataggagttgttcgccagaccagaagcaaccgtgcgtgaacctggaagacgctggggaacaacgaagaggagatctggagccaaggacgccaccgagcggccatcgatccattggtcggaccagaagagcatagactcaccatttcccggcacgaagaaagtggatgccgcgaacatgtcggagacggtctgcttgactggggacttcaggccatcccagcaggtttattttttcgcgaacgcgtaaaaagattgcacatcaatatattagaagaaaagagttatagttacatgacacaatcagccagaccggcttacgtaaagggaaggggaaaaaaagcaaaataagaagctgaagcttaaaaaactacggcggctaaatacaaactccaagcagcgggaaggggccgagccacgctacactcccaactagtcccaaaaacggcaacgccagctatagaccatagatggctcttgactaggtttattaatttttactagagaattaaaggttcaaaatgtaatgttatcctcaccgttgtaggtaactgtatcgatcggtgacgtttgtgtttgaatggaactcctagcagcaacagggccacgtttgctctgcgaacaggtcgtaagtacaacgtacgcactgaatttcttcacctctccagccaatcaacggtgggccacattgctgaacatataaattccacgttgctgaataagcacattgccgtcaatatattaaacttgatccattggagatatagtatatttatatagagaatcaacgactccatgaaggctcaagtgtctcatccatttcacagttatttcgtgctcacttattaacgattatgagttcttatctcatttttcctaattcacatctttcgtttttggtacgcacgcttttcaaattattcaatggtgtgtttttttttaaaaaaatttctatgcgaaagttgttttaaaaaagtattaactatttttatacgaaagttgtttcaatagttaatacttaattaatcgtgcaataatgcatgttccgttttatgtgccgggaggcaacccctcctcccgaacacacccagaagttaacatcaaattattcagtcct

SEQ ID NO: 22852 - DNA, 5409 bp, Oryza sativa
gtcccactcgaagggctgaagccgggcgacgcgatgatcccgctgccgccgagcggcagcaccgtcctgctcgacaccttctcgccgatcagcttcctcgtcgacggcgcttaccaggccgtcaagaagccggtgacggtcgccgtcggcgcaccgccgatggcgacgccggtggagctgttcgacgtctgcttcccgaaatcgggggcgagcggcgcggcgccggacctcgtgttcacgttccggggcggcgccgccatgacggtgccggcgacgaactacctgctcgactacaagaacggcacggtgtgcctcgccatgctgagctcggcgcggctgaactcgacgacggagctgagcttgctgggaagcttgcagcaggagaacatccatttcctcttcgacctcgacaaggagacgctctccttcgagcctgcagactgcactaaactctcctagctaatcaatggctgctgctacttaattactttcttcatatgtatgtgtacttctgaataacgcagccttgcggcatgagctgcagcatgctcatgttggtgaaaataatactccattcttattattattctgtggcgatctggcctacttcgatttcaatctctgttccatgtttaatactttaatggttcatcaaccactgtaggaattaggatgctctcctacagtttttctttcaaaaaaaaatgtggttcatcaaccaagtttcgtcttacagcttcagaaacaaactgcatgcctcttcagttatcttagcaaaacactctgaaattaaatcagaacggtagcttcaagtcgatcaattgttgggaggcattgctaagaaatctaattagtcaatagtcatggattacgagttacgacgactgaactgatataccaaattaatcaccaaatatgacaagtggaactctaaaacagcaacatttatgcttaatccaccttgcatttctggatcacgtgctggagacgactttttccaccagaagccgcttcacacgtactaccacactcgcactaactaaccacgtattcgctccattaaaaataaacaaacttcgctaaaatgtgataaattctgatagtacgaatctagataggttcttaagtactacgaatttaaacatactaaattcataataatgttataatgtatcacatcttgtactatatttattaattttagactgaatggggtagtagatgaagtagactagaccaaacatgaagccagcagatcagggtaaatgtggtaaccgcaagtccaaagaaaataaatcctctaacttactattctatgtatatccacagctcatgtttccatggctgctcttatcctttttagttttttagggggggggggagggggcgttaccgtggtaatcgccgaaaaccgcgtaaaattcacctccaaaaatataacatttttcatttaacctgttccaataatatttataataagcttttgtcaaatctaaaaccttttgaatggaacactctcattttgtctttacaatactaatccaatatgtctaatacaatggcatgacaagaagccgttgctatatctatcacccaccgtagtatggtaaaattaaaaactattgcctagccatggtcaaaggtacggttggcgacatggctgaaaggtttatttaataaaaaaattataaagctatatacagtttttactagagaacggttaaactgaagaaaatattattcattcggatgtaacaacatcagtgatgtctgaatgatacttatgtgcataattgaacctttatagtgtgaatgacaccggtattttttttagagaagaatgacaccgatatggtgcagtcgttgtcaatggtttttgagatagaatgtcctagctacatggttgaggcgcgatctatgcgaacaggtggtcagtactgctaaagaaacttctactatgtagccaaccaaaagttgccacgttacgtgctcaacacatattctataaagatccatgcatgtgacgaaaacacaaattgctaggtttcttttggttaattaaaaagatcaaactgaattttaaattttgagaagatagattgatccaattttatttgtttttatcaatttatcaatggttacagtaaaatccactcatgaacggtttttattctcaccatgaacggtttttattctcaccatgaacggtttttattctcactatcagaactagcatggtggcccgcgcaatttgcgcgggctagcatcattatattttctctcatataatagcatatatgttttctcattatattatttaaatatattacaatgacaacataattttaaattttgcaataactttacgaaactactaatgtgtaatattcatattgtattttatatacgtgttagttattaattatttttaatatcaattttttgttatttataaattatatattttcctatatggactctagtctcctcttctaatagtccttattttttaattccgaattttaactatttctaaattgtatttctatatggactctagtctactcttctaatattccttattttttaattccgaatttcagctatttctaaattgtatttctgtatggactctgctttttctttttctccgattaatgtgagaatttctaggtcatgagagcaaacgtggaggctcctttttattccgaattttagttagttttaaattcatatatagactctatactctacttctaatattccttattttttaattccaaatttctttttttttcttaattataattctatatagactctatactctacttctaatattccttatttttaattctgaatttctattatttcctgattgtatttctatatggactctatactctacttctaatattccttatttttaattacaaatttcagttatttcctaattgtatttccatatggactctagtctcctcttctaatattccttattttttaattccgaatttcaactatttctaaattgtatttctatatggactctgctttctctttttctccgattaatgtgagaatttctagaccatgagaacaaatgtggaggctcatttttctattcctttaataatataatagattgtgaacccaaccctgctccatgaaggctcaagtggttcattcaatttcactgtcatttcgtgcccactaatcctcgacgagtctctctcgcgtaccaattaaacgatgaggcgtacgttgacatctctttattcagttttttttatcggttagatttattcaattactatgcgacattacagtgttagttaaaatcatcttactcctggtttattgcatgcagccaatcatctgcagatataagcttcctatataaaccctacctctggactttgatcatactcattagctcgagacattagtcgatcatcataatgggaaggctaatcgtaacactgctcgtgctgtgcgccgcggcgactacgtgccccgcggcgcttcgcgggcacgacccccggcgagccatgcgcggccgcctcctcgccgacggcggcggcgcggtcgtgccgttccactggtcccccgagctctacaacgtggcgaacttcaccatcggcacgccgccgcaggccgcgtcggcgttcatcgatctcaccggcgagctcgtctggacgcagtgctcgcagtgcatccactgcttcaagcaggacctgcccgtgttcgtcccgaacgcgtcgtccaccttcaagccggagccgtgcggcaccgacgtctgcaagtccatcccgacgcccaagtgcgccagcgacgtgtgcgcctacgacggggtcaccgggctgggcgggccaccgtcggcatcgtcgccactgacacgttcgccatcgggacggcggcgccggcgagcctcggcttcgggtgcgtcgtggcgagcgacatcgacaccatgggcgggccttccgggttcatcgggttagggaggacgccgtggtcgctcgtcgcgcagatgaagctcaccaggttctcctactgcctggcgccacacgacaccgggaagaacagccggctgttcctcggcgcctccgccaaactggccggcggcggcgcctggacgccgttcgtcaagacctctcccaacgatggcatgagccaatattatccgatcgagttggaggagatcaaggccggcgacgcgacgatcacgatgcctcggggccgcaacaccgtcctggtccagaccgccgtcgtgcgggtcagcttgctggtcgacagcgtgtaccaggaattcaagaaggcggtgatggcttccgtcggcgccgcgccgacggcgacgccggtgggggcgcccttcgaggtctgcttcccgaaggcgggggtcagcggcgcgccggacctcgtgttcacgttccaggccggcgccgcgctgacggtgccgccggcgaactacctgttcgacgttgggaacgacacggtttgcttgtcggtgatgagcatcgcgctgctgaacatcacggcgttggacgggctgaacatcctgggaagctttcagcaggagaacgtccatctcctcttcgacctcgacaaggacatgctctccttcgagcctgcagactgcagctcactctcctaactaacattggctgcagcctgtgcagtttgtgcgtcagcttggctgtatatgtttgtgtggttgtcaggtgtgtacaactcgcatgtttatagccataataacgcagctagctaggcagcatgcatgcatgtgtgctgcgacatgctttgctttgctctcccagtgtctacgcattttccttcgtgaacctgcgtgcttgtgtgtggcatcctagtgtgatatgttacttgttagtgcaaataatatattcagtcgtgatctggacttgatttaattccgtcattcacttgatcattcccatatgtaatgttttattctcacggtctccttccccttattaatgatggtaaaattaaaattaattgctctattaacataaggctacaacttatagaaacagattgctcattcagttatcctgctaaaccacagttccaaaattaaatcagtttccccagctcgcagctaagtattagtttctcttgttcctatggagcaatcgtcattacgcaggctgctcatgagatgacaaacctgctccattatagattaaggtatacgttacactttgaatgcaacccattctgctcccgattggaaattgtattttgcaatcttgccttcataaagtccttaattggtgtaaagttctgttatctttagcttatttttactctactgaccccgattccacatgcacaaggattggtgggaaatacctcggagcgaataagatgggattttgatgttcttca

SEQ ID NO: 22853 - DNA, 2580 bp, Oryza sativa
ggagggtataaggtgtgcatatgtgaattcatagggtgggtgtgctcacatttatataagcgcttatgattgcctttacatcgttaataaaaaaataatttcaagaaaattgacggaatggcgtgaaccgatgccacggcagggcgacttcttcggcaacctcaccagcagcgatcactacatatatgcacaatctgaggaaaactttaaggttgcacagacaaaaacctaccaaacacgatggatcatacatatgcgctcttgttatttcttttcctttttgacatctattgtgtatgtacgtacatagagagggattagctgtttttttaaatggggttacttgagtagattgaatagatctaatctaactggtgaaaataatggatttactgtgttagccatgtacatttatggctaaatgttttgctttccccttatattttgttcttagactttctcttatttatagagcaccacatgcattttagaagagtttgtaggattgtaggaacgctattacttatactcgcaatatacttgtagtcaactattgttttttgtggcttagtggcgtcctctacttacctatcatttgctgatggttgctcacttagtatcatcctttatcttcggtgcttgataacaatcttgttgaatgttagtgcacggatgccttgtaagcaatatgacctgacaatttatggatagtagtttgtatataaacttatatacataggggttagcagggatatacgattgatatattatgctatttttgattgacaaagtatattacatattaagcattttagtatataagaaataaatttaaggttatattctaaagtgcttatcggattggctactcccttgtttatcgtgaccacatttactgaatttctaaatggtgcatatttttgcaaaatattttatatataaaaattttctaaaaaaccaagtaaatccattttcatgttttaatattaatacttaatactttttagaaatatattaatacttaattaaactttctctaatgacctgtgtcgtttcacgtgccctggataagctcacccaataagctagatcgaacgaagtcgaggagtgagataaacgacatcgatatggtgtcaagagaatatatttgatctttaatttgctaaaaatatatgaatagagaaaacacataatacaagaagatatatctgtgataatttttatttaacatttatgataaatttagtatgtccttttgacgtatcaatatttttatagtatagagaattggagttgtttttatttttgaaaatgcatgttcaatttaactattacataatctatattttaattaatttattttttatggatgttttaatgacatgcgtctagtttgaatacaactaaaaataacatatatttttgcaatttaaagtatagttaatatgggcttgaattattagtttagtttttctatctaatctaaaggagaaaacagaaaaaaaaaggatgtgggatctatgtatgtacgtaccttttttaatgaatacttacatatgggctaggagccacatcatagcttggtctttttacagataaatttaagagttaatttcacattgcaccatatattttgaccaaattttacaatgggcaagggccaaaccaaccttttcacttaacaccacatatctttgcactagttggcactttggactagggttgagcacattaatgaaagttgtcagagaaaagctagttcaaatcatcatttttagttccatagtattaaaataaatatctttagaaagaaacagcaaatcacaaaacaacttttttcagcaaatcacactaaaataatgatgtgaacatgtttaaaagtggcacaaaatgatctatacataggggcaaatgaataaaaataaaatagaaaatagttaattaccactcacactgaaaagaaggaagaaaacataaatgttttgccttttataattatccctgtgtaatcatatgaaattttctcacattcccttgatttgctcacccctagtccaaactgaaaacttatgtaaagatgtatggtgttaagtgaaaacattgatttaaccctagtccattatgaaatcttggtcaaaatatgtggcccaatgtgaaatttactcaaaatttaatcatgagatagatttaatcgttaaaaaaatagtaatatgggcttgaattattagtttagtttttccatctaatctaaagaaggaaaaagaaaaaaaaaaaggacgtgagatgtatgtacgtacgtattttttttaatgaatactcacatgggccaggagccgcatcataacttggtctttctacagataaatttaatcctaaatatatctaatggttaaaaaaataggaagctttttccctaagagattatgaaagaaaagaggagatgaggggaggacgtacgcaccacagaagagtgggggtacgtattacgtacgcaccaaggtgtagagagggtggattttttttaattaaatctaatggtaaaaaatattggacccaccaatttaaagaaaaatcaatggt

SEQ ID NO: 22854 - DNA, 657 bp, Oryza sativa
ccgttgtcaatctgaattgtagccttgtcatcggcgcaattgagctcgtacgacagaactccgcactcagatgggtcacctcgccggcggaaaggagacgacacgctgctaagattaccacaggtgaacggagggcagccatgccgatgatgccgcccacctgcatctgggacaagaactgcaagcaaacacaggacagaaattacccgcaggatagcagtagtagagcaatgaaacacaccatgaatcgccatgccaggtgggcttgtgcagagccggatctagatggccaaatgacatgaacaataatacaaagaattttttttttagctacctgtccttgactgtgatgctgttgacttggaaacactcgacagaagcggtagagtccaagctcagcattcagttccagcattagtcagtcatgcatggttatttattgctgaaaaagactggactagtagaaatacggctgtgtttagttcagtgcaaagtttggattttggttgaaattagagatgatgtgcactgaagagttgtgtgtgtatgataggttgatgtgatgaaaaaggaccgaagtttggatccaaactttggatctaaacacagccgtataatcatatagactcacaaagtcacaaatacagccactggaag

SEQ ID NO: 22855 - DNA, 11113 bp, Oryza sativa
attttggttgaaattagagatgatgtgactgaaaagttgtgtgtgtatgataggttgatgtgatggaaaaggaccgaagtttggatccaaactttggatctaaacacagccgtataatcatatagactcacaaagtcaacaaatacagccactggaagttccaccaacagctgcaattacccgtcaacaaacctttaaaaaagattatcaccagtcactccactaccaccacagagcttcaccatgtcaacttcacgagttgatttcaacatcaccaaaagaaaaaaaaacaagtcggaataaaatcagttgtggaaaatcaagggcatgcgggagccaaaaatgataaggaatacctttcgaagaaatagaacatggcaaaagtttcattggcactgctcagagcctcagacatcatgacaagcacagcatcaattcacaccgataaaacaagtgaccatttctaaagcacagccttctcattcacctccatctcatctccattacactgcatggacttcaccaaccttcttatcacggtgctcctcctactcgctcctctgaaatacaaatctgatgttgccacagcaagtgatgatgaagacttcttcaagacttgttcatcacatcggtgcagcaagcatggaccagagatcaggtacccgttccggctttcgacacaacctccatcatgcggcgcacctgggatgcaattatcatgctctggacaagacaccatcctggatcaccctgttcttggttcctgcaaagtgacaatgatatattacaggcatgttatcatgaacgccatcccacttgtagattcctcacctcattgcctacttcacaagtttatatcagtaaatcaatcaactgctgtgtacagacctcacactttaaaagctgcaagtctagtaggttgttcaagagattccatagacacaaaccaatataatagtatagttggcccaacctcttgcctcagcctcgctaacaacgcaagccagttctggtatttggcatatccctatgaatatatgtctattcttccattgggctgcacaattgtttccaaagacatcccaatgccctacagttacgacaaaaatggtccaaactttgacatctcaatcttcaccgaaacagcaaaaagagtcatcagcactggtgagactgtattcacttggtactcaagtaacgttactagtatttgccaacaatgtgaacatgaaggtcggcgttgtggctttagctctcaaagggatcaagcattctgccagcatcatagtatgtctctttctcaagtataaattcagtttcactatgatgacttgttttagtttggaattctcacttctccatctattacatctcttatttctcgagtattcagttttcaaactacccaggatatttttcacaaatagtcaaactatccagcaaactgtgaatcagccaaaggctagcttggacgaacattttggttctaggttcacaactgcaatttttctcaaagaaaatttcatcaagagacgataatgtctgatcattatgaaaatcaatttttttttgtaaaattctcatagaaaaggttataagcaattgcagcacattttagcatatagcaatgatctaaagagcaagctttatttgtattactctagacattggtattaacttagaacattaaattagattcatatggttcaaatttactagtttggaatactgtaatagctaattgaacattaaagttagatgcaaatggcaccaatttactagtttggattactgtgggaggtactacggcgagagtagtatctcaattagaccttttgatgctagagatgcacttgatagtgcagtggcaaggggtgtatggttttaaccccgaggtcccgtgttcaatccctaacacgttcacaatttcttcttaaaaaagtttggagggacgtctctccctccaaatctccttttttttagaccttttggtgctaacaccatagtcctgattgttagaaagttgcacccatcgagtaatcaagaatgtaccagcataatttacagcattaacaagttcccacagttttaacagggtagaaaccagaacatatccatcttacacaacgttgatacgaaagttgtgcacatgcatatttccagcgatgctctgtaagattattgaattaggtagtttcttcctcctaggcactatagataaaaatgttttacttctatggttaagacaagaagcctccttatcctatttctatatgacaatgccaaataaacaagccatctaacaatcaggaattaattgtttctaggaaaaattataggtgtttctctcgatttatttcatccataaatcatgtcataactaataacctttcttcctatgtccaggtccgcgtgtcacaatcattgcaggtaagcaactaattttttttcttcattcttcctgaactgctcattctgtagaatcattgccttttctccaagtgcaactagctgaatttctctctttttttactcagtaacatcatctgtaggcacatttatagttctttcattaattgtggccactgcactctacatctccttgaagtcaaggtacaatgaagagatacatttgaaagtcgaaatgtttctgaagacatatggcacatcaaaacccacaaggtacacattctccgaagttaagaagatagcaaggcggttcaaggacaaattgggccatggtgcatttggaactgtatataaaggtgagctactgaatggagttcctgtggctgttaagatgctagaaaactctgtaggagagggacaagagttcatcaatgaagtcgcaaccattgggcgaattcaccatgcaaacattgtccgcctcctaggcttttgctctgaaggaacacggcaggctttaatatatgaattcatgcccaatgaatcattggagaaatatatattcccacatggttctaatatttcaagagaacttctagtaccagacaaaatgctagatattgcattaggcatcgcccgaggaatggagtacctgcaccaagggtgcaatcagcgcattctccattttgacatcaagcctcacaacatactgttggactacagcttcaatccaaagatttcagactttgggcttgccaagctatgtgcaagagatcaaagcattgtcacattgactgcagcaagaggcacaatgggctatattgcaccagaactatattctcggaattttggagcaatttcatataagtcggatgtctacagctttggcatgctggtgttagaaatggtgagtgggaggaggaacacagaaccaaccgttgagaaccaaaatgagttctactttcctgagtggatatatgagagagttatgaatgggcaggacctggtgcttaccatggagacaacacaaggcgagaaagaaatggtgagacagctagctattgtagcgttatggtgcattcagtggaacccaaaaaaccggccctcaatgacaaaggtggtaaacatgttgacggggaggttgcagaatctgcaggtgccccctaagccctttacatcgtctcaaaatcaacttgtgatttagatcatgagaccgcatcgccatggtttggactttggagaccagcaaagcaatggagcttggccagcatttcctataaaaaggcatcaccatggtttggtgcctgagtgagagatatgcttaatccacatatcagaaaatagttcttagtgagctgaagcatgcacatatagtgtttgattattaaactaaactgggcaaccagatatatgatatatcaccatgtactcttgtaatttgcaacatatctcaatggatttaatttgcaatataataatagttggaagatgacaactaaattaccttattccatcgttgatgctagtccactaatcatccttgctgaacaccaacaataaggtcatatttactcccagtgctgcattttcttttcaagataaaaaaagaagtgctgcatcatccagaagaggaaaaaaaataaaaataacaaaggaaggaagctaagcaaagggattattaccaaggcagcgaggctctggatggacatggactaataatgtgggagacggaggtggtgtgagcgacttgagaagacgaaacatgtggcatcaggcttggtggattcgaccggatctttgccggccgtcagcgccaccattgaagacacggtagcaacaacagatggcgccatggcggtacgggcgacggcgaggcttggtcacgcactctcgcatatgccgggaggaaacggcagcttacccatctgtctacggaggcgagaagcggcggcggaggcggctcgcggaacggcataccgccgcattaaccggagctctcgccgggaatagtggtgagggacggaggaagaagaaggggatttttttttttttgttggagagagggagaaggggatgattgctcggccacaggccggttaggatggcccacctaatcccccgcggcccatgaacggtggattgatctgacggttcacatgtagcccaattcacgagcaaatataatgcggaataagttcaccagaggtccctcaacttaacagcgtgatttttttgaggtcccttaaccacaaaaccagaaatgtctacccctaaacttactcaaaccgttcaccagaggtccctcggcggtatttttgcccggttttgctgacgtggcatcctagtcagcaaaaaaatttaaaaaaagtacgtagagcccacatgtcagctgcacatctttttttcttctcttttcttctccttctcttctcttttcttctctcccctctcttctccttcaggctggcggcggacgcagctgcgatggccgtgctcggccgccaccaccgccgtacccccgcgggtggccgacgatgctaggagaggcaccaccggcgggagaaggggaagaggcagaggaagagattgtttcttggtcgccggccgcctccccctccctcccaaactcgctggccgccgcgctcgctcgccgctgctctgccgcgcgctcgcgctccgctactctgtccgcggcctgctcgcgctccactgctcgacccgccgctgcgctcgcaccttccgctgctccgttgccacgctcgccctcgttgcgccgcccgcatccgtgctcgccgctccgccgccgcgctccgctgcctccgctcagccgccggacgaccgcaccgcgtagcctcgcccatggcgacgacgacggtagagagccgatgacgacggcggccacggcgcgcggctcctccgtccgcagcctgaaggagaagagaagagagagaaaagaaaagaaaagagaagaggagagaagaagaaaaaaagatgtgcagctgacatgtgggccccacgtgttttttaaaattttttttgctgactaagatgccacgtcagcaaaaccgggcaaaaatattgccaagggacctccggtgaacggtttgagtgagtttaggggtacacatttctggttttgtggttaagggacctcaaaaaatctcgctgttaagttgagggaactccggtgaacttattccaatataatgctccaacttatattcactggagccagcagccagtactccctccgtttcatattagagatttgcttcagtccagcaaaaaaaaccttgagataccggtgtctcgcagtactaaatcgtttttatcttagatatagttggcaggatgggcattgttacctcctttcacttttttccgaattttttttgaaaataatattattttaatggaaaatcgcaaaattataggtcggctagacgaaatcgcaagtttagcgccctgtcgaactggggcagttcgataggtacccctgtcgaactggggcagttcgacagggtactgtcgaactggggcagttcgacagggtactgtcgaactggggcagttcgacagggtactgtcgaactggggcatgctagttgtccaagaaaaaaaataaaaaagtacttgctacagtgcccgatagggacgtatcgaacagggggagttcgatagggcgcgtggcatggacgtatcgaacagcgcaagttcgataggcagtgtcgctacagtgccgatacagtgtgcgctacagtgtgctacagtgtttttccttttttttaagttattttattacctgtcgaactggggcagttcgacaggtaccctttcgaactggggcagttcgacaggtaccctttcgaactggggcagttcgacaggtaccctttcgaactgcctccgttcgacagggtgctaaacttgcgatttcgtctaactgacctataattttgcgattttccattaaaataatattatttccaaaaaaaactccttttttcctagtcaagtttgactaagattataaaaacaattaggaacatctaaaataccaaactagtttcataaaatttaacattgaatatattttgataatatgtttgttttgtgttgaaaatagtactccctccgtcccaaaatataagcatttttagcatagtgtcaagtcaaacatttttaactttaactattaataggaaaaaataaaaaaaaagatctatcaagtaaaattgatgttactagatttattattaaacaaactatcgtaatatgcaactctttttatttaaaacattttacttttatagatattgttggtcaaaatagtatctcgaagaccgtgtcgaaatccaaaaatgcttatattttgggacggagggagtaatatatttttctataaacttggtcaaacttgattaagaaaaaaaaatcaaacgacttataatataaaacgaagggagtacaaaacacttgcttatttatagtagtatttcatacaaaaaaaataaatttatgcattagtatctatcaattgttggatccatgaatatggaataataacaaccattatttatgaacgctaattgctagctagatacatcattttcatcacagcctaactactggctaattcagctattccatcgtcctcttctgaaattgcagaaagatcggaggagtgaaagtaagaatccatgacttgtggaggtggcatgccatccccatcgcagaaaaatggtctcagaggcacttgcagcgcatccacacccccttcgagcatctctattgcctcactcatcgtcggccgatcgtgtgatttcatctgaatgcaccacagcccaacaaggcacaacttcctctctagctcatgcatgttggcaaagttggatatctcatcaacttgttgatctgctattagcttatcataaacccatgatgggtagtatgccttacttgcactggaatctgcatttggatctgcattccttcgtcctccgaccatctcaagcagcaacattccaaaactgtaaacatcagacttgccagatatgatgccaaagctccgggaaaccatctcaggagccatataacccactgttcctcgtaaagccctatctgacacaaagctcttgtcccttgggtacagtttagcgaggccgaaatcagcaacttttggaacaaagttatcatcaagaaggatgttgtgtggcttgatgtcaaagtgtagaatctgcatatcacacccttggtgcaggtagttgatccccctagcaatgcctagagcaatctcattgagcttgtcccatgagaatcttctctcagatgagaagatgtgtttgtctagagatcccctaggcatgtactcgtaaaccaaggcccttctcatttcctcggagcagaaccccaccaaacgcacaacattaacatggtgaatcctaccaatggtggcaacttcactgatgaattcttcgccgttgcaattagagtagccattcagtatcttgatagccacatggagatcacccgggagcagcacacccttgtatacagaaccgtagcctccttggcccaacttttctctgaaatgccctgtgattgcgataatgtcggtgtaggcataccttgtcggaccgagcatttgttgcattcggagaaatttctcgactgcatcaattgttatcattcttttcaagtacttttgtgcaaggaaaatcaatacaaccaagggtgccaacagatacctgcatggtgctgcgtacacaagttcgatcggttggaatcaagaaattgtaacatgcgtatataactagatgaaacactagaaacaattgagatgatgtgggtttataagaaaagatagaaataacattaactattaatgggataaattatatagggtagggacgtagggtcctggtcgatgacttacgtacgtgcaagcatcgtccagaacatcaaggcatacaatattatgcccaagagtatattgtatggcgatggaattttagcagttgcgcaatccatgaaattttcagtcaccgaaagactaaaccaatctgaaagtttgcctataccagtcgatttgctgcatgcaagaacaaagacggatagattcaggcatatataaatggaggggaggtcggaggaatgtgcaatcagatattatgtcaagatcaggaactcacggaatcgactccattaggcaatccttgaagcttcgatttctatggtgtctgaaaggaaattggacgcggaatcctttcctcatgaattttactacgtcttcataacttaagctatcaactgctggtgctacacgacccataccatccaaaggagtcatggctaggtaaccacaggaaggctcgaggttttcaatgtaacaggacaatctgccagtcaagacataaacgaaggagctgctggtgcccatgcaagcaacaggactgtacataacattgttgtttatttccttggaacagttgacaaagaaagaccaccaacgtgaagcagggtccaattcgacttggatgttgtatggcgatgattcttcgtcgtcactactaacatcatcatagtaataaggaatgcgtttccagcgaggaagagggcaattgttacgtgaatccgagatgttggcgtcgacaacccagaaggtggaatcactgtagtcgatgcctgtcacaaagtatgttccgttgtcgatctgaattgtagccttgtcatcggtgcaagtcagctcatacgatgcaacaccgcactcgtagcctcgccggtggaaaggagacgcgactttgctaagatggccgcaggtgaacggagggcatgcaggtattccatgaattaaaggccattctatatccggatctgggacgacaaatcgaagcacacacaggacagagaaaacttgcagggcagtcgagcgacggaagaacggaccaggaatcaccatggtgtggtgtagcagctagcttagctagttcgcccaagcagagcatgcaggagctaggtagtgacacggatgatattacaagtgtctatctccgcgcggtgcgtgcactgtatgtaagcagtgtaactagagttttccaagcaaataaatttagctaaaaagcaacacttcatgtccttgactgtgatgctgttgacttggaagtctttgatgacacgaagcagattagtctaaggcgtagcattcagttccacaagagtctaccgtgctgcatcggtcaccgtttattgatgttgccgaaaaagattggtcaaagtgcacacattaccagtcgcccgctatcacgagccttatcattaggggaacagtgcttcacgggttaatttcaaaagcccccaaagctaacatagtgtattcttctaaaactatcttaacaggacgcgactacaccgagagtgctagctatatggtgctaaagagagacacctttctttccaaaaaaaaaaagctacttatacactcaatatctatgtatttttttccttcttagagaagtttctcttaaattacttatctgatttataatccgattacgccgttgtgtttattgcaattaaatctttacaacaagatctcacatgattatattttgatgaaaaatcacaaattacttttatgatatgtctaaattacgtttacatttcactaagttacttcttaaactataaaagtaaattcagtaagtctaaaagtaatttatatatattatagaagtaacttagaacaaacgaagataactttggcatgttatttgaagtaaatccgttgtatagataaaaacatgactctatctaaaaattaaattaatcagcacaaattatggaatttactaaaaagtcatattttatccctacaacgaatttacttctaatgtcgtgacaaagttacttacgttttgttttaagttacttttagaatatatgtaaattacttttagactttattgaatttacttttatgtctaagaagtaatttagtccaatcttgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaagaaaaaccctaaaagaagtcttctttccccccctttcccttcttgggccggctcggcccacttctctccctccctctttctcctctcccccgcggcccatcggcctcccccgcgcgagcgccgctgacaggcgggcccgcccgccaccctcgctgacgggtgggacccacctgtcatcgcctacctcccgccgcgccgccgccgcgcccgtgccctagcgccgccgccgccgcggattccgccgcatcccgccttccccgcgcgccttaatgaggggggaatcattccccgcgattccctctcccgtttcccccgcttttccctctctctctccctcggattcgttcgaatcgcgcccgcaatcctcgccgacgtcatcaatggagcccgagaactccgcggccgggttcctttctctccggccgccttctctcccttccgacgctataaaatcgtccct

SEQ ID NO: 22856 - DNA, 1510 bp, Oryza sativa
tgcattaatcatgcatctgccggtgtggcttgctgagtactgtggttgtactcattctgctcaatccttcccctcttcagtaaaagaagctttgaagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaatctaaaagtaacttatatatatatatgataaaagtaacttatgtatataataaaagtaatttacaaatataatttttttttcatcgtaagtgaagatttaattgtaacgaacataatagcgtaatcggattgtagatcagataagtaatttgagaggaaactttatttgaacaagaaaaaggcacccacgtgaactttatttgaaaggaaaaagacatccccgtggatggacatcatgacgacgtgcacagttagacggctctcagatgcgtcgtgctatagagctaaaccgagaacgctctcgaaatagatttcgcgatcttaatagtatacttcctccgtttcataatataagccattttaacattgtccatattcatatagatattaataaatctaaatatatatatgaatgtaaacaatgctagaaagttttacattattaaatggaaggaataataaatgatgtatactgcttatgcacgttcctataaaaaggcatcgccatgcatggtttggtgcctgagcgagagaaatggttaatccacatatagtaaattagttgtcagtgagctgaagcatgcacatatagtgtttgattattaaactaaactgggcaactgggtttgtgatatatcaacatgtactcatgtaattctggtagctagcaacatatctcaaattctcaatgtatttaatttgcaatataataatagctggaagatgacaactaaattaccttattccatcgttgctgctactccactaatcatccttgctgaagaccacgataaggtgtggtattagctctcctatcccttcagctcaagagatcaatcccagtactgcattttcttttagaaaaaaaaaacgtgctgcatcatccagaagagaaaaaaaacaaaggttattagagcaagtttaatactatagtcaactaatagctctaaatcatttatagccaatgtaatagccaattcatacaatagttacatactatactattaattcttggtcctacctgtctgtcggtgatatgggaccgggagtattgcgcccggaggcttgaggcagatggaatcgcccacgtggcctggcaccttcggggacggtcgggcccgagggtgaggtgtccgccctcctctgatttccccgaggggg

SEQ ID NO: 22857 - DNA, 50625 bp, Oryza sativa
ccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagtgcagtgatgcttccgttccagaacttctcatgattcatatcttcggagtcaacctcggacaagttatcaacttcgtgtcatgcgtcgtaacctgcttgtcattactaggatactatgtttgtcatcataagaatatcatgcttgtcattcacttctaacttgccatcaactgtctcatattagctttcctggtctccgggtgatagctacttctgctatttgatgcaagggtcaaccactctaactataagttatgcttcccaagagaaccaatttatcccacttgacatactttgacgtcttcccaaatagctttactgctggatttgttattgtctaatcattatcccgccaaatctgaggcttcactgttacatgtgattttaaactgacctctgcagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttactcaatgacaaggtgactgttgtgggggggggggggcaattactatcaggggtcttccgtgagcgatgcagagcatgtttctgtttatcaatcacctttcggcccacttctttcatgctagagaacatctttgccaatctctttttatcaatcttctttcggcttatgtctaacaggtggtattctttaatgtggattgcggacgcttctggggacgatgaggtcctttggcttgctgcctttcggtgaaaccttgatgtggttcgtcaaaaagctgtactgactaccttcagggaaatacattgcctgctatttgtatctataccactagggtttaattggcgatgatcatccttagtgcttcctcgagatggggagcatccaaattgttcttctgccacatcacctttgacccttttctgatacctgatcgactaattaccaaccatcgactactatgttctcaaacattgatgtctcctggatctttgtaactgtttgcaggtatatccgaacttatcaatgtagaggcatggcaggtacccttatgggtttcatccaacaatccttatcttgatctgtaaaaggcgtatcccaactcctatcctcaactactgtctcgttggctttttgacccaacacagtttaattggttttcttttccatcaacaggttggttattaactcgaggttggaacatagttcctctgaaatgagaccctaggtctcctatgtcagtaaacaattatacacatgatcacatatccgcatctttcaaacgaatcctcatggaacttgtctgtattacacatttctccctcattacatgaatacgaggcactaccttaaacaaaaagggacggtgcttaacatcggtacattgtattctcaatatgaatcatccataagcatagcaagctcactgtttatagacatgaatatatttatgtattacatggttgctgcaaactttcgattacaccatgataagtagcggactgaaaaccacaaacatggctgctcattttgattctggagagatatagctggcattgttccagtgactgcatccttgattggttctgtgatgatgtgataggactgcataatgctatcattcacaggagaaagcggatgacggtcttctgcttggtatcgccctccggaggttgattgctcttggctcggcctggagtaggtcggggagagacacaacttcttccatctacgacaattcttcgctgaggctgtcgatgcagagagtggttgctatggtttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggaataatgcccttcttcactgcagttgtaacaaacaataactttcttacactcgggttcttcatcttgtacttgatttctcagctgctgtattggaacttccaaaggtacaacgcagatactggcccctgtcttgtcagctggtggctggggctgaaattgagcattgacaccttgtggtagtgcattcattggaattggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtgatcttggcggggatttgtgttgccttgatgcttctctccgttggaactggcgggttggttggccatcttctttgtcagcagaaaactgaattgacaatcttttggtacatgatcagttccttcacaaaagaaacaagtgatcctgctcgttggacacctgtcgggtagatggtcttcctcacaatgaacgcatgtagaggcacacgagctggcaacatgaccgatttctccacaacgagggcatgccttaagttctacttcatcttcatcatctgaggagacttgatctgaatcttcactatcagacactctacctccattagctaaaagatgctctgtcaactgttgtgcacctcggaaggaatttcttctctgatgttttgtcattcctggtggaggccattccgtgctggtaatgatcatcttacggacttcatcttcggttcgcattggtgcttttcttttctgctgaggacagttccttgcgtagtgcccttgctcatcacacataaaacagatgatacttgcttcttttgggtcaacatgtggcatggcatgaggggccttctgggatgttggcggtgcgctgacttgtggtgtgagtgcttggactgcctccaactgtacttgaggttgcatctgactcgggttcaaaattggcatccgatgctgctgtagtatctctataagcaatttgttctggttaatcaggtgttggaccactgccacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaacacacgactaacaacactaccctatagggtggcttaggttctacgacgggttctccaagatctttcactcctgcttcacagctggcttcactgcttcctttgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaaggaactttcgcaaataatttttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtataccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggggggtacaagggaataataataggggttaggttttgcagtaaacagcatttaaaagtcacttagttgcccaaagccattttgtaaagacgatcctagagctacacagtattattaaacaaggccgtgaaccctcacgagcctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacatctggcatgcacccaaaccccaccgaaaacaggttttaggggttttgaaagaggaagagaggtgtgtgtccaattccaacataagccaacaattccatagtgtccaaatgatatgagaattcccaaagtctaaagttataaaaccacctaaggttgcctaattattcagcgaagcatctacctaaatttatactagtggaaccatgaatagagtacccactagttggggtttttattttcctagggtgaacaaggtaataataacaatagcaataataatgtcataacaaaggtaaataggcatggctaaataaaacagtggtaacgcgggaatttaaacaaagcgataatgcaataatttaaatcaaaataattttataaactgggattcaatatgctcaagggtgatgtgacttgccttgctcgctttcccaaacgacggcttcaacttccacgaagagcggatcttccgaagctgcagcgtctacacgaccgacggaaaagaaaaggcttttactctactaaactccacataacagcagaaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaactcatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacctggcagccgcgagggcgcgcccgaaggcggcctctccggcacggccgacgggagcggcgcgcccgcgccccgatggtcaccgccggcgaccaccggcgcggcggagcggcgcccgagagagcggagagaaggggggaaagcgaacggcggtcttcggctcaccccgggacaacgacgacgacgagaacggcggccggagtggaggaaagcggcggcgcggctcgggatgacgatgacgacggcgctccgacggtcggcgagcgaaacggaggcgcggacgaggtcgacggcgatgcggcgatgccgagggaggtggcgccgagccgggaggaagaccggagcgacgacggcggcgaaccggagcggaggaaggcgacggcgcggttcgggatgccgagggcgacggtgctccggcagtcggcggacgaagcggagcggcggacggggtcggcggcaacacggcgaagcggatggaggtgtcgccgagtcgggagggagaccggagcgacgtcggcggcgagccgaaggtcgacggcgacggcggagagagaggagcacggcgcgagcacgaatccgacggcgagagcgagcggcgagcggcggaaacggaagagcgaagcacggggagcaaatatatagcaacgggagggggagagcgcggccggggagagaggaaaccgcgcgcggagatctcgggcgccattgaagacgccggcgaacttcgcggggtgaatccggacgaatccgagggagagagagagggaaaagggggggaaacgggagagggaatcacgggggtgattttccccctctttaatgcgcgcggggacggcgggaaacggcgagattcgcggcggcggcggcgctagggcacgggctggcggcggcgcggcgggaggaaggcgatgacaagtgggtcccacccgtcagcgagagtggcgggcgggcccgcctgtcagcggcgcgcgcgcgcgggggagctgatgggccgcggggagaggagagagagggagggagagttgggccgagccggcccaagagaggaaggggggggagaagacttttagggtttttcttttttataaaccttttcaactttgtttatttcttctcaattattatttgtgctctgaaaattccactaaaatttgagggctccttttagaccaaggagaatttaacaaaaattctccgggtcacatttgaatttttcttgtacgtattttaatgtttgccaatttcttttcgaattttaattaattctattattccttttagaagatgatttttattttgggatgaatttatcaggacgtgacatttatgtaaagaagaaaagtccagtttaaaaagggaagggtacatgtggtatccccttaagagataaaaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcactcgagagagtcgaaaaatccgcagcatcgccagtcgcgggtggtgcaggagaacggcgagatggggagcgtcgcctcctcgtctacggtgacggcagcacgcctcagggcgcgcttcaggctgttggcgcgctcctacgtcacccgcctgtcgtccctgacccggagtctccagcccagcgatggctggacgacgtggccaacttggtcatgacggcacagcagcgcctgggtgctggtggacggtccgccaccaccaagacctccggcgccgccactaccggttccgcgtcgtcgagacggagggcgcggcgagcggcggctgttgcacgccattcggctgccactccctcgtcggcacctccgactcgggaggatcggcatggagagccggatgcccgcctcgacatcgagcgtcggcgtaatagccggcgtactccccgcgcaacggagggcgcctcttcgtccagagtgtcacctcgacagggacgtgaggaccagccctccatgcccccggctggtggtgtcggctgtagagcctttgtggcgagtcttcggaatgtccgttggcccccaaggttccggcccaccatcaccgagaagtatgacgggagtgtcaaccccaccgagtttctccaggtctatacgaccgggattgaggccgctgggggtgacgacagagtcatggcgaatttctttcccatggccctgaagggacaggcgcggggttggctaatgaacctgccgcccgcgtcggtccactcctgggaggatttgtgccagcagttcaccatgaactttcaaggcacttatccacgcccaggtgaagaagcggacttgcacgcagtacagcgaggggatgatgaatcacttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgttccgcgggccacccgaaaggggaggcctgcgagcgacaaaaagaaagaggctggtactcccagcagggagcgcccagccagcaagtggtgctccgtccacaacacctccctccacgatctcgcggattgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgatgggggagcgtgtgctcacgtttctcaccggagtttcaaggccatgaggcgagagcttctcgccgcggcccctactcatgaggcgacacgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctatccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacactgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccattctgtgctaacttggcccgggagcgagcggggaggagaggcccccgagtcggacggtggcctacggcccctgacgaccggagtcggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggcccccgagccgaacggaggccagaggcccctgacgaccggagttggccctttgcctgcttgtccgacgatgccaggagcccccgacccccaggacggccccgaggccactgagggaaggccgcccctttcatcctccgaccccgaggtcatcggcacagaagacaagtgcgccccgaaaggccacttgaatgaagaacgccccggggatacggcccctagcaaagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttatcccctcggtcaaatcttgtataatcgagagggtacaggacgggtggtaaaatgggcaatcgagctttctgagttcgatctgcactttgaaccacgccacgctatcaagagccagaccctcgccgattttgtggcagagtggaccccggctccagagaccgtctcaatccccgaggccagcacgaactcctcgcagctgcctcacaccacccactgggtgatgcagttcgatggttctctgtccctccagggtgccggtgcgggggtcactttgacctccccgaccggagacgtccttagatatctagtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacaccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtcctggcctcgggacccgaagggagcgctccaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctggggacttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttaccagcggtgctctgggcaaaccgaaccacaccaagccgagcgaccggggaaacgcctttcttcctcgtctacggcgcagaagcggttctcccatccgagctcaccctgaggtctcctcgggccaccatgtactgtgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgtacggctggccacgggcgacggcactgagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccatgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaatgaaaaagttggagattggcgggggcctgggggctcattccaatgcgcccgggtcgccggcctcgtcgccaccgtcgtcctcaccgctggcgtcgccctcctcgtcggagctgagggcgaacgcgagccgaggggccgacccctcgaagctttggacgatatggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtagagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggatgcattccagattgcggcgcgcctgctcctcctgcgctgccttgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctgatctccacggcgccggcatgatcttccagcgccatggcacgggcttcaagggcctcttcgcgccgtcgggatgccgcttcagcctccgttgctcgctgctctcgggcagcggcggcgtcaaggaccccctgggcggcgtcgagctttttctttagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcgagccgccccggaggttgtcgcctgagcgtcacccgagggagtgggcccgagcgacgcgccggcggtcttgtcgtgaaccgcctcggaagacgccatcgcctcagcctggcgagcccgggcggtttcctcccgagtggcttcttcagcctgacgagcccgggcggcctcctcccgagcagcttcttcggcttggcgagcccgggcggcctcctcctgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggaggaacgcgacgggacatcgctgaagcagaagaaaaaaccggaagacaaacaaggtggataagagaaaacttgctgattgggataaagggaagatggttgtgaaaggcgtgaaacgaacctgcgagggggtcggttgaacgaccaccttggaggggaaatcaggtttccccgggatggttccgtctcccccgtcttgcggagccgcttcttcttgcgctccgtctcgggctgtgatgtcggcgcggccccctccgggcgcctgcggctggcacgcaccgccccgtcccctcggggaggagatgggggaggtgttcctccctgtttcctcttcccccgggcgtcggcagggcggttgctccccgagcccccgtcgcggggcccagaagcacggccccctcctggggttgattcttcctggcggctcccgccggcgccgtcgtggcccttaggagccacctcctctgaggccccgacccccatcatgatggtcagaatggaggcgcggtctggatcgcagcagagggggaggagtccttgaggaataagagacgcctccatggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatccactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacactggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcggattccggcatgaagcgacgcggcagcccagcctgcctctcgcccacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttcccatcgctgagcccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgatcgccgaccgaagcgacgttaccatatctccagacgaaacgaatctgcacgcccagattcgagcgctgctcaagtgatgtggcagtcttgaagagaccgcccatgactgacggccaagacaccattaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccaggcttcatcctaaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttatgtaaagaagaaaagtccagtttaaaaagggaagggtacatgtggtatccccttaagagataaaaggaggaccatgcccacgaagagaaggggggattttgattttcccgggagaggagagggctggttgatattttgtaacttgctcttacacagatccaccaaaaacacaggagtagggtattacgcttcccagcggcccgaacctgtatacatcgtctgtgtctcgcgtttcttccgggcacgcgatctttccacatacagagagagcttgagatctcaccctaagcccccggccgaactggcaaaggggggtctgcgcggtctcccggtgaggagccacgagctccgtgactgtcatacacacattacgtctcggagtccgtgctgcagctgctcttttctctcttccttttatctctttaaaatatatttatagttggcttatagtctgctattgtatccgctcttactgctcttagtaccagtactaataatgtgagagacggaggtgggagagacggaggtggtgtgaggaacttgagaagacgatacatgtggcatcgggcttggtagattcgaccggatctttgccgaccgtcagcgccaccattgaagacacagtagcaataagagcaagtttaatagtatagcccactactaactttaaatcatttataaccaatacaatagccaattcatacaatagttacttattatactattaatatctggtctcacatgtcatacacacgttacgtcttgaagtttgtgctgcccgctgctcttctctctttttttatctttttaaaatatgtttatagctgactagtttgctaacctgctctaacagatgcgccatggcggtacgggcgacggcgaggcttggtcacgcactctcgcatatgtcaggaggaaacgacagcttacccatctgtagacggaggcgaaaagcggcggcggacgcaaaccgccgcattaaccggagctctcgccgggaagagtggtgggggacaaggatcggaggaaggagaaagggatgtttttcttttcttttcttttgttttttttgagagagagagagagagggagaaggggatgatgattgctgggccacaggttaggatggcccatctaaggccttgcttcgatggcccacctaatcccccgcggcacatgaacgatagattgatcggacggttcacatgtggcccaattcacgagcaaatataaggaaaaagtacacccaaggtccttcactttgtcgtcgagatacaaaatcgtcctcaaaccgcaaaaccagataccggacgtccctcaactaataaaaccattcgctttagatccctcggtggttttgaccccgattttagcctacgtggcggctgagtcagcgtggaacctacgtggaccccacatgtcagcgtgtcacgtcaactctctcttttattgcagtagcagcaacagcaagcagcagctaatctcgccggaagaaaaaccaaagccagaggcgacacgggagtcgtcgtgcttcggcgacagctcggtcggcatcgccgccgccgccgccggtgactctgggcgcggcggcgcgctggatcgcaagctgcaggcggtgaccacggcggtgtacggtgcctcgttgcactccgggaaggagctcctcatccgggtcacgtggacgccgaacgctgccggagccaccggcctcgccgtcgccttcgacgacgcgctctctccgtcgtcgaggtgcgcccaccatgtgctgcacaagaagcgcgggagcaggtcctcgctaccaccaccggcacggctgtgggcgtccactagaacaccgccgaggccacgtacgcgttggattcgtcgtcccctgagcccaccggcgaggcggcgactactacctcatcgtcgttgctgacaccgaggtcacgctgctcctcggcaaggggtggcttctgttaaatatgtgatccgaattttgggcccacaatatattcggattagtttcctaataagagtcctattaggtgtctttctattatcccttatatatactcttgtaagccgtacgggaatgggtgacgttcccaatgtgattcccctacgtttgtaatcatctcctctatagtgatcattgccggtcggcgcccgtggtttttttccgcaagggatttccacgtaaaattcgtgtctccgttgtgcatctattttcataacaagtggtatcagagcattggagatcgatctactgcagtcccggccaccggcgattttttccgatcgaagaaatcgatctaatcggcggtacgcgtcgtcgtattcgttgttccgtcgaaattctgttcggcgaaatccaatccaaagcggagtcgccatcaactccgagtcgacgtcgtccttcctgccgtgcgcgtgtcagaggagcagcgcaggcgcagcagaagccatcggcagcaagcagccgagcggcacaggaaaatccatccatcacaaagcgcacgcataccgagggaaattagggcagcagccgcctgttggccctgttcacatgaagtccaaactcacgttgaatttctacgcgcacacagccaatctaccaggagatttacagtacttcgcttggtgcacacaggaggtgtaccatagttcgtgtttttttctagtttaccctaatttcttactagcaaatttcaggattaattcccatggcgagtttgaagtatgatctaccgctcctggaccgagacacaagattctcactttggcaagtgaagatgcgagccgttcttgcacaacaagacctcgatgatgcgctttctggatttgataagaggacacaggattggtctgttgatgagaagaaaaaggatcataaggttatgtcatatattcatcttcatctatctaacaatattttgcaggaggtgcttaaggaggagacagccgttgggctgtggttgaaattgaaacagatatgcatgactaaggatctgaccagtaagatgcacctgaagcaaaagttatttttgcacaagttgcaagatgatgagtctgtgatggaccatctctccgctttcaaggaaattgttgctgaccttgagtctatggaggtaaagcatgatgaagaggatttaggccttattttattgtgttcattgcctagctcatatgcaaacttcagggatactattctttatagtcgtgatactctaactttgaaagaagtttatgatgctttgcatgccaaagaaaagatgaagaagatggtaccctctgaaggttcaaattcacaagcagaaagcttggttgtcggggtaggcaacaggagaagaacacaaacaacaaatcaagagataaaagctcaagtagctaccgtgggagatcaaagtccagaggcaggtataagtcatgcaaatactgcaagagagatggacatgatatcttcgagtgttggaagctacaggacaaagacaagagaaccggaaaatatataccaaaaggtaagaaagaagaggaaggtaaagccgcagttgttactgatgagaagtctgatgcagaattgcttgttgcttatgttggttgtgcacaaactagtgaccagtggattcttgatactgcatgcacctatcacatgtgcccgaatagggattggtttgccacctatgaaactgtgcaaggtggtactgttttgatgggtgatgatacaccatgcgaggttgcaggtattggaacagttcagatcaagatgtttgatggttgtatcagaacattgtcagatgtgcggcatattccaaatttgaagagaagtctcatctctttttgtactcttgatcgcaaagggtacaaatattccggtggagacggaattttgaaggtaactaaaggctctcttgttgtgatgaaagctgatattaaatctgccaacctgtaccatctgcgaggtacaactatattaggtaatgttgctgcagtttctgattcattatctaattccgatgctactaatctttggcatatgcgtcttgggcatatgagtgaaattggtttggcagaattgagcaagcgaggattgctatatggacaaagcatcgggaagctcaaattttgtgagcattgcatctttggcaagcataagagggtgaagttcaacacatctacacataccactgaaggtattcttgattatgtgcattctgatttatgggggcctgctcgtaagacatcctttggaggtgctcgttacataatgactatcgttgatgattattcgcgaaaagtttggccttatttcttgaagcacaaatatcaagcttttgatgtgtttaaagagtggaaaactatggttgaaagacaaactgaaagaaaggtgaaaatccttcgtactgacaatgggatggagttctgttctaagatatttaaatcatattgcaagtctgaaggcattgtgcgtcactacaccattcctcacacacctcaacaaaacggcgtagctgagcgtatgaacaggacaattatatcaaaggcccgttgtatgttgtctaatgcaggtttgcctaaacagttttgggcggaagctgtttccactgcttgttatcttatcaatcgatcacccagttatgccattgataagaagactccaattgaggtatggtctggttccccagtaaattattcagacttaagagtatttggttgtactgcttatgctcctgttgataatggtaaattggagcctagagctattaagtgcatttttcttggttatccgtctagtgtgaaaggctataagttatggtgtcctgaaaccaaaaaggttgtgattagtagaaatgttgtcttccatgaataagttatgttacatgacaaaccttctactaatgttcctgttgagagtcaggagaaagcaagtgtgcaggtggagcacttgatcagtttagggcatgcaccagaaaaagaagatgttgctattaaccaagatgcacctgttattgaatattcagattcttctactgttcagcagtctccaaaatgttctattgcaaaagataagcccaaaagaaatattaaacctcctcgaagatatattgaagaagcgaacatagttgcttatgctttgagtgtgacagaagaaattgaaggtaatgccgaaccttctacatattctgaggctattgtttctgatgattgcaatagatggataactgctatgcatgatgagatggagtcacttgaaaagaatcatacttgggaattggtgaagttgccaaaggagaagaaacctatccgttgcaagtagatcttcaaaagaaaggaaggtatgtctccaagtgatgaggcaaggtacaaagcaaggttagttgctaaaggttatagccagattccaggtattgatttcaatgatgtcttttcccctattgtgaagcatagttcaattcgcactttacttagtattgttgcaatgcatgatgatgaactagagcaaatggatgttaagactgcatttttacatggggagttaggagaggacattaatatggagcaacctgaaggtttttttgttcctggaaaagagaacctagtctgtaggttgaagaaatctctttatgggttgaagcagtcacccagacagtggtataagagatttgactctttcatgctttctcagaagtttagaagatccaattatgatagctgtgtttatcttaaagttgttgatggttcagctatatatttgcttctttatgtcgatgatatgttgattgctgcaaaagataaatcagagatagaaaagttgaaggcacaattgagtagtgaatttgagatgaaggatttgggtgcagcgaagaaaattctcggtatggaaattactagagaaagacattctggcaagttatatcttagtcagaaaggttatattgaaaaagttcatcatcgtttcaatatgcatgatgcaaaaccagtgagtactcctttagctgcacatttcagattatcttcagatttatgtccacagtcagattatgatattgagtacatgtttagagttccttattcaagttcagttggttcacttatgtatgccatggtatgttctcgtcctgacttatcacatgcattaagtgttgtcagtagatacatggctaatcctggcaaagagcattggaaagctgttcaatggattttcagatacctacgtggtacatctagtacttgtttgcagtttgggagatctagagatggacttgttggttatgtggattcagattttgctggagatttggataggagaaaatcgctcacaggttatgttttcactattggaggatgtgctattagttggaaggcaagtttgcaagcaacgtttgccttatctactactgaagcagagtaatggctatttctgaagcttgtaaagaagctatttggcttagaggtttgtacactgagctttgtggagttacgtcttgcattaatagattttgttccatgagagaacaaagcacattgatgtgagatatcactttattcgatgtgtgattgctgaaggtgatgtcaaagtatgcaagataagtactcatgataacccagctgatatgatgacaaagccagttcctgctactaagtttgagctttgctcaagcttggtgggtgttacagtatagtcctagagactatttggcgcgcggtgattttacctacatgaggtattttttggtgattgatgtttttatgcaacaagaggaaattcgtctcaaggtggagattgttaaatatgtgatccgaattttgggcccacaatatattcggattagtttcctagtatgagtcctattaggtgtctttctattatcccttatatatactcttgtaagccgtacgggaaggagtgacgtttccattgtgattcccctacgtttgtaatcatctcctctatagtgatcattgccggtcggcgtccgtggttttttcccgcaagggttttccacgtaaaatttatgtctccgttgtgcatctattttcataacagcttcttcctgcatgtgcaatgtgttactaacaaaaaagttcagcttctctaattcgagttggtgattttattacagtgtaaatcatggtgtacatgaaagatataagtatgtctccagcctgacattgtatgaacttgggtaaatgcatgctgatgtgagcgttttctggttatctgaatcgcaatcaaatggcatagatagatactgaacatggttacatggaaaaatgatgcttacattgcctccagatagcttcactcagatcaagcagaaacgctttgcattctctgcaacgatgctatcaagtaatgactcgcatgcgttttccagcagatccagcaccagaaaaacattgtgcaacgatagctgtcccctccctccccgccgcctgccttctctttccccaccgccgccgctgccctctcgcgcgccggccgccgcctgccttctctttccccgtcgccgcctgcactatgacgcccgggcgacggactggttggtggggatggcggcgagggacggcacggcgctgaagccggtgctgagcgggttgtcgatgaagccggtgccgagcggtgagcgactccgagaggcgcgcgccaccgccgagcgcgccctcgccgccgccgagcgcggagggcgacgaccccgcggcggtcgacgtcaacctcgtccttgccttcctcgccgcccgagacggggacttaaacgacgtgagacggcctcgcctccgcctccgcgcccaacaccacggcgcccgcccgcgcggggccgcttcgccaatggcggcgacgcagcgtcaccgacgccattcgcgaccggctgccgccgccgcctcgcccggtggcttgctcctcagccgcccgccggcttgcccaaagaagtgaagagaaaagaagagagagagagagagggagaagggaaaggaggggaaagagggggaggcttacgtggccaggctggcatgtggagcccgtgtgggtcccacgctgactcagccgccacgtaggccaaaaccggggtcaaaaccaccgaaggatccattatgaccggttttgattagttaagggactccgaatatctggttttgtgattaggggacgttttttaactcggtgacaagttgagggaccttcggtgtactttttccgcaaatataatgctccaacttgatgactaataacacactagcaccagcagctagttgcttatttatagtagtatttcatacacggaaaaaattttaagcattagtaaatatcaattgttggatcgatgaatatggaataataacaaccattatttatgaacgctaattgctagctagattcatcattgtcatcacagcctagctactggctaattcagatattccatcgtcctcttctgaaattgcagtaagctcggaggagtgaaagtaagaatccatgacttgtggaggtggcatgccattgccaatgccatccccatcgcagaaaaatggtctcggaggcacttgcagcgcatccacacccccttcgagcatctctattgcctcgctcatcgtcaggcgatcgtgtgatttcatctgaatgcaccacagcccaacaaggcatagcttcctctccagctcatgcatgtcagcaacattggatatctcatcaacttgttgatctgctatcagctggtcatacacccatgctgggtagtatgccctgcttgcatttgagtttgcatttggatctgcattccttctacctccagccatctcaagcaacaacattccaaagctataaacatcggatttgtcagatataacgccaaagctccgggataccatctcaggagccatataacctactgttccccgtaaagccctatctgacacaaagctcttctcccttgggtacagttttgcgaggccgaaatcagcaacctttggaacaaagttatcatcaagaaggatgttgtctggcttgatatcaaagtgtagaatctgcatctcgcacccctgatgcaggtagttgatccctctagcaatgcccagagcaatctcattgagcttgtcccaagagaagcttctctcggatgagaagatatacttgtttagagatcctctaggcatgtattcgtaaaccaaggcccttctcatttcttcggagcagaaccccacaagacgcaccacgttgatgtgatggatcctgcctatggtggcaacttcactaatgaagtcttctccattgcaattggagttgccatccaacatcttgatggcgacatgaacatcacccgggagaaacacacccttgtacacagacccatatcctccttggcccagcttgtctctgaaatggcttgtgattgctatgatgtccgtgtaggcgtacctcttggggcctagcatatcttgcatccgaaggaacttttcgactgcatcaattgcaatccttgttttccagtacttgcgagtaagaaaaatcatcacgaccaacggtgcgaacacaaacctgcatagcactgaatacgaaaaggctaatgaattttgcaatgcaatatgtggtgtgaccagctctgatactgtatactgtagaattgagtggaacaaaaatgcaaaagttaattaccagcaatccacttgacaagacacaaggtgtatattatgaagagcttatggtaaagagaatgatcaacgccgcggatcatgtcgctgatggaaagacgcatgtcgaggtaataccgtctggatatgcctatcatgcatccccagaaacggaggtcaatagaaaggatgtcaatgatccggtctttgatgcctactctgggtaatggattgtcatggctatcagctaagctgcaagatcatttattggaaagagttaattaaacgggattggaggagaagagctaaacaaaatcggcccttttcagatgataaagtaaaggtttcgagattataaggaattaaggcgctcacctaacagactcgttgaggcaatctttgatgagaccataccaagtagtccaaggtcctccatatgtaggaaatttgacggcaaatccacccctcatggattttacaacatcttcatattcggacagattaatgctgttaccgttactgccaccgccgataggagtcatggccaagtatccacaagaaggttcgatgtcttggatagatggtgctccaaacgatgggagcatataataaacgtaggacgaagtcgtggtcaggcaattcatgggctggtatttgctactactgttcgtaattagttcctgcgaacaattgacaaagccgacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagtcgatgctactcacatagtatttccctgtgttgatccgaatggtggccttgccatcatcgctgctgcagtctagctcgtacgacgagacgccgcacctgcgagggtcgcctcgccggcgaaaaggatgagttatgtttgagagatggccgcaggagaaaggttggcactgacgatgccgtcgtccttggacatggacgacgtgatgatctgcatccgctaccacaagtgcgagcacacacaggacggtcgacaaagcagctgcttccattctagtgtaggctaccaagctagctacttgttgctcgctcggccggctcctacttataagtagtacgacgtacgcgctaccaagaaggggaaaacagaaaattgagtatacgtcttagccattaacgcataattaattagatattaattattttaaattaaaaaaatagattaacgtggcttttaaataacaatattgtatatatattgttttcaaaaaaattacaacggttaatagtgcggaaaacatgcgcatgaaaaacaagtaattttttcaatctttcagctcggccgaacctttaaagttcgaatttatattaggtcgatcttatgctataggttgtgtccattacatatttcttatttatattaagtcgaccttatgcgaccatcgaactcgttcgtcgatcaaagaaaaggcagtgaaagccaaagccaaagtacagatcaagtggccaaagccaaaactctcggctcacagtgctaaaagcagtaactaaacaggctactcggtagtagaatatactaccctttttatttttttaatgatattgttgattttttataatgtttgattatttgttttattaaaaaatttattacaaatatgtaaaagtataagttaagattataatttcttcgataataaaagcaagtcataaaaaatatatttatatttttagtaaaatggatggacgagcggcgtctgctgtcttaaaaaatgaacatacttgcgtgttgcgaacttttgactgtagtactgtacgacaacaaagctcgcgcgcgtgaattagcatttctgcgtgcgccaggcctaatttccacacgggaattaaactttactggccggtttcttcaattcttcatatgttaatctctcatgagattggacatgagtggactggagcaagtctacgatgttcaaggtcagtcctaggccggcatgattttccaaagcaccccctccgtttcatagcttttaactttttttacctgtcaagctctttcatagctttaccttttttttttactagtcaaactctaatcaaatttatagaaaaatacgacaatatttttaatacaaaacaaacatattatcaaaatgtattaaatattagttgtaatgaaactaatttggtcttttagaatttatatgttgctaaatttttttataaatttaatcaaacttaaaaatgtttaattaggaaaaagtcaaagtgacttgtaatatgaaaaacgacttatatagcacgaaacaggaagaacatacagcgcattgttgcttacaatgaagcacacagttacactatcctgagcccacatatatatatccgccttcactttatgtacatatatggagtacctacagactacagttatcaaaccaattgcttttgcacctatagagtcagagatcaggatgagtagcaaatttctcgccatgtatctcctgcttgctctcctcagccatggcacctacagctacagtgccaccacagcttcaggctgggaagaccaagacttcttcaggcattgcccagtgtcccggtgcagcgacggtggaccagagatccggttccctcacggcctgcaatccagcaacacatcatcagcatgcggcgcttcatgcgccaagctagcatgctccggccaagacaccatcctacatcacccatttctggggccttgcaaggtcacctccatagattacaaggaggccatcatgagcatcatcccgcttgtgtactcctcgtctccatgcccgcttcagaagctcatctttgacaatctacagccttacgactaccatagatgtaaattatacagctgggctcctgcaaaaatagtacgctgttcaaaagagttcacaccaaatggtacttctccagtcgatggctacgctttcatgaacaacgccgattatatcaccggcccaatctcctgccccagtgaggcaagtcacttctcatatttggtggatgctcggctatgcatgtatgtgcttcccttggactgcaggatcgtctccagaggctccattccaatacccggtccagcctactctgatatcggtggcccaacattcaaggaaagagcagaaaaattcatcaactttgctgagacgactgtcagttggtattctgatgacgaagttaccattaactgcacagagtgcgaacgtcaaaagcaccgctgcgcattcagctcacaaaggaatcgaacattctgcatgagccgcgagcatcacggtaccattgctaacttctcaaaatccaatcctatcaccctagttttatttcctgaactacttttctattttccactccctccgtcccataatatagcaatctagtaccggacgagacacttcatagtacaacaaatccgaacctgcttactgtttagattcattgtactatgaagtgtcacatctggtcctaggttgctatattatgaaatggagggagtagctattatgatttagccatacagtactagagtgctgctctcgcatcattaatcttacatgagatatactgcaaaattatttttgcaggccagtagtctgctcctagcaaccatctaggaagcttactagctagctttctcgcacattaagtcattattccttccatacaattccaataaaaatgtcccaatacttagtgaaatgaagatagaactatatttgttcgacgggcatcagtaggataatttgatatttgataataaaatctggaacttctcagagatattttcaggtatacaggacactagagcattgttacaaaaaggaccagaaagcaaatgatgaaataaaattggccaaaagtttcatgagaagtacggtgatataatgttacacacaaaagattgcacacataataactgtctgagtcttttgcaccaattaataaatagccagctttttatttttaaacaagcataaccagccagtttttatatgtaacaatctcatatactgttaagatttttcacgatatttacccaagaaacacaatttggataacatagagaagaaaaatcctccatcaacatatttagctcagcatcgtcacaaataacaaaaaggaaaaattaaagaacttcgagttgctagagttggtaaacggaccagtacacatgctagttcatacgcacttgatacaatccttaagaatattttctgaggaataaacacaaactaaaacagaaaagattacctaccaacagtatcaagtgactcatgaggccatagaagtaaacacgtcagaccatattatacttcagtcgctgagtccataggaatcacattcccttctggcattactgacttgtcagattttgtggctgcattttcgatactgtcctggttcatcctggaactgcaggagagccagttgacaaccaatcctggaaaaaaaaaagagaaaatgattgaatatcgatgtcactctggctcattctggagctgattttgctaatacactgaggtaatgtgctcctggaaaaatgaaatagtttgatggacccatatgaactatgaaaccatgcaagacaaaacaaaacacccaggagtaaccaaggtggcgtctggctgcctctagaattacaaagtagctcgaaagtgtaaataattgagactgcgagggagcacttgactgagaaagatataacctgagtattgcttttgttaactgatacaacaggagctgcagctagatctgtggttgcttcaatgaatgatcagtagatacaagagttgatatgtggaacccttgataagttaacccgcaatcaacctcaactcgctctaacatccttatctggcattctagcataatgacaaaattatcagagctagtatgcagaactggcttatgatgatactgctaactaagatgtaaggaaaaattcactattgcaaacatattcatataaccatagactcatagtgcagttgttcctttaaaactaaaactctatcctatcccactagggccatgttctgttgacatgttgtgtaactaattaactatgctggatctcattgttttttcaagaagtacttgttcattatcagttaaaccatcaatcaaatcttattatcttttttggtacttgcaggttcgagtgtcaaagtcatttcaggtactgctataattcaaacctaccctctattcattattcaaaagagagaagaagcactgttataacttatcagcaataaaaagttcttattgctggcgcttctgactcaatattttgctaaaaaggacactaccttgccttacccatcaggcaactacaatcagttgatcactagtccatagctttctatcctattccaatgcgctgatttcccatctctgtttattcagctacatcatcggcagctgcatttgttgttctttcattgatcatagccactgtgctctatatttcgctgaagtcaaggtatgacgaggaggtacatttgaaggttgaaatgttcctcaggacatacggcacatcgaaacccacaaggtacaatttctctgatgttaagaagatagcaagacgcttcaaggaacaattaggtcagggtggatttggagtgtctacaaaggagaactaccaaacggagtgcccgtggcagttaaaatgatagaacacactacaggaaatggagaagaattcatcaatgaagtagcaaccattggacaaattcatcatataaacattgtccgccttctgggcttctgctctgatggaacaagacacattcttatctacgaattcatgcctaatgaatcattggagaaatatatattcttgcatgacccaaatacttctcaagaactcctagcagcaaacaagatgttagatattgccttaggcattgcccgaggaatggagtacctgcatcaaggatgcaaccagcgcatcctccattttgatatcaagcctcataatatcttgctggactataacttcaatccgaagatttcagactttggtcttgcaaagctgtgtgcaagggaccaaagcattgttaccttgaccaaagcaagaggcacaatgggctacattgcaccagagttatattctaggaactttggggagatatcttacaagtcagatgtatacagttttggcatgctcgtgttagaaatggttagtggaaggaggaactcagacccgagtattcagaaccaaaatgaggtctactttccagaatggatctatgagaaagtaattactgggcaggactttgtacttagtagggaaatgactgaagaagatagactgaaggttagacagatggccctagtggcattgtggtgcattcagtggaacccaagaaaccgtccctcgatgacgaaggttgtaaacatgctaactggaaggttgcagaatatagaggtgccccctaagccatttgtttcatatgaaagccatgctgtgccataaatcatagtaatgttatgggagttatacacttatacttagttgacgtgttgcatagtaatgtctagaaattgcataatatgcaccttgactgcacattgataactgtatgaattatgaatcgtggctctttaccatgtaatgtaatacaagtaataagaaacacatcagttgatgtgattaccgtgttcagttgttgctatgatatatctccatcaaaccatggtgtgcagagtactcctggctgcactatttcagtaattcatgggtccgtagctagtggcttgcaagaaaatcctgaaaggaaattgaattatggcaatttttcccaggcagcacaaatataaaatatcgaagcaaagagtattatttttgtctgtttgtccgtgcgaacggccgactagggtaacattcataccctgaattcgtcactgaataaagaagtagattcatatcctaaattcctcactgaactaagaagtataataagtaaagttggcttggtcacattcctatccatcccattcaaaaagtcagggcccgcctatctatctgatggaaatctcaagcaaacaggatgctgctgggcaagcaatcgaggagctacgaatttgcaatgtgaagagatgaatgggcatggactcgactagtgaataagtacactttaataaaacttagcaaaaataatcaaaagcagaggaaacgggctacctttatcaatgcaaggagggggcagcgaactgaacaaccaccggatcaggagatctccccgagttctgtcaatcctgcggctcggcatggcatctcgcttggggcctggatttgcggctcgggtctcacaaggacgcagggagaactgaaggcgacgcatagaccgggcaacgcgcgttgacggcgcagtgctaagaagagacatcgccggggaagcagaggcggccgggagtcggtgggatcgccggcgacggcgaagggttcgtggcaagagagggaggaaaggggattccgtacggtttgcaaccagaaactaagctcggcctagggctagtaatggggccggccctaaagctcctgccgctaatgggcctttatttgcatttggaccaaaaaagacctgcgggaggcctgtcttctttctgctcgtggaaatttttataactgtaaatcgaccatttttataacttatagattttgtggttttttcacggaattttattttatagcatttacttttgaattactaagaacccgtatttaaaatttttatctacaatttttttaattgctaataagtcgtacaaataagcatatagataagcaaaatatgaatcggaaccgggaattgctagatttcagtcacgtaggaaagaacatagcaacagtgccgaccaacacagaacactagcttagctcgatttttgcatgcattcatacagatgaagcacaagataataaatcgtacaagcccacatatacgcattctacaggaatataggaataggagcatagaaactgcatctgtgtgactgtctacaatcatcacaggcttgagcacaacctgctcacgaaaagacatcaacacaccatacttgctagtactagctaattcaactcagtgatactctcgtcttcctcctcggagattgcagccagctccacctcggaggacagatacagcgactccattgccgggatgtagtcatcgtcacagaagaatggcctaggaggaatttgcaaacaatcaacaccaccttcaagcatctctatcacctcgctcatcatcggtcggtcacaagacctcatctggatgcaccacaatccaacgatgcagagcttcttctccaactcatgcatgtcggcggcagcggtgatctcacctgtttcttgtcgggtcagctgacggtacactcgtgatggatagtatgcctggcttgaattctccgcattcggatcagcattccttcttcctccggccatctccaatagtagcatcccgaagctgtaaacatcggacttgcttgatatggcaccaaaaccccgagagatcatctcaggagctatgtatcccactgttcctcgtgctgcgctcactgggacaaaactcttgtcccttgggtacagctttgcaaggccaaaatcggcaacttttgggacaaagttgttgtcaagaaggatgttgtgcggtttgatgtcaaagtgtagaatttgcatatcacacccatgatgcaggtagttgatccctctggcaatgcccaatgcaatttcatttagcttatcccaggagaaactcttttcagacgagaagatgtacttgtcaagagaaccctgaggcatatactcgtacacaagcgctcttcttatttcttcagagcagaacccgacgagtcgcaccacattgacatggtggatcctaccaatggtggagacctcgctgatgaactcttcccctttgcaatttgcgtcacccttcagcatcttaatggcaactcggacatcaccagggagtagcacacctttgtagacggagccatatcctccttggccaagcttgtctctgtaatgacttgtgatggcaataatgtcggtgtaggagtatctcgttggggtcagcatttgttgcaattgcagaaacttctctacttcatcaactctcatctttattttccagtacatgtaggcaacggaggtccacatcagcagcatcaccaggacgaacctgcatgctacaccataaacatgttcatccctgctgtagagaccaagtgtatgaacaaatagagcatgacgagactacaatacagcgaaaaaggaaaatgtaactgaaatttgatatgtgtgattgtcacgtaccagaaatgacccttaaaatccagaaagtttgtggcactaacatcaggagcacaacaaaagggtgtggaagttgagttgcatggcggccgcatatcgagaagtaagaattgatattagtaacaatgacgaagatccgatatactgtcggttctccattactgtcgctgcaagaccacgatgtcatgcatgagccattgtacagcaaagcaaatttccaagataatgttatttggcattggtaaatttcactatcaagaatgtacaaggaagacgggccaaagtgttcagttttaagtcccaaataaattgactcacctgatcaagccccttaggcagtcgatgaatcccccagacctgaaaggaaaacgaacagcgaatccttcactcatggatctgacaacatcttcataatttacatcctccagtgtcgcagccgcagtagcagttcgccaattctctagaccacccagagctaaaggagtcattgccaggtatccacaggaaggctcaaggttctcagctaaataagatcccagaccagttagcacatagacgaaagaagagttgccgctccggcaagccacaggcctgtacatgacattgctgctattcatttcctgcgagcatttcacaaaggtagcgaaccaatccacatcaggggacaactggacttggacacggcggtgtgaatcttctccaagcctgtagttttcattataaggagtctgactccaccgaggaagagggcagttgttagctgaatccaagcttgcatcgaccacccagaagtactgatcactgtagttgatgtcagttaccaagtatgttgccttgtcgatctgaattgtagcattgctgtctgcacaagtcagctcatatgatggaacaccacattcagcggggtcgccttgacgacggaatgggaaatgcacatagctaagacgtccgcaggagaaagatgggcacttgcctctcccctgaacctgatctggtacaacaagtgcaagcacagagaaggcagccatggcctgcagggcagcagaacgacgaaacgcaccagccatcgctacggtagctagcttcacaggcagtgcaaacaagcctattacaatagagaggggcctgctgtccaagctagctagctatatgcttagcccacatgtcagtgactttcaatatagggataatacagcagaggatctcaattgcaaatggacacgggtgggtaacaattacatggctgagagcagatgacagtgatggcattgactgacttggggaaggaaacaatcgagcctggatgtgacaaaagagagcatgtctccagcctcaatccattagagcatcagtatcagtaaagcagtgaaaactatgggattcaattcatgtggtctggtaaatttggagagagcaaataaaactggagtacctcatctggaattccagagtgaagacgagatgcacatttggactgaagctggtccgtcccatcatctgtcacaaaataattaggaagatcagtgtgcagaataaggctttcggagaactcttttacaattggatatggattggagtaaactatctatgaagaacttcacaatatctttactacacagggctgtgctgcagagggtcatttacaatagcttctagccactgccagcaaattcacagtttaagtttaacactaacaacagttcaccgttgcatggaagtgcggcttcattttctgatgacgccaggaatgcagtcacactaaaaaggactgcaacatgggaccacagaagtttcattgtactttgggattgctccaaaagtacgctgctatcatgagttcatgacaagcacagcataaactcccagtaaatttcattatagttacattcatggccttctccttgtgccttcaatcttcaacagcactacagaaacatggctaaacttcttgttgttgtgctgctactatctcttctcatctatgcggccacagcatgggatgccgagagcttcttcaacttcaagagttgtccaccaaatcagtgcagcaaacatggaccaaaagtccggttcccactccgccttgcatcacaatctccgtcgtgcggcacacctctcatggagttatcatgttctggacaggacaccatcctgtatcacccagttctaggctcctgcaaggtgactgcaatatcttacaagcatgctgccatgtccatcatcctgcttgtagattccacacctcactgcccacttcagaagctcatctcgacaaatttatcaactgatgtgtacaaacctcaaaaattggaagctgcaagcttagtaagttgttcaagagatttaccaagagatcagcacggtgtagttggcccaataacttgcctcagtaacaacgcaagccagtggtatttgatacatccttatgcatattgtctgttcttcagccagactgcaaagttgttagtaatggcatccaggcaccctcaacttttaaggaaacagaaaatggagtaatcggtgttgatgagttggtattcacttggtactccagtgacataaccagagattgtcaaaaatgtgaaaatgaaggcaaacactgtggtttcagctcacaaaggggccgagcattctgcaattatggtattttctctttctgaagcagaaatcttacatcaatattatgacttgctttgccttggtaggaaactctatggtctttaccttttcattctcttagtttaaagtttgccaattaaattgttcaaaagatttccatagttgaattagttgtaaacactgcagatcagagcagctgctagccaatggaagcataccaaagctctaggttcacatgcatggttattctaatttaaaacgcgcgcacacaagagaaggttataaccgattaagagtaacggaatttttttgaaattcttaaaattaaaaaaaaaaccattcatctacaaggtaacctagatcaaaatgaatttttctttaggattggagcataggcatcccttggtaactagagagggtgctatgaatgaacacactctccaaaataccattgttagtatcaacgtatagtttatttgattgtaaccatttggactggaccgcctatacatgttccaagttaaagaaaaaaaaagaaagaagaaaacataatttacttagcaacaactgctaagcctcacgttggttccatgtattccagccatagaaaccacacccacattccttaatgtcaatactatactctctactctagcttatcactagaaccaaggatggacatgctctcagatttgatgtggtgttctggttatctttaatttctcactttttcacaataagcatgacctgaactttggcttgtcagcaccttcttggatacatattcttgaaaaaaacaccatactgggtacttgcaaaaggaaaaaagaagaaaaagtgaactccatgtagggtcatattgatattttaattctgaactcttgcatacctatgttagatacacagaaagcaacaggatcttcagcatgaacatgtttgcacgagttctaggtcactggtgatccatcatgaaacacagcttggtgcccaaagaaaccagcatcccatctgtctattgataatatatatttttttagagtaaatttcacttagagccatcttttattactgatatttcgctttggccctttaatcaatgttctcactttcgaccagttctttgtttttaacctttgtggcactttggaccaccctcaactattttatccatctacatccaacttatcatatgccaaataaatggtctttcatatagctgagagagttaattgacgagtacaagccgacatactcgagatcgttcatatgcttgagaagagagttgtgatggtccaaaatgaagcgaaggtaagattacccggaatgcatgaacctaacaggaatgcatatctattttccagacaagttaggatccttattggaaaaggaataatttttgaggagtttatacatatatagccctttgttccatgttgtccttcacctgttatgcttcctagtgatagatcagagatgccctctctcagtgacatgttgcgctagaatatatatatgggcgctggttgtcacatggcaggatgcttctcattccttctttggcccatctcctcctatacatgcgcaggcatgatgcatgcatacggttgcatgcacaaaccagttaagatcagagaatcccagcagtgtagtacatgcatacttgcgacgtcatatgctatatacctatactccactcggtgctagctaggttgaattgagatcgatcgatcagatatggggataaaaactgatagagctaagctagggcctggatgcagagagatgcagccatggccttctgttttgttttgttctcaagtgagatacgacgaacctgcatgctacaccataaacaggttcatccctgctgtagagaccaagtgtatgaacaaatagagcatgacgaaactacaatacagcgaaaaaggaaaacgtaactgaaatttgttatgtgtgattgtcacgtaccagaaatgacccttaaaatccagaaagtttgtggcactaacatcaggagcacaacaaaagggtgtggaagttgagttgcatgacggccgcatatcgagaagtaagaatcgatattagtaaaaatgacaaagatcctatatgctgtcggttctccactactgtcgctgcaataccacgatgtcatgcatgagccatggtacggcaaagcaaatttccaagataatgttatttggcattggtaaacttcactatcaagaatgtacagggaagactggccaaagtgttcagttttaagggattctttttagaaataatacttttttattagagtcgcaataatagaggttgacagacaaaaattgcaagtataacaccctatcgagcaatcgaactgtggttgttcgacggataaaaaataaaaactaagagagaaaaatcactgtgcgccactgtagcatgcaggacctatcaaacatccccagttcgataggccaccctgccatgctcttccatgtattttttttaagtggaccaacaaccctgtcgaacaacctgtcgaactgtggttgttcgacagggtataaaacttgcgattttagccaatcaatttatatttttgcaattttttattaaaccaccgggcagcggcacagttcgattgaatcttcattgatttcaattgaatcttcagttacaacattaagctattccagtgagtatgggcgctctggatcctttatatctctaatatgatgtaagaaggttaaggagtgcaaacaaaagaaaaattttgagggcagcagaactccagatagaggtaagtataacaggaaagaaaaggtacacagcatgtagataagttaacgaagaaagcacatcaaatatttctagctggtcaatagcctctgccgcattttcatctgtggtttctggtgcctgccgagcacgcctctcttttttctcataaactacaggattagcatttattaatcccacaaccatttttctgatgcaatgcactaatttatatcagaatggcgaaattcctgcaagttgaaaacatggaaattataccaatatcagtcttgaataattttgttaatcactataaacgttcaatggagatattccccgcccaatctatcactagtagtctactagtaatattattgtggactgttaataatcaagactaaattgcgttcgttaaactatgaaatgtaatttgatccctcaacaccccgatgaaagaacagattgctaaacagaaatgcaaaatagaggtgtgataagaaatttgctaaaggatatttagcaggctaaactctgaagcggtcgcgggccatatggttaatcactaaagactgcaaggactgatgtaacatggggcatgggggggttcagctgaaccccaatttctttcggaaacaaattgcttagtataattaggttaaggcaaaggcaaggagtaccgtattgcaagagaagctaagcgcatctgtagtatcgccccaaattaaacagaacccgcagcgatagtaaggagtatagcaaccgtacgtcgcgcaggaggcggcgcaaggcagaggccaccggagagcaggcgtcgtcgtcgcgcgaggcgaagaccaccggggagaaggggccgccgccagcggaggaggcggcctgggatttgggggccgaacgaacgaacgaacgaacggggccaccggaggaggagactaaatcgaaccaaaccatgcaccggagaggatgcggcaggacgccgggagacgctgctcgcggggtggagatcggcgccgccggccggcaagcccgcgagttgatggcgacggggagatcggctagggcagggcaggaagggggagatgagaaaacgcacccctccaactccaaccacaggaaacgggcaggaagggggagctcggaactcggaactcggaagagaagaaaagctcaccggcggcgggcggcgggcggcgtaggcggccgtacaccaccgcgggggcgtttgagcccatctagtggtgctggtggtgttccattctgacttcgcttgtaacatctgggccgggctgtgaatcctcctccgtcatgggccgacatgccagagtccaacatgaatcacccccgaacccctttccttccttgggtatttcatttactggccgttcgatgcgatctagattgcgcggattaagggtcggtgtttaaaactcctaaccccttttttaggttgtgagcgcgttagattgagcggataataaataagccattcgtcgcaaaacgcaaagtgagccgagcgctaatcatgctatgcttgcttagatctagggatgtagctatatttatggcgccatattttttataaaaaatagtcggtatatatttacattgtaagtatctaaattacatatgtaattttagtgtatttacaatgtaagtctcaaaattacatatgtaagtactaaaattacatatgtaaattcgaaaattacatactaattatatatgtaagtggggtgtaaataagatataactactgtgtaagtggctaaaaaaatcaactgtagcatatagcgccatatttctagcaactccgtagatgtagatctagtgccatcagatcattaaatcaccaacggattaatggccatgtcgtaatttcctccctatcaccaacagtcaaatgtagtattcattggtcaggtcggatgcgattttatatgcagtacgttgcactgtcttcttttcttgtgcccctgtctaaataaaaatgaaatcctgaaaccccctttttcattaggcataagaaaattacaaataactaaaagagtgacggattaaattctgaaatggcgacgaacacacagtgaaaaatgccgtcgccaaacttcttctcatcggcaataccgttttgagtcaactacaatattatggaccccaaagcagggcacggctgcagatacgttcaaattttcagatgttgggcggaggtctttcagttctgatcttgcccgagtacccgcgttacgactccaacagcgattgtgcttccaccagaccttaagaatgccctgccaagagctcggcatttggagaattcttcaacacagaccggagcgtctaaggtaacctgacaaatatcaagaaaatcacaacatcgcaaatgatgacttcggaagcaatggctcctcacaaggatctgtgatcagttgttacctgcacaactgcattctgctttgacttaagaaatcgaggtgcagttttgcttggtttgccagccttgtcaagcaatgccacgattttcgtaaccctcgcagcctccttcacatgatgtatgtgaaactcgacctaggcccatatttttatcagattgcatcagggaagaaaataatcaaaaggagagcttttggtcatatctttacctgatagccaataaggataggaatggtgacgtccaacactagaacccttagctccaagaagttagagacaggcactgggaaaccagggttgcaaagaatcccacctgctattagcttactcccatcgatgccctgtaaactaaccgctacattatcaccagctcttgctatgtcacatgaatttgaatcccgctcgatggatttcactgtcgccacttccccacaaggtgaaattaaaacctgcaacagcaagttccaagctgtcaaaacagataggaatgtcaagacatttgcgtacaaaagcaagtataaatatatatattttttaaaaagaccaaattccgacatcatgctgttactgaaagattggcatgcaaatatgcaactagcaaatgtcacaatgtaaacgctcttgatcaatctttcctctatcctcatatttggagctcatctcaatgaaatatacaagtatcaatagtccctgctgatttgtgaggaatgtacctttgaaccaattcgaatagctccagtctctaattttccaaatgctgccaactgccctgttgactgagacttgataacatcacagataggaagaatgaggggctttgaaacatcccgagatggaagctgcaaggaatctatagcatccaagagacaaaatccttgatacctgaaaggacatcagttcaagattcctattcttcagataaacaaatgattttttttctaataagacagtatggtcccaaatatttcaaaatatcagtaatgctattctcacgagtgcttactacaatatgtcgatattaccatgtgaaaaggttagaaattgcaagatgcatgaaacagccatctctgttgaaaaattctacacaatgtagtgtttcgaatggcatggaagtagtgtgtcaaaacataacttaccaggaagttaaacggacatcagaaggaattttgatcaaattctgattttcaacagcactaagaggaatccaggtaacagatgaatctttgaagttgcatgcccgcagaaaactaccaagttgaaccttgatgaactcgaatctttctttggagtacccgatggcatccatcttgttgaccgcaacaataagctgttcaacgccgaagcttctaataagctgagcatgttcttttgtctggccaacacttttccctccttcaccgtccatgccagcttcaaatgaaccagtgcaagcatcaacaacaagaatagctgcatcagcttgcgttgcgccagatatcatatttggtacaaaatctttatggcctggagagtcaagcaaaactacacggtacttattggtctccaaataagccacagccacagtcattgtcacacctctttctctttcttcactgctttcatccatagcccacgcataagcaaatgatccttttccctggtaaaaaataatttccataatacaagaatatgaatggaacatcaggatcaagtatagtacaataacaacaataataaacttactttttctttagcctccttctcattcttgtgcatatcttttttcgatatccttcctaacagatgtagcagtctcccagagagtgttgacttgccagaatcaacatgacctacctaaacaaattgttcgtagacagtaacctatttagacaaagcacttttagaataacaaaattgttacggaacatatgccatattcagaacagaagatgagtatagcatactattgcaaggtttagttggctcagcactcctgattcctcattagcaaacatccacttctcaggcttatattcttcaggtaaataaggttttgcagtatctacttcattcttttctaaacctagcttctgtatgtcagaagaaagtttctgggccacatcctcattctgtgcagaactggtagccctactactctggtcctccttcagctgaaaatgatcagaaatcaattgagctgtcctctcgacaggcacatcttcaggaagtgcaatgtgtttcacctttttcccagcgcctgatgagctaccaacagatgcgtactgtgtggaaccaactgttgaataataaaataatttaaattaaggtgacaataaaagaacaaagctaacaggcttttttttcaacaggaaggcttatcaaccaacagatgatacaactggttgggaagatctgcaaatcaagtacaaataagtcacccttacaaaagtagcttggttcagacttcagagggcatgacacgtgagctgtgggttgttgttgtccaacaagtgaaacattttttagtggtatgcaagggaacaatctgttcagccacagtaagtgacaatggtgcttgggaaagaaaaggatcaaaatctgcttcccgcacataagatgagctaatgtgattcttttatatggtgaattatgaattatccttttcataactcaataaggtgttatggtaggagaagctagtttaaaggtagaacagagttgcatacacaaaattgtacagcatctaccatttgcaccagcagtacctttctcatgagatatgctagcattctttatctcagggtcaccaccaaagtctgtagtacgagtattcactggcatctttgtagaatcagatttcggcatcgaaggtgtcccaaaatcacttggtatcccatggactgtaatttaatagttatagtacactatgattacattagaattccttgtcagaatacaaattgtgattcaaagagaattagaatgggtgaaggatgttaccttttattgaaccatccttggcagatttcataaaggattctcgaaaaaccccacacatctcacaatacaccatgctttcatgattatcgaacatgcacatggagcatctccaaagcacaggcaccatacttgaggacttcttcgatgactctgcacaatagagtggtgacataacattagagatcaaggagctgcactacacgcagttagcttgatatgctgagtaagtcacaaaaaaacttcactgtacaacaacaaagcaaagcattcgatgcgtggagcttatgcggaaagcaacggttaaatgtataagcatatgaattatttcaaaatgtgtcaaatatataaaacaataatatgcatatgcaccaggattcagcaagcaaccagtaggtaatactggtagttctaactggcagccagctatgtttcgattctcacccaatttgggtagatttaatttgtagtaagtttttattttgatggactggatgaatgatatttgactcattccaaaaaatgcatgttgaataacaatgccttcaagaaaacaaatatctgaagtgcatatgatgggataaatgggcaaggaaattatcacaagaccaggtaatcggcaaacataagctacacgatcactgcatttgtttgaacaagcaatgctattggaagttttagagtaattaagcactagaaattcttatttgcataatcaggcaatagaggatgcgatagcaagtacgaatgcaggatggaaacaatgtaatgacattaacaacatttaacaccactgagcaaattatgataacgggtgaaggctcctagtaacctacaccgccgtgactaacctacacgagtagatatgttaggtgtgcatcatgaagcgactccaatagctatttcaccattcttacatgctgaggtgtacactgtctagtactagcttcaaacctttgacataatacctttctccttcgtagggtgctgaatgtcgtcactgtgcccagtcccaccgtaatcatcatagtcttcatcatactcatcatagtcatcattgtactcatcatcgtagtcaggcccagagacaaccttgcgcggcatcctgctgacacagggcagacctaatgggggaaaaaatagtgttatt

SEQ ID NO: 22858 - DNA, 17834 bp, Oryza sativa
gtttgaggcaaattcgagatctggaagctgggtttctctttacaaataacactaaccctaccatcaaatcaagaaaggaggctttgaacaaatagcttgattgaagtatgaagtggctcggtgggcgacgatgacgggcgagctccggcgagggcctgggggcctgagcgacgatgacgggcgagctccggcagcggcgagctctggtggtcgcgcgctggggcctgggggacgccgacgggccggcgctggtgggaggcggcgacggaggctggcggaggagggacggcggacggcaggcggcgctggcggtcgcgcggcgagggacggcaggccgcgcgcccgccggaggaggagggacggagggacggcaggcggcgctggcggtagcgcggcgagggcggtggcggcttaggtcgctggggggaggaggactggagccgactagtatacctggccaaatgggccgggccaaggcgtgccggcccgagcacggcagcactgtagccggcccaggaacggcacggcacgcccgctcgtgggccgtgccggcacgacccgttcagccgtgccgtgcttggcccgacgtctgagcccatgggccggtacggcaccgcacggttgccatcgggtcggcacgtcaacgccacatcagcaaaaccgccatccaaaaccgctgagggagtcaaattgcactagtttgaatagttcggggagtcatcctatccggttttacggttgagggtcacggattagattcgggtgacttttaagggagtcaaagtggacttttttccttttattaaatttaacattgaacatattttgataatatgtttattttatgttgaaaatgctagtatatttttttataaagttggtcaaacttggataaaaataaaagcaacttataaggacaagttcactgtacttctttgcttgataatactaagttcataaaactacatatacatgggcctccgcgtaatgacgctagcgtacacagaaaaatacaatcatcacatatataagcagcttcagcagtcagcatttcgcaacgtgcatactactagtactaagttactggtagctaaagctctgaaacaggctaatgctttcgtcgtcatcgtcctcttcagcttcagagattgcagtcagatcagatgacagatggtaaggctctactccaaggggttgctcatcatcacagaagaatggcttgggaggaacttggagatcatcgctgccaccttcaagcatctctatcacctcgctcatcgtcggtcgatcagatgacctcatctgaatgcaccgtaatccaacaacgcaaagctccttctccagctcatgcatgtcgacaatgtcagagatctcacatgtttctcgtcgagtcaactgcttgtacacccgggatggatagtatgcctgacttgagtttgctgcattcggatctgcatttcttcttcctccggccatttctagtagcagcatcccaaagctatacacatcagatttgcttgatatggtaccaaagctccgagagatcatctcaggagctatgtaacccactgttcctcgtgcagcgctcactgggacaaagctcttatctcttgggtacagcttggcaaggccaaaatcggcaacttttgggacaaagttatcatcaagaaggatgttgtgaggcttgatgtcaaagtgcagaatctgcatctcgcacccctgatgcaggtagttgatccctcttgcaatgcccaaagcgatctcattcagcttgtcccaggagaaacacttctctaatgagaagatgtatttatcaagagagccccgaggcatgtactcatagacgagcgctcttctcatttcttccgagcagaatccgaccagacgcactacattgatatggtggatccgaccgatggtggagacctcactaatgaattcatctccgttgcagttggagttaccggacaacatcttgatggcaacatgtacattgccggggagcagtacgcctttatatacagagccatagcctccttgtcctagcttgtctcgaaaatgggatgtgattgcaatgatgtcagtgtaggcgtacctcattggaccaatcatctgttgcatctggagaaacttctctaccgcatcgattgtgatccttgttttccagtacttgtgggcaaggaagatgaataccaccagcggcgccaacattaacctgaataaaactttgcagaaatgccaagagcccgagaagcagttttttttagatagtggaagggtacggaacaatataggctatagcattataggtgtgtatcactcaaaaagaatattagagctatgatgattaaatgaaggtaattcaagcgtaccaaaatagagcttgatgataacgatggcagatactatgataaccataagtgtcataaactttgtagagcttgatgataacgatggcagatactatgataaccataagtgtcataaactttgttgtgtaggcgtgaccagcaactctgcagcgtgtgaaatacagttcgctccagaaaatagcacgggctatattcggaatgcttgcgccggttatatgctcgttgaagtacctgcagatcacaccattttacaggatgggttaagcgaaggaaacgcgtctttctccatagacactacagaatttatgagggaaacaaaaaaaacagctcacacgagggtcgagagtattcatgccatacgtatttgagagcagactgaccttactgaattgttgaggcattccttggtgctgatatgatgattgaggtggtgtttggatccagggacttaactttagtccctgtttttagacactaatttagagtattaaatatagactacttacaaaactaattatataaatgaaagctaattcacgagacaaattttttaagcctaattaatccacaattagagaatgtttactgtagcatcacataggctaatcatggattagttaggctcaatagattcgtctcgcgaattagtccaagattatggatgagttttattaatagtctacgtttaatatttataattaatattcaaacatccgatgtgatagagacttaaaagttttagtcccatctaaacagggcctgagggaactatgatccattgggaatcgaacacgaaaccccttccctatgaatccaatgatatcagtataacttgcattttgtagctgtgagactgatatatgttgagtatcaaagggaatcatggacaagtatcgacaagaaggttgaagctctccaattgtacagccataaaactcgttgagataaacaaaagaattgttggtaggcaggcaagagacgggcctgtaccatggactagtagtatcttgtattggtctggaacaattcacaaagcatgcccaagcactgtctgaagaagtagccaaatcgagaaagccataagaatcagttgtagtacggtccaacagatcgtcagtactgtaaggagggtgatcggatggaggaagagggcagctgctatcatcatcctgcatggtggcgtcggtgaccaagaaggacagatcggtgtagttgatgctactcacgtagtatgttcttgtgttgatctgaatggtggccttgccagtgttgctgcaggacaggtcataccatggacggggagcagcaacgcaatcgcgcgaatcgccttgaagacggaaagggtaggatatgttgtgaagatcaccacaggaggaaggaggacagtagtggttgttgctttgccctcctccaacatctgctgcaacaagcaaagaagaagagatcactagagctgtctgcaaggtgtaggtaatactactgctactaatggagctcgccatggctgcaggggcctgcaggctgcagcttcaagacctggatgaatgacttatgacttatgaccgcgagtggacgaactgcagcagtagtactagtcaaagttggacggccacaccagtcgtccaggcacagatgagacacgctcctacacgaattattgggatattatatttgcgttaatggctcttcttcgcctccatgggtcagacagacagaaacgaatagtccagtcaagatgagctctgagcttgctcttgttgcaggaccctgcttgctgctgctgtcgtctctgcttctgcagctgcaggccacggcatgggaagacaaggatttctcagctactgcccgccgtcgcggtgcagcgagcatggccccgagatcaggttccctttccaacttgaatccaacaatactacaccatcctcatgtagcgtaccatgcatgaagctagcatgctccggccaagacaccatcttagatagcagatactcgtaccttggaagcccatacaaggtgaccgccatagattacaagcatactaccctcaccatcatccctatcggagacttggattcatgtccgcttctaaattctgtaccacttccttctcagccactccattatcattatcacggtgcaaactggagctcttgcgacatatacaattggggttctgcagccctagtaagctgttctcaagagttgacacaaactgatatcccttccactcatattgctggcccaatctcttgcctgtccaccaactcaactcacttctcctatttggtggcttatgatgtgcctacgtgtcttattccaatccagtgcgaggtcatctcagatggccccattccgataccatatttttactctggccatgcctcgctcaccttcaggcaaagtgcagaaagaatcctcaattttgctgacacgacggtctattggagatccttcgcaaacccagccgcttacaattgctcacagtgtgaacaacaaggccgacgctgcgcatacagctcacaaagaaatcaaacattctgcatgcgtcgaggtatttttttcaaacccggtaaatccctttacagcaggcaccgtctttttcctgcaagttttacaattttcagtttacaatccactcatatgaatgctaactagtagtatctgattgtcaatagccagcaaaacacacatgagcgtcacatacacttcatcttaattccaaacgtggttgctcaaaatgtagaggctaaataaaaagctttaccaacctcatcgtaagatcactggcatggcggcattcacttctgggagcccatcatcgagttacaacttacaacaagatttatggctgccatccttcttgtactggaggtgcaatatatagtagtgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttctccacagtgccgaatacaagactcaaaaatagtccacagactgaatcgaacatgcctacaattaaggaagaaacaaggaaactaatcccttctttctaatcttagccactcccggtggcttcctcagctgtgcgctgggcgcgctctgtagcgcggcgcacgtcacgcgcgcgacggcgtctcgcgtacgtgcggccccacatgacatctcccccctcatcgagagccagctcgtccccgagctggaagtcggggtacttggcgatgaaagcgtcggcgtcttcccacgtcgccgaagctggggactctcccttccattggatcagcagctggcgcacaccacgtgcgaggcgcgtcttgacggctcgttccggctccgggaccacggcaccatggtgaacagcaggcaggggcggtggagcatccggcggggagccatggaacttcttgaggaggccgatgtggaaaacgtcgtgcagacgagctcggggtggcagagcgaggcgaaccgcgacgtcgttgatgagctcggtgatgcggtagggcccgtagaagcggggcctcagcttgccggcgacggtctgtggcagtgaagatgccgcgcgctgcctgaggcgtagtagggcccagtcacccacctggtacgtgacatggcgatgtgccttgtcatagtggcgcttctgggtcgcctgtgcttgttcaaggcggctgcgaatgtcagcgaggaacttatcccgctcttccatggtcttggcgacggcggccaccctggtgtctccgggctcatatgaccggatggatgggggatcgcggccgtagacgacgcggaacggtgtgtcccgcagtgacgtttggtaggcggtgttgaagacgtactccgcccacggaagccactggagccactgccgcggtcgatcaccagtgaggcaccgcaggtacatgacaatgacgcggttggcggactctgactgcccatctgactgtgggtgaaaggccgtcgtcatgtgcaacttggtacccaccaaccacatcagctcgcgccagaagtgggaggtgaaaaccgtgtcccggtccgacacgatggactgtggcatgccatggaggcgaacgatgtcggcgaagaaggcctgggcgacggtctccgcggagtacgggtgagacagggggatgaagtggcagtacttgctgaacctgtccaccaccgtcagaatgactgacttgccccggacgcgtggtagcgcctcgacgaagtctagggcgatgtccgtccagactccttgtggcacgggcagcggtagaagaaggccagccggatgtagatgctccgacttgtagcgctggcacgtagggcatgcccgcaccaaatcctgcacgagctgtttcatgttaggaaaatgaaaatcacgccgcagccggtgcagcgtgcgctggacgccttcgtgtccttcctcgtggacagccgccatgagctccggcagcagaggcgaggccgggggaatgtacagccgcccgctgtactggatcatcccgtccacggccgcccacggcagagcttgggagcccgaggtgagctcttcatgcatggcgacgagggccgggtcagtggtttgcgcgtggcggagcctgtcgacgaagtcaaagcgtggggccgagagcgccaagatggtgccatcctccggtgtgtcccggcgcgacagcgcgtccgctacggcattggcatgtcccggcttgtactcgacggtgaagtcgaacccgagaagcttccccacccagtgatgctgaggaatcgtcgcgagcctctgatcgagcaggtacttgaggctgtagtggtcggtcttgacgacgaagcggcgcccccacaagtacggccgccagtgacgtacagcgtgcacgaagccgatcagctcacgctcgtatgctgcgagcgcgcgatggcggggtgccaccggcctactgaagaaggcaacagggtggctgtcctggacgagcaccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacggacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacggcgaaggaacggccgaagtacgtcgttcatcagagcctggaacgtcaccggggcattgcacagcccgaacggcatgacgaggaactcgtagaggccgtcgtgggtatggaacgcggtcttgtgaacgtcggccggccgcatccgcacctggtggtacccggagcggagatctagcttggtgaagaagcgcgccccgtggagctcatcgagcagctcgtcgatgacggggatcggaaacgcatccttgaccgtgagcgcgttgagggcgcggtagtcgacgcaaaagcgccacgatccgtccggcttcttgacgaggaggaccggggacgagaacgcggagtcgctgcggcggacaatgccttgctcgattatggcggcacattgcagctccaattcatccttgtgagccgccaggtaacgataggggcggacggccactggcagcgcacccggctttaagacgatgctgtggtcccgagcgcgctgtggtggcagaccggatggctcggcgaagaccccttcgaaagaggccagcagcccatcgagaaggacctccgaggctgctatgacggcgacagtcggctccgggcgcgccgccacgtcggaccagcgaacctccatgccgtggcgcgagaacgacatggtgcgcgccgtgaagtcccatgttatcggccccagggtaaccatccattgggttcccagaacgagatcgtatcccgccaacggcatgacgaagaggtccacgtggaactcctctccatcgatggtgatcggcgcctgtcggagcacgcccgggcactggatcttctcgccattggccactgtggccgtgaggcgcggcttgggctggatggccaggttggtgcggcgcgccgcctcctcggcgatgaaattgtgggtggagctggtgtcgaggagggcggtgagggtgaccgcgcccagcatcacccggacttgcatcgtgtcgcagatcgggactcctgcgaccgcctgcaaagagaagacaggggcctccccatcttggtccgcgtccaacgcggcgtcctcggcgtcggtgagcgtcacgccgtcgatgtagaagatgcggcggcagacccggttatggccacgggagtacttttcgtcgcaattgtagcacagcccgaggcggcgacgttccgcctgctcctcctgggagaggcgtttcaccggtttggcctccatcttggccacgggtgcgctcgccggcggtgcagggagcgcgaggcgctggggcagtgccggcagcaggccgcggggcgctggccgggcgggaactggagccggcttgtcgagctccatcaactcaacttgacgggccaggctcatggcggccgcgagcgactgcgggttgtgaatccgcacagcgtgactcagcggcggaaggagtccccccgtgaatagctggaccagctgggcttcctgcagtggaccggcgcgtggtaggagcgcctggaagctgttctggtactccttgacggtacccgtgcgccggcactcggcgagctcgaacagcggcgctgagcgcaggggcggtccaaagcgcaggtggaggaggtccttgaagcgattccatctgggagtaccctcgtcctcctggagttggatataccacaattgggccacgtcctccaggttgtatgaagccatccatactttctcctcctccatgatgcgttgttgatggaaataagattcacatctgttgacgaagatcaggggatcggtcgtgccatcatagcggggaaagtccatcttctggaactgttggcaacttttttgacaagttgacaagcacgatcgcagcaccttaagctttgcggtgatcctagagtcgccaaccacctcgatctagcaaagagctaaacctagatgggttttgataactaaaccggctaatggagccgatttctagataactacccgtctcgtgggcaagacggaaggttttcaggacaaacctacaaagagatgttgcactctcgcagcggcggcggacggtttacggcgcaaaccgacaaagatggacaaactaagagaaaactaaaagcaatatgaaaagaacgattcgattgattgatagtagattgttttttacaatgaaccggccttgtcccttatataggggttggtcttgccctctacaggcccttctccacgtccaactcggggtagaaaccaaaggaaacccgaaacatgccttcccgagcaaggaaacctcgaaacccgacgcaacagaatcggacttgggcctgccggtcaaaccggccacataccgccggtctgaccggccttcaaccggcggtctgaccgcccaacacacggcagtcagactggcctacctcgaaggaaaccggtagacttccaaattttggcaatatttcctattttaagcctaggtgccaaatttgggtgtaaacacatgcccccctgcctttttgatgaacgacgtgaatctaaaagcatagaacatgtttttggtcttaggacgataatccaattaccggccatagtacctcctaagcgtcttgccaaacactcgggaagtatttctttaagtatttcccattgattgctcgctgaaaacgctccccttgtagtgtctccaaaaagtatgcgttccctcgaacaacgccgcaaactcgataaggaccctcccaactaggagaccacttaccgaactccttagatcgagtacctaaaggcaaaattgtcttccaaaccaagtctccaacttgaaacaattttgctttcactctcttgttgtacgctttggccaccctcttcttctctttctctatctcttccaatgccttcaagcgcttgtcggtgacttcatcaaggttgtctcccataaacgtctcgtaatcttcacttgacaaatcatcttgcttgatataacgaagagaaccaagatttacctccaccggtaaaacggcttcttgaccataaaccaactcaaaaggagtgactttagtggcaccatgtttatatatcctatgtgcccacaatgcttcagaaagcacctcatgccacctcttcgggtgttcctcaatcttcttttttactagctttaacaatgtcttattactcgactcggcttgtccattagcctgagcgtagtaaggagaagaactcaacaatttaatgccataagattcggtaaaactcttcacttccttagacataaaagaagcgccttggtccgtagttaatgtttgcggaataccgaatctatgaataatatgcttcaaaataaagtcaattacctccgtatgagtcatattcttcaaaggtacggcttcggcccacttggtgaagtaatccgtagcgactagcacgaacctatgcccctttgatgacgaaggataaatttgaccaatgaaatctaaagcccatcctcggaacggctatggtttgattataggattcaacacggcggcgggcaccaattgaacattgccgaaccgttgacaagcctcgcatcctctataatatttgaagcaatcatcaatcatcctcggccaataaaaccccgctcttctaagcaaccaattcatcttgtgggccgatttatgagttccacaaattccttcatgtacttctcccatagccactttagattgatctttatctaagcacttcaacaagacaccatctatgtttcggcgatacaaatctccttccacaaattccttcatgtatttctcccatagccactttagattgatctttatctaagtacttcaacaagacaccatctatgtttcgacgatacaaatctccatcaagcaatgtatatttgaatgcttgccgccgaatttttcgatcaaccttaaatgtgggatctttcaaatattgaatcaaaggaattctcgaatcctcttctgtatcctggacacaaacgtccgaattcacaattaattcggcttcaaaattacttgaaacgtgccccccagcattctgcctagaaccggtcagaccggccacacagggccggtcagaccgctcagggatgccggtcagaccggcggcatgtggccggtcagaccgcccctggtcacggtcagaccggccgtgcaacgtcggtcagaccgcctctggtccccaactttgccaattttgcgcaaaaatttaaaatcaagcaccggctcttctaatatcagaaataaccccctttttacattataaccagatgtttgttgtgccaagtcatttgctctagaattatcacacctagcaatatgtctaatagcaaaattatcaaaattggcaataatatctaaacatgaatcgaggtacctatttagtgatccatccaagcacttgtagatcccggcgacttgttgcaccaccaattccgaatcaccaaaggcctccacatatttagctccaaccatctccatcacttgtaagccgaacaataaagcattgtattcggcttgattatttgtgcaataatattccaaacgaaccgatgcctcataacacatgccattaggtgaaatcaaaactacccctttgccttgaccttctttgcaagaagaaccatcaaaataaatcttccaaggtataacttcaactaagcaaacctctccctcataagcaacatctatatgatggtccactataaaatcacatacaatttggccttttatagttttcaatggttcataagccaaatcatattctatcaaagcatatgcccacttaccaattctcccacttagaattggcctttgcaacatgtgtttaataacatcggcttgacaagtaactatgcatgtactagataacaaataatgcctcaatttggtacaagcatagtataagcatagacaaagtatctctataaaaacatacctcgtttcagcatccaaaagacggcggctcaaatatgtaatgatatattccttgccatcttcctcttgcgtcaaaacggcaccaatgactttgtcctcggaggcaacatataaccgaaaaggctttccggctttaggcgctcgcacaacgggtggagtagataaatacctcttcaactcttcaaacgtctctttttgttttgccccccaagtaaaatcggcttcttttttcaagcgaagtataggaacaaaagcatcgattttacccgctaggttagaaataaacctcctcaaataattcaccttacctagcaacttttggacctctttcttgcatgtcggcgctttgaaatcatgaattttttctatcttcttaggatcaatctcaactcctctctcatgcaccatgaatcctaagaacttccccgccgacacaccaaaagcacatttaagtgggttcatcttcaaaccataccggcgcatcctctcaaaagctaatctcaaatcggctatatggccttccataccatccgatttgacaacaatatcatcaatatagatctctaagataatacctagcaaatcatgaaagatcaaattcattgccctttgatacgttgcaccggcattcttcaacccaaaggtcatgacaacccactcaaataaaccaacaaaccccgggcacctaaaagccgtcttgtacatatcctcttccgccataaagatttgattgtagccgacattaccatctaaaaagctaatcaccttatgacccaaggcatcattaatcatcaggtcagctataggcataggatactcatctttaggagtggctttatttaaatatctaaaatctatgcaaactctaattttaccactccccttcttctccactgggactatgctagaaacccactccgcataacgacatggcctaataaaccccgcctttaataaccgatcaatctcctctttgactcggtcatataataaaggattaaaacgacgaagtggttgcttataaggcctaaaacccggtttaactggaagccgatgctcaacaagctcacggctaagacccggcatctcatggtactcccatgcaaagcaatcaacatactctttaagtagctcgattaccttaaccttataatcggctttcatgtttttctgtacaaaagtcggccttggtttagttccatcacctatatctacttcttccaatggatcggccgatgtaaacccttgtccaagcttctcaacttcatcaaaatcttcaacagtttcaccaatatcgttctttgtagaccgatattcttgcaccctcttttgtaaccactctaaactagcctctttactcattatacaaatttatatggcttagccgtgctacactagccggctttacagagataggtacaaatttgccatcggagatactaataaaatcataactagaaagatccctccccgataagcattggatattcccatgacgccactcaaacgtagcatcggccattgcaacttcggccgatgtatccgcttgaacaatttcaacatcatcgccgtcccattgaattaaacattgatgcaaggtagaaggcacacaacaatttgcatgaatccaacaacgacccaaaataacattgtagttaccttgcacatcgacgatgaagaaagcggttggtagcgtcttatttcccacggtgagctccgccgaaaaaatacccctcgcctccgttggttcaccattgaatccattgagaatcatgttggtcttcttcaactcatcaccctcacgccccaacttcttgaatagcgaatacggcatcaagttcacggcggcacctccatccactagcatcctagagaccggcttcccatcaacatggcctttgagatagagaggcttcatgtgacggtttgattcatcgggtttctcaaaaaccgcgtctttaggacctaataagaattgggcaacctcggcttcatccatagcacaaaactccatagacaacatacacaccatgttgatatccatgtcctcctttggagacgatttaccttcatcaacctattgtccttccttctcctcttcatcaatcggttttgccttctctatggatttaggcctccatactggtggtggtcgcaactcattgaaccttttatcccttttctcttcggcctttttctcccttaattcttgggcccgaagacgttgcaaccttctcttttgtgtagccgtcaaatccttaggcatccacctaggattcggctctgttccaggaggtaaataatgtcctttattaaccttgtttgaagacgatgaagcccttacatcggcttttgcaactctcccgtcaaaccggcgctggaaaccggtcagaccggcagcagaccgccggtcagaccggccatatgcgccggttagatcgacgttagacacacggtcagaccggcctgaggcgtcggtcagaccgtcgtcagatcggcggtcagaccggccagatggcccggtcggaccggcaacatggccgcggtcagaccggccagaaggcctggtcagaccggccgactgcgaggagctagaaccggcttcggactttttacttggggactttccaactccatcttcggaaggtataggcacatcatgggatcctatcttgatggtaatcacctccgaagtcctctcttctatcttgacgcgctttccttccctcttctcttcattaacccgatttttaccataaaatcggcttttgtttggtgaagataaacgctcatgaattggcctccgtggtcctccccatccttggttgaatctcattggcggcatatgattgtacattggcggcgttgccccccctggcataaagtaaggataaggataacccggcggcggcattggataaggaccccatgacatgtcttgtggatgaaaatatggaggtgaacatgaccgtcttggcgaatgaccaaatcgctccctaggaggtgatcttggtcttttccctttgttgtgatccctctcaccaccttgcctctcatacttttccaaaagcatatcaaaagtcactttggtctttctaggggccttagaagtcgaagcttcacccttattctccttccaaacgccaatctcctgcttctttggcaccatcatcttaggccttggctcaccaatgaccactttctttcccttggtagattcggcttgctccggccgaatcaacaccttcttattattgaaattaattgtattcaccggaaaaggatcatgatcaaacttcatcttggagccatcggtgaatttcaatcgtccctcatctatggccgattgaacctgtcgtcgaaacacattgcaatcattagtagagtgagaatgagaattatgccatttacaatatgctcgacgcttcttgagaaggtatgacatggcctttaggtaatctaatttgcttctcttgcaaaagataatcaaaatcttatcacacttagccacatcaaaactatatttaacctcactttgccgatctttacgaagagtcggcattaagttagaacaaacaaaaggtttatttttgttagtccatgaccattcggcaacataaatatcatgatcaccctcctcctcactatcactagcatcagagtaatcaactgcattaacattaggatttttgtctaatggtctagcaaattttttattatctttaacctggctttcttgagccagagccctttacataagttgactaacatcaagaaattgttggccatctagtttttctctaagaggagcaactaaaccattaaaagcaagaccggccaaatctctatcagttatattcaaagtataacatcggtttctaacatctctaaatctcttaatatagtcaacaacagattcattatacttttgcttaaccgatgttaaatcacataacctaagctcagtttctccagtatagaaataatcatgaaattgttcctctaattgagaccaagtatgaatagaatttgccggtaaagaagtaaaccatgtaaaagcattaccggataaagataaagaaaacaagcgcaatttaaaagtatcactattagcctcaccacattgcgctaaaaattgacctacatgttcccatgtggtcttaccatcttcaccactaaatttggaaaattcgggaactctataatttctaggaaacgacacattatcataataatcgggatatggctttttgtaagctctagcacgattcctagtttcgatcccgaatctattcctcataatatcactaatcatatcctccatgttattaggcccttgtggatttggtggtgggtttggtggcctaataggttgagtttgtgacgcaatatgattatattggccttgcctagtatcgggaggatatcccctagaaacatcattataaacgttagaaatatgtgggggaatttgaggattagtggtagcagtagatacaggaggatcaaatgttctaaagtgatacaaataactagcattagtcattggatcaattccctgtatcgggacgattgcgccggtctgaccggctcagggcccggtctgaccggcgtcatgttgcgcggtcggaccggcctgagggccggtctgaccggtgggataatacccggtctgaccggccatctggccggtcggaccaacggctgtgtcgctgtctgaccggccatcaggcccggtcggaccggccgtgaacgccgctccgtcggttttagaccctattggatctatgggagattgactaacagtggtataggctttatcttttaatgtgtaatcatccataagagaacctagcctattccttaaaaacccatcaaccttttccttaaacattacatctaatctatctttaaaattaaccatagatgaatctattgtagatgcaatttgttggttgatagattgcgatacctcgtcattacttaccatgtcgggagcgagtttgggacgtggcccgggcttgatgatcacgccttgacgagtcctagtagttgctctcatcaacg

SEQ ID NO: 22859 - DNA, 16950 bp, Oryza sativa
  unsure (1)..(16950): unsure at all n locations
acagtagcccatcatcgcggatgaaggcttgacgttccggggcctgccggcgcactttctgccggaccggccttgcgcccggccgcacggcgagacggtgctcaatcacctccctggggaccccgggcatgtccgctgctattggatctatgggagattgactaacagtggtataggctttatcttttaatgtgtaatcatccataagagaacctagcctattccttaaaaacccatcaaccttttccttaaacattacatctaatctatctttaaaattaaccatagatgaatctattgtagatgcaatttgttggttgatagattgcgatacctcgtcattacttaccatgtcgggagcgagtttgggacgtggcccgggcttgatgatcacgccttgacgagtcctagtagttgctctcatcaacgcctcccgtgtgagctcgttgatgtgctcttccatggctttacgatcctctccttcaaagtcatccaatgtgaccggtatcacatgagatggctccacctccgtcttagatgatggcttcgtcatggcgaagtcgaagtcgagttgacgatgaacggatcttgtccccagcggagtcaccaaaaatcgtgttggcaacttttttgacaagttgacaagcacgatcgcagcaccttaagccttgcggtgatcctagagtcgccaaccacctcgatttagcaaagagctaagcctagatgggttttgataactaaaccggctagtggagccgatttctaaataactacccgtctcgtgggcaaaacggaaggttttcaggacaaacctacaaagagatgtcgcactctcgcagcggcagcggacggtttacggcgcaaaccgacaaagatggacaaactaagagaaaactaaaagcaatatgaaaagaacgattcgattgattgatagtagattattttttacaatgaaccggccttgtcccttatataggggttggtcttgccctctacaggcccttcttcacgtccaactcggggtagaaaccaaaggaaacccgaaacatgccttcccgagcaaggaaacctcgaaacccgacgcaacagaatcggattcgggcctgccggtcagaccggncacataccgncggtctgaccggccttcaaccggcggtctgaccgtccaacacacggcggtcagaccggcctacctcgaaggaaaccagtagacttccaaattttggcaatatttcctattttaagcctaggtgctaaatttgggtgtaaacaggaacctcgggggtcggtcgttgtgatgttgcccgtcagtgccgccacccgggccagacgaggaagaggacttttccttgtccttcttcaacgtcgcgacgtcggtctgcagggcggcgatcgtgccggtgaggctctcgatcagcttggcgaggtcggcgttggagggttccaccattggtgcggtgacggaggtggctgatggtggagatggtggagggctgagtggtggcgcggcggctgggaatggagcggcggcgttgggtgggtcggcggagcaggaggatgaggatcggcgtgaccgtgataccaggttgtcaagggcgtcaaggcccctggtagctggaccgcggctacgtaattcgtagccggaatccgtcttctccggcgaggttttacccctcagccgtaggttcaggtttgggagagagaagaggagattaggtgagtgattcttgattttttttctccacagtgccgaatacaagactcaaaaatagtccacagactgaatcgaacatgcctacaattaaggaagaaacaaggaaactaatcccttctttctaatcttagccattcccggtggcttcctcagctgtgcgctgggcgcgctctgtagcgcggcgcacgtcacgcgcgcgacggcgtctcgcgtacgtgcggccccacatgacaagtagatcctgctgaaagatgacctgctttagtgcattactgcgaaggtcatttttgttttggatcatagcaaaaatcaccgagttggataataccatagcatatgccattaacatggcccccgcatgtcattctcacatgtaatggtatttctaaccggtgcatctttatactactaatttttctgttaatatagtgatctcataaaaaagaagaattggaagcagaaatgaacacaagcatgatacactggcatggctgcacctgcaaaaaattactgaagaaacaaaacttacctgctatcacagatgcaatattccaattgtctgtagcagcagttcaaggttcgtacacagatactccctccatggctccatccataaatgtttgaggcgctttgacttttttaaacatatttgaccgttcgtcttattcaaaaatttaagtaattattaattcttttcctatcatttgattcattgttaaatatacttttatgtatacatatagttttacatatttcacaaaagtttttaaataagacgaacggtcaaacatgtttaaaatagtcaacagcgtcaaacatttagggaagaagggagtagtttagatagaagtaggtaatttggttgcttgtatggtacaattagagttgcaacgagatgctgcttgattgtttacttattttgatgggtgacaaggttaaatagatctgaggtgtgatagacagatgctttgcaacccctcatctgccttatcccaccctaataactcagtacttagcagttagcaccagcaagatgcttattgtatttgctgaacatgacgtagggagcatttctcatttacagatatattcatatagttaatacacataactggtcctcagaatctaaaacttaataagagcaaggtcaatagtatagctaactactggctccaaaacatctatagccaatctaatagcccattcatacaatagttaactataaaaatatactgtaccattaatacacggtcccacctctcatacacacataacatcttggagtccgtgttgcagccggctacaaatctgtagcccgctttcttctctctcttctcttttcttctcgatatatgggtacagccggcttatagcctgctattgtacctgctcttaagcgcatcccgcctgggggtctggttccactaattgcactatagcaatcacttgtaaataaccataaatgttggggtttaccttttctttctaaaaaaaactacttttcctgcggtgtgcacacggaaagcttgtgtgcacaggatacgttcacttaatcaaaatatcaatcaaatctaaattctcttgtttggtatttgcaggttcacatgtcaaagtaattgcaggtactgctcaatccaaatcttcctttgttcaaatcaaagtaaaaagaaagaagaaaatctatctgttacatacagagtcttatttttatctactactgtcatacattctcttttacacattacaatcaccaagtctggtgtctttatattttctatcctaatcaacgtgtcgatagtatgctcctccttcgatttatgtggtagcatggttttcccagcatgttcctctattccattttcctgagttataagaccttagtatcaataaaagttaggctatgagactttgggcagaaagaatgcaatgcactaatttctctctgcataatcagctacatcatcggttaccgcatttgttgttcttttatcaatggtagccattgcactttatctttcactgaagacaagatataacgaagagatacacatgaaggtagaaatgtttctcaaaacgtatggcacatcaaaacccacaaggtacactttctccgaagtgaagaagatagcaagacggttcaaggttaaagtaggacaaggaggatttggaagtgtgtacagaggcgagctaccaaatggagtccctgtggcggtcaagatgctagaaaatccaaaaggagaaggagacgaattcatcaatgaggtcgcgactatcgggagaatccatcatgcaaacattgtccgcctccttggcttttgctcagaaggaacaaggcgggctctcatttacgaatacatacccaatgattcgctggagaaatatatattttcacatgattctaatacttctcaagaactcctagtaccaagcaagatgctagatattgctttaggcattgcccgaggaatggagtacctgcatcaaggatgtaaccagcgtatcctccactttgatatcaaacctaacaacatcttgctggactataacttcagcccgaagatttcagactttggccttgcaaagctgtgtgcaagggaccaaagcatcgttaccttgactgcagcaagaggcacgatgggctatattgcaccagagctatattctcggaactttggggagatatcttacaagtcagatgtttacagtttcggcatgctggtactagaaatggtcagtggaaggaggaattcagacccaagtgttgaaagccaaaatgaggtttacttcccagagtgtatctatgaacaggttaccactgggcgggatttggaacttggtagggaaatgactcaagaagagaaagaaacaatgagacagctggccattgtggcactatggtgcattcaatggaacccaaagaaccggccatcaatgacaaaggtggtgaacatgctaacagggaggttgcagaatctacatgtgccacctaaaccatttttctcagctgatagccatcctataatgtaagacttgcagaacatgctgccataatttagtaaaagaatatgtgatagataaactaaatgcaatgtaataaatgcatagcgacagcatgcaatgtattctcttattgttccattctattagccacctgaaatacattcaacgatgaaattggaaaattgtagttcaattgccacggatacctcattctgttgatgtgcttttgcatgcccgtgcatttgttgtgctctgtgagtcgtcaatatgaccaattcatgagccagacgaatctggtggaaaactggaagtgaataattaactccataatttatatagaaaagaagagctgaaatcaaatcaaaggtgttacctctgtcaattcgaagtgtaggagtctgatctcaactcccgagagctgcaaacctgagcaggaagccctcacatagctagcttgaggagagggaggtggaagctccggtctgggaggcggaaacctcggcatggttaggagagagaggtgtcgcgagcggcacagaagagaagggcggaggtggctccggcgatcggccagcgccatggtagtgtggcactgcagcctggggggcggacgtttgagcagctcaggtggcacgtcttcctcgggaaccccacgcgcctccggcgagccgaagaggcggcggggtgcgccggcgaccgagaaggtgaacgacaagtgaaccaggaggaatttccctagccccaacatcccttccagcccaaacaaatgggccgcacgtaattccccaaccctttgttgggccgcacctggtcctaagtcagaatctgtttcggtcgaattactgtgggccgttccattccagcccacacaatcgacacgaaaggtggcagtggcaccctcctgggctgtcctggcattggtctgactagagtttatacaaaaagagagaaaaaacgcaaagcaaatgaattttaccatcatcgatgcctgacattctgacaaggagatctctctcgccgtgtgtttcggtcttacaacaacagcgacgagatttacgaaaagcagcaaaacactaagtcttgtgtaaactctttcaaagtcttaatctttttcagatactcggtaaatagtacgagctcactttatttgcttattatatgtgctacaaacttacaatatacataaaaactattgaagttacaatatatcgatctcagcatattgaagtttcgacagcaaaatgggcatacaaattaagtaaatacagtcatcataaatgtacttgctactaagttactggtagctttcgaacagacatatgctttcgtcgtcgtcgtcctcatgctcctcggagattgcagttagatcagatggcatattgtaagactccactccagggaattgctcatcatcacagaagaatggccttggaggaacctgcagttcatcactaccaccttcaagcatctctatcacctcgctcatcgtcggtcgatcacacgacctcatctgaatgcaccataatccaacaatgcaaagcttcttctctagttcatgcatgtcagcaatatcagagatctcgcttgtttctcgccgagtcagctccctgtacacccgtgatggataatatgcttgacttttttttttcgccgggtcggcaaagaacgccgaccatagtatattaagaatttggagaatgtacagagatggcgaggcttcacagccaccgcctatttacaagatgccacaccactatccggagaacccggaggaaaccacagaggggcctctcacagcgcccgtaacaagctgggcggcttcccaagactcccattcatcttcaatggctgcgcagagcaaagaagacgatgtcccacgccctcgaagacccgagcatttcgttccttccaaatcagccacgtaattaggatgatgcccgcgtcaaacgtttttctatcaatcttggcaatcttcttgcgcgcttcgcaccaccacccctgaaagtccgaggcaggcttcgggcagcggagaccaagtcgatcccggacggactcccacactgcctgagtgaaggaacagtgagtttgctgcatttggatctgcattccttcttcctccagccatctccaaaagtagcattccgaagctataaacatcggatttgcttgatatgacaccaaaactccgagagatcatctcaggagctatgtagcccacggttcctcgtgcggcactcactgggacaaagctcttatctcttgggtacagcttggcaaggccaaaatctgcaacttttgggacaaagttatcatcaagaaggatgttatgcggcttgatgtcaaagtgtagaatctgcatctcacatccctgatgcaggtagttgatccctcttgcaatacccaaggcgatctcattcagcttgtcccaggagaaactcttctctggcgagaagatgtacttgtcaagagagcctcgaggcatgtactcgtatataagtgccctcctcatttcttcagtgcaaaacccgaccagacgcaccacattgacatggtggatccttccaatggttgatacttcactgatgaactcatctccgttgcagctggagctaccagtcagcatcttgacggcaatatggagattacccgggagcaatacacctttatatacagagccatagcctccttggcctagcttgtctcgaaaatgtgatgtgattgcaataatgtctgtgtaggcaaacctcatcggaccaatcatctgctgcattcggaggaacttctctaccgcgtcgatcgtgatccttgttttccagtacttatgggcaaggaagatgaatatcaccagtgaccccaacagtaacctgaataaaacttctcaaacaaaccaacatacatgtatataagttagtatatatatgttcatacatgatatcaccggtgtgatgattaaaagcaagtaattcgtacgtaccgaaatgaaacttggtgatatcaatagccgataccatgattcccaaaaaaatcatgtctttcttggaggcacctagattactgcaatctacttcggagtatgtttcattccagaaaagagcacgggttaaatcttgaatgcttgcacgagatgtatgctgcttgaagtacctgcaaatcacaccattgtacaagacggggttataagtgaaggaaccacatctgttttataaaaacagaatcatgagaaaaacaaaactaattaacttgcgtttgagcgcagactcacctctttgaacccttcaggcattccgtgacgctgatatcattactctggtaaggaccaattggaaacgaaacactaactcctttccttatgaatcctatgatatctgtgtaacttgcattctgtagctgtgagtccgatatatgccaaccatcaaagggaatcatggccaaatatcgacatgaaggttgaaactctccaacggcacagtcatcaaacgagacaaaaacaaatgaattgttgggaagcagacatgtaacgggcctgtaccttggcataatatctgttattgctcggaaacaattcacaaagcatgcccaattgcgtgaaacagtgtacaaatcgatagcgccataagaatcagttgaagttttccccgaatacagacgccagtaattcttcgtgtaaggaaggtgatcagagcgaggaagaggacaactgctgccgtttgtatcatcatcttgcaaggtggcatccacaacccagaattcctccccggtatagttgatgctagtcacgtagtacgtccctttgttgatctgaatggcagccctgccattgttacatgagaggttgtaccatggacgaggagtagcaacgcactgacgtgaatcgccttcaagacggaaagggtaggatatgttgccaagatggccacaggaggaaggaggacagtactgggggtttagccctgttccaacaacttctgctgcaacaaccgcaagcaaagaggagagaagtagagatttcgccatggctgcagcttccattcccagtccgtccctagagaaatgaccactataattggcagggattagccttgctgagtattaatttggtggggtcggggtgggtgctttaactggggagatactgactactagtactatctttttctttttcaatgtatgattctgttgacttttcagataatatttaattgttcttcttattcaaaaattcagtgcaaacatatatatataaataaagtaaggttagggtctctttgatgacaaaataaatcacaacaaaaaaacattcttataaattttttgagcaagacggatagtcaaacgttatgacaaaagttaacgacgtcatacattaaaaaacagaacagagtaactatctctctttcataatatataaaagaaatagacttagaccaggtattagaaaaagtatgtaaaattaaacgagagaatgttgtgattgtttaagagaaaaaagtagacaaaaaaaatttaaatattgaaagattgtgattggttgagaaggaaatgtaggtaaagaagttgttatattttagaacaaattttaaatactaatagtagaatttgttttattttaagacaggaacgagtattaatttttgggacttttatggaagcactcaatttccacacctgtcaatttcctccgtgtaatacacggtacagtacctataggtaacggtcaatcgcgatccaataaagtaggagagccaagctcccccatttccattaagagaaatgagcatttgccagatgtttgagggtttctacaaataaaccctttcccagacagataacaggtccagctaagctaaccaagcaaaccctcaaaagatctacctataggtctttttccacacggcaggatggatgctgctgcgattcactagactgcaggcagcttccggccgggtactacactgtggtatagtggtgtccatcttttaactcgacgcaacgcaacattgccctgccttgcttacttgttggatcgtctccatctcgcctgcctgtcacagtgcatacagaaaataggatgagaggatttcttgcagcaaccctcctggtgttgagccttcttctcaacctgcacacagcagcgtcagtgtcagcgtgggaagacaaggatttcttcagctactgcccgccgtcgaggtgcggcgagcatggccccgagatcaggttccctttcaaacttgaatccaaaaatacaccatcgtcatgtggcgtgccatgcatgaagctatcatgctctggccaatataccatcctacataacaaataccttggaaggccatacaagttgaccgccatagattacaagcatgctctcctgaccgccgtcccgctcgcagacgaagacaactactcctcaccgtctccctgcccacttctaaaatccatatctatcaggccaaacttaataacagggccaggctatggttattacaacacagggtaccagaacccttgccaaacatacgatacctactatgcagcactagtaagctgttcaacagaatttgccctagctagtgtccctggcactgccaccgataacgattatattgctggccccatctcttgccttagcaaccaaacccacttctcctatttggtggcttatcgtgtaactatgtctcttcttccgttggactgcgaggtcatctcagatggccccattccgataccagctttttattactccggttatatcccatccatgttcacaacaagtgcagacagaatcctcgactatccttccggttatgtcttatccacgttcagagaaagtgcagaaagaatcctcaattcttctgagaccatgatctggtggtatttctacaagtacgatggcagacattgtgaacaacaaggccgacgctgcgcattcagctcacaaaggaatcaaacattctgcatgggtagaggtattatttcttactggccaaacaactactcctatacaactcgcagtaccattcttgtttatcatctgtaagttttacaatttccaatttacagccccacacatatccatgctagtgctatttgatcgtcaaaatccagcaaaacactggcaattatgcccgatggataagaaaacaatatttatcagcacatgagcatcacttatattatctttatttaagacccacttatattatctgatcatcttaaaaactgaaagcaggaaatgaccataaccttgatatgccagcacattcatgcatggttgcacttgaataaagttaccaaagaagcagaacttatttggtcacaactgtagcattccgattgcctgtagcagaagttcaagggatacaggtagctcagatgggatgagacttgagggtatacaagtaatacctccgttttcaatatatgacatggatgactcttgaacatacttttaatatacttaaaaatggagggagtaggtattttggtctattgtgtgatacaacgagagctgcagtaagatgatgcttggttgctttgatggctgttgaggttaacatagatctgagatgtggtgtgtagataattttgtaaccctttttccacgttatcccaccctaaccattcttaatctgccattccgtcttgcttagccaccatcattagcacatggcaacttgcttattagtatgagttatgatatctgctgaacaaaacgtagggatcatttctcacttacaaatatattcatatataggccttgtttagttctaaatttttttcttcaaacttccaacttttccatcacatcaaaactttcctacacacataaacttccaacttttttcttcaaacttccaattttagtcaaatttccaattttggtgtggaactaaacacagccataattgaataattcaaacacatctgattccacagaatctaaaacttacacgcactccactgggtgtctggtcttccatactgcactatagcagtcagctgtatacccatgtcagattttaccttttctttctcaagtcaatttctcctctctttttttcctaacgaaactatcgatcaagtctgaattctcttgtttggtttttgcaggttcacatgtcaaagtaatagcaggtattggttcaataatccaaaccttcttttgttcaatgaaagtaaaataaaaggaacaaattaaagttatctatcacatactaagtcttattattagctcctctggtcttataatctcttatcattattacaatcctaatggtggctctctaatttatattcgtaatcaatgtgttgatagtctatttgctcttctgtttgtacggaaagatggttttgccagcatattcctctacattgcttttctgagctaagtcttataaatataagttgggctgtgagccttctgtctagaaacaacacaatgcactaacttttattatctgcatcatcagctacatcttcggttgctgcatttgttattcttctgttgatggtggccactgcactatatctttcactgaggacaagatataatgaagagatacatctgaaggtagaaatgtttctcaaaacatatggcacatcgaaacccacgaggtacactttctccgaagtaaagaagatagcaagccggttcaaggttaaagtaggacaaggtggatttggaagtgtgtacagaggtgagctaccaaacggagtccctgtggtggttaagatgctagaaaactccaaaggggagggagatgaattcatcaatgaggttgcaactatcgggagaatccaccatgcaaacattgtccgcctccttggcttttgcttagaaggaacaaggcgggctctcatttacgaatacatgcctaacgattcgctggagaaatatatattttcacatgattctgatacttctcaagaagtcctagtgccaaacaagatgctagatattgctttaggcattgcccgaggaatggagtacttgcatcaaggatgcaaccagcgtatcctccactttgatatcaagcctcataacatcttgctggactataacttcagtccgaagatttcagactttggccttgcaaagctgtgtgcaagggaccaaagcatcgttaccttgactgcagcaagaggcacgatgggctatattgcaccagagctatattctcggaactttggagagatatcttacaagtcagatgtttatagtttcggcatgctggtgttagaaatggttagcggaaggaggaactcagacccaagtgttgaaagccaaaacatggtctacttcccagaatggatctatgaacaggttaccgctgggcaggatttggcacttggtagggaaatgactgaagaagagaaagcaacaacgagacagctggccattgtggcactatggtgcattcagtggaacccaaataaccggccatcaatgacaaaggtggtgaacatgctaacagggaggttgcagaatctacaggtgccgcctaagcagtttttctcagctgacagccatcctactctgtaagacttgcacaacatggtaccataattcagtagaggaatatgtgatacatataaacttagtacacattttgcaataaatgcctagcattagcatgcaatatattcttattatgccaagccacatgaagtgccactcttcactgtataaaaattcaatgagggaattggatatttgtggttcagttgtcgtgggttaccttattgtgtcgttgctgtgatttatcctcaccatgatttattctgtggtgctccccctgtgaagttgtctgaagtccttgtccaatttatgaaccagaatctggtggaaatttcacaggaggattgtattaactgtgtgagtaagactcatatctgtcccatcatggaattgagcgcagtagttccaaaatttagatagaacagaagaaatcaaatcagaaagtgttaccttagtctatggctatcgaaaagcagcagcgatcatcgcgggaagaccgaagacctaagacctcgactcgcttgcgggggtcgtctttcccagcactattaccctccctcctcatcccatccaagcccccagatcccgcgagatgggtggtggtggtggaaggtgacgacgtggaccacatggggacgggatggagaccggggaggagnnangagnnagnaggatanagnaagatgcaggtcggctccggtgtggggnacacggtgagcgcgcgncgncggagaagagtggtagncggctccggcgaccggccagcgcgccggcggatgaggaatgctggatgccaaggcaaaggggatgctcggctcgcgaaatcgccgccgccgctttagccggagctcgccgggaagtgtggtggggcgaaggcggagcaatcacaatctaattaaggcctagtttcgatggcccatctaggcctggcccatcaagtcaatcacaatccctttccggcccagatatatatgtttgtgggctttgcaaaaggaaacttaattaacaagaccactaaaatcctgccattagcaatggtcatcttgataacttggtcattagcaggcagcaggttagcagctagcacaaaaatactactccctccatcctaaaatattttgacgccgttgatttttttaaacatgtttaaccgtttgtcttattcaaaaaatttaagtaattattaattattttcctatcatctatctattatattattaaaacagctctgaaagggagcaccacgttcggtgcgggagatagaaattcccacattaatcgaagaaaaacaaaaaaaaagaaaaagagagtccaagtagaagtacaatttaaaaatagctgaaattcggaattaaaaataagcaatagtgaaagaagtttccatataagaacccaatacgagattaatcaaaattcaaaataaaaataaaataaaatccaaaattagaaaagaaaaggagagcccgagtagaaatacaatttaaaaatagttgaaattcagaattaaatataaacaatattgattgaagtttccatataagaacccaatacgagattaatcaaaattcgaaataaaaataaaataaaatccaaaataagaaaaggtgatgagagtccaagtaggaatacaatttaaaaatagctaaaattcggaattaaaaagaaggaatattaaaagaagagtccatataaaaacccaatacgagattaattaaaattcagaataaaaataaataaatccgaaattagcaaaagaaaataaaagaagagttcaagtaggaatacaatttaaaattagctaaaattcggaattaaaaataagcaatattgaaagaagaatccatataagaacccaatacgagattaattaaaatttagaatagaaaataaaataatatccaaaaatagaaaggggcaattgcaaatttatcactactttgaaccgttattacaaaactgccactagaaaattgcaaaaatatcactagaactgtcattcgagtggcatccttgcaatattgaaaaaaccagtggtaaatttgcaaacgccccaaatagaaaaattaaaagagagttcaagtaggaatacaattttgaaacaactgaaattgaaaatataaaataaaaacattaaaagaacacagtacggtattaactaaaatttaaaaaaaatctgaaattagaaaaagaaaattaagatttcaattaggaatacaatttataaataactaaaatttgtgataaaaattaagattattgaaagaaaagaccatctaaaacacatgacgagataaattaagtaacatgcctataaaggagtagagtggtggcggttgatatgacatataaaaattgttaataaaacacctaatagaatcctaatgacgattaaaaggagggacgtcagacaggccgtgaagtaaacgagtaaggcggttgtcgggacttctagaaagtaaaaaaacaaaccccattgataatcatattcgatttttaaaatctcaatgataataaaaaggagaagcagcgggcggggtgtataagagtatagttgcagagccgccgacggttgacaggacttatagaaaataaaaaatgaattccaacgatagttatgttcgatttttagaatcacaatgataataaagagtaggcggcggacgggctgtagagggtgatgaggacatcctccactattatttgttcagcctcggccaacctcacctgggggcatagtggcatcgtttgatgtgacttttaaaacttaataaaaaattaaactacaagtccaattttaaaggttcggaacttttaaaaagttaaaaaaaaaagaaacccaatgataatcatgttggattttaaatcttaaatgataataaagaaggaagccagcgggcgacccgtagaggagtacaatggcaaagccgctgacggtttggcgggacttctaaaaagtaaaaataaacccaaacgataattatgttcgatttttaaattctcaatccaataaagagaagagcagtggcaacgtttgacgggacatctagaaattataaaaatgaaacccaacatgacaataaactccaaaaactataaaatccaatttttaaaggttccaagaagaatgaatataaatagtggtagatcgagcaagtaaataaaaaagaagatgacataaggggtagcaactggtgtgacttttaaaaactatataattagaaacacgaggatggtaaggtttggtctttcaaagtcttaagacaatgagatagctatttaacaaattttaagtaaaatcatacttaaaaaaaatatgattttgtttgggtgctagccgcgtaattgcgtgggccacccagctagttatattattaaagaaatagaaaaagaagcctccacgtttgctcccatggcctagaaattctgacattaatcggagaaaaataaaaaacagagtccatataggaatacatttaataatagctgaaattcggaattaaaaataaggaatataggaaggtaggtctaaagtccatatcgatatacaataaaactaatagaaattcagaattaaaaaataagaaaaaaaataaatgtagaggttagaatccatctagaaatacaatttagaaataaagaaattcaaaattaaaaaatatattggatgaagaatatagagtccataaagaaatagaatttaaaaataattaaaattccgaat

SEQ ID NO: 22860 - DNA, 1592 bp, Oryza sativa
ggtctaaagtccatatcgatatccaataaactaaatagaaattcagaattaaaaaataagaaaaaaaataaatgtagaggttagaatccatctagaaatccattttagaaataaagaaattcaaaattaaaaaatatattggatgaagaatatagagtccataaagaaatagaatttaaaaataattaaaattccgaattaaaaaatattgaaagataagtttagaatccatatatagaaatacaatttagaaataatataaattaggaattaaaataaggaatattggaagaagagtatagaatccatattagaatcttaaaattcagaataaaactaataaaattaaagtagaatttagagtacatatagaaatacaatttacaaataactaaaattagaaattaaaaaaggaatattagaagttcgctctcatgagacacgcaaaattatgttgtcattttaatatatttgaataatacattgagaaaacatatatgttattataagagagaaactataatgatgctagctgcgcaatctgcgcgggccaccatgcttgtttgatttattgttaaatatacttttatgtatacatatagttttacatatttcataaaaatttttaaataagacgaacggtcaaacatgtttaaaaaagtcaacggcgtcaaacatttagggatggggggagtagtttattcatagtcattttacatacacgtaaaacaacttcaatctgctaggtaaataagttcaagctggactagcttacaatggtcttgtactccatctagtgtaaaattaatattagtgaacgctaattgctagattcaaatacttcgctcatagcctagcaagcaactactatctagttgagttattccatccacatcctcctcctctgagatcgcagtcaactcggaggagtaaaggcaaattgaatccatcacaggcacaggaggaggcggcgtgctatctccatcgcagaaaaatggcctcggaggcacttgcaacgcatcaacatccccttcgagcatctctatgacctcactcattgttggccgatcatatgatttcatctggatgcaccaaaacacaacaagccacagcttcctctctttctcatgcatgtcaatagcactagatatctcatcaacttgttgatctactataagctggtcatacacccatgctgggtagtatgccctactcgaatttgagtttgcatttgggtctgcgttctttctacctccagccatctcaagcagcagcattccaaagctataaacatcggatttgctggatatgacgccaaaactacgacatgccatctctggagccatatacccaaatgttcctcgtaaagccctatctgacacaaagctcttctcccttgggtacaattttgcaaggccgaaatcagcgacctttggaataaagttgtcatccagaaggatgttgtctggcttgatgtcaaagtgtagaatctgcatctcgcacccttggtgcaggtagttgatccctctagcaatgcccagagcaatctcattgagcttgtcccacgagaagcttgagtattctatagtgtc

SEQ ID NO: 22861 - DNA, 717 bp, Oryza sativa
aggtgcccgaccccttgtggggtttgcactatgtacataggtggggtgaacacggtagggctcacctaaccgcattattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgtcccgtcaagacgagagcctctaggcactcgtccccagctggagctagcgtgatacatcccagagatggcacgttagccccgatcgatatatgccaggcttcatcctaaccattacaggcaagatgttgtgtgaagaagggcaaacatgcacgttgctaagctgacacgcggtggacaagaatgaccgattggtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttattgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaaca

SEQ ID NO: 22862 - DNA, 629 bp, Oryza sativa
agaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatgggttacgtctacgtgactatacagatacgta

SEQ ID NO: 22863 - DNA, 1052 bp, Oryza sativa
accctcacgaacctgctttacccaaggcctacgatagtttggaccgaactgccaacccgacctgggttcaagctcgtcccaagccaacccaggccaaccattccatattttagttgttgagcaaattttaagaattaaaacactgacttgggtgcattgctaggcttgcccatatccgagggctgggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatccaacaattccatagtgtccaaatgatatgagaattcccaaagtctaaagttataaaaccacctaatgttgcctaattattcagcgaagcatctacctaaatttatactagtggaaccatgaatagagtacccactagttggggtttttattttcctagggtgaacaaggtaataataacaatagcaataataatgtcataacaaacggaaataggcatggctaataaaacagtggtaacgcgg

SEQ ID NO: 22864 - DNA, 452 bp, Oryza sativa
aggaaggtggagggggtgggtgaaaagtgtccagacctgtgatgacatcagacagcctctgagctactgcagagaccccctatacctatggaccacttgatttggtgacattttcaaaatatatccaaaatctgactatttctcaccacccccagcactgccatgtgccccaggccaccaccttctctccccacagggctccccgctgctgctgtggcccctcccaagctattctccacatggtagccaaagtgaacttctatgaacttctacaaacagatcatgcaactcctcccccagaaacccccaagccttctcttcccactctgtgaaatggccaaagcctttaccacatggatgaagtcctctaagacctgggcctcgccgacttcactgacctcaccttgcaccactcccattgcctggaagcccctcaaagacacagagcacac

SEQ ID NO: 22865 - DNA, 15736 bp, Oryza sativa
  unsure (1)..(15736): unsure at all n locations
nnnnnnnnnnnnnnnnnnnnnnnnnnnnnnnnnnnnnnnnnnnnnnnnnnnnncaatgctgattcattagtgttaatatcgaccatttccagataactatcaactgtgcatttttgatcttcatgagtacagaacctcggttcagataagtaaacacagctccatctaatgttggaggtgcttgctacaccaaaaccagtgttgaagtacttcgacacgaaaaatgcaatgtcctcggaatcttcaaccttggaccacaacggattctcatcgaggaggttacacttgtagaccactatctcataccttgtccaggtagtgacccgtaaaatggcgccgacgaggtacaactcgccatttatgtccatgtagctacgctggcagatatgtgccggcggaggcatcaagagcaacaggctcgccgtgagaggagctacaccatcagtgttatcgacgctaaagattgagatctctccgagggagccaatcgcgacaaacctgtcccggcagtgcaccacacacgtcactgggtactcgagcttcgaatctaccagtgtccatctggcgtccccgagccggcagaaggcgaccaacgtcgagctcgcgagcacggccatggccatgcaatcgacacctctggagttccttggcgacgcagacaacacgatctcacggaagaagacatccctcatgttgctcaacttgatgggcttggtggcaccagaaatgtagtgcagaatccacgccccgtcgaccatggacaccgtcttgtaggacgccatggcgacgttcctgtcggccggcgggagcgcgacggcggcgccggtgaacgggttcagcagcgtgacggccgcggcgccgtccatgagcgccagccacccgtgggacatgccgcaggcgaccttgccgcgtacctcggggaggcgcaggtcgatggtggcctcgtcgtcgtcgtccatggcgcagtagaaggtgaccacggcggcgtcgccgtccggtgagtccggatcgaaggggagcatcagcatcgggtagaacgtctccagcggcagcgcggcgcaccacggcgagcagaccaggcggaaggaggcggcgtcgcgcccggacggcagcttcttggcgatgaactcgagcagcttccgtgggaggcccgagctccagtccggctccgatctcctctcagcaggcgcagccatggacaagaacagtatgatgcccaagaagatgctgaaaggggattagatgatgcagaaaggggattcagctcaaacaaacggattcaggaagatgaagatcgaaaggggatttgatatgatgatgcagaaaggagattcagctcaaacaaacggattcacgtacgagcaacaatttggctgtgagagactacgcgagctgaggatttggggagaattcgatctctgctccgatgaaaccgaggaattatgttaggagcaagagaggaactcgatcggtgaaaagagtcagcaaaagtaataatggcaaaagatctgtgagcgttttgtgggaagaaatttgtcttttctcccattttttgtctttgctttttgattcttcatcgcatgctctgaggggtgaggtgcgtgagcctgctgctgaatcaccggcgcgcgtacgtagccagttagtaaaggagtttacgtaagtgatgttccgaacttccgatggttccatgatgacacgaataaaccaccagattcactacaaaacatattgatgaggattattagattttttatcaactgcctcgtttactgtaaacctataaacggtgtgatttcttaaaagaaaacttttatataaaagtttttttaaaaaattcaaatataaacctatttttttaagtttataaaaattaatacttaattagttattttctagtgattcgtctcgttttgcatatggtcatttagctaaccgaacatgctacttcgaacaagccctaagtaacaagcaagagcatatctccgggcacatttatggcaccacatagctagagtgacgatgtagctagagtgatgtgataagtattttttttgaacgactcgtacgagacggtgcgaagttctattgatagagcaggaaaaaattacaagattacaaccctggcggatcgtaaccaggaaaaatgaaaaaatatagcaccacccgcacaccgacagcgccaacacacaacccgggagaaggctagcaccgaaccgactgccgctagaccaacaaaggaacacagacaacattgccccctaggggatgccaaaacgacgtcttcaagaagagaagcgacggaaaaaccgttgctgccgtccgtcggggctcaaaggagccaagactgggctttcgcccggcaaccactcttgaggggtgagacagcacgacaacgccctcaagagggggaatgaacaatcgttgtcggtccagctaaggccaggctaggttttcacccgccgctcaccacctgcgaatccatggctgacgcaccgatgctccaccaccactcaagctctgccgacatgtgggaccccagcaccagcgtcccctgccggccaggctccgtgcgccgaagatcatgccacatccaccggtagctcctcctcacaccgaggtcgcctcctccaccgtcggccgcgcctctcgcgccaagccggtctcctccaccggatgcgtctctcgcgccaatccggcctctctccatcggctacgtctctcgcgccaacccagcctccatctctgccgcctgcgcctctcgcgccgagccagtctccgacccctcctccaaatgatgccacgccagccagaagcagccgtttgccacgccctcagctagccgtccgaagccgccatgcctccggtgaccgtggtcaccgccaccgcagccaccgctgccgaacgcccagctacctcgccgtcgccatcctcacctcctccgccacagccacgtccacggtcgccacattcatcgccacaagccgtccgccgtccgccgtcgcagcttgcagccaccagcacctgctgtcgccgcctgcgagctccgtgttgccgaccgcgactccacaccgccgccctccacgacgcctgcacggcaggcctcgccacccaagaggctgcacgaccgcctccacgacgcctcgaccaccacggccgctgcctcgccagccagccgccgcagtcgatgtcgccacaaccgccgccgccgtcattgccgccgtcggcagccgcaaccgccgccagccagatttggttagaggcgtcgttgcctcctcccgcatcaccgacgtcaccaccggctctctcggcacctccaccgctgcacccgtcgtctggccgcgccgccgtgctcgggtactggagccagctccggcagcgtctcccgccaggtcgaccacccaaacccaccgccaaacctcgccgccgagctaccaggacgccgccgcccgtcgctgggggaccggatccgggcaccacggcactggatctggacgccgccggtcggcgccgacgccatgccctgagctcctgccgtgccgatgtcccgaccgtcttgaccgcgagcgagggagagagagccccgccaccgccgtacttgcagccgcctggctttgccggcggcggctcgggcggcggcgaggctgggagggggggggaagagaagggcggggacggcgcggcttgttcgccgcccgcgtcgcccccggacagagcgaccgggcagcactgagcaagtgtgtcagtttatgcgataagtatggacaaaattgttttgtttatatgggaaaggagctttgaactttttgctgtgtggcaagtttgtatcttgttgtttcgctagcaaaacatgtgtctcgcaatcatactttatgtactcatacttaacttgctgcatgtgtcttagcggacgagtccatgtttgagaattagtggatctggtggatccatgcatgatttatactgcaaaccaggctccatagatagttggtttttgataactattcatgggcacaaacaaataaactaactgttataagatagaaaaatgtatttaaataagttttctaagaaattcatatacgggaagttctttttgtttttttttttttgaaaattgctgaattgaatggttctattcctttagatattcgaatatgcaaggtttttgtaactatagtttgcaaaagaacaaaccatgttggtataccatgactaaaagaatacaacttttaaaagttcagtatttgtgatggtttgtcttttacccatacttttcacaaaaaaattggttaattttttttgataaatttgataatggtgatgtcaaaaagtaaatatatacacttgtctgatagcatgtatattgtacaactcatgtttatcgatggcattttgtatgagcaagtgttgataacactttgtatattttctctatatcactaaaaacacaggtggctgcatcatttgtgagaagtctttgtctttttttcctcattatttccgtttgatttttcatacttcataagacatgctgcagtggtgaggtgagccttcagaatcagcggcgtagccagttcttaaagaattgtaactgatgtttcgatggttgtccataatgacacatctggttgatctcggattatgtgattaaaccactacattcaatacaaaagatttgaagtattactacattaagtgttgtgcaagatgcatatctcggaggatgcaggcactaaaaacaaccccatgtaaaaacattttctttaaatatagtacaaatgcaggcatttataatacgcgtacactcacctttatgaaaaaacactatacccatatgggccagcgtatcttaaggtacagataaagttaacataggcatctcgctgtcgacgggtcgcctaccaccaaaagaataattagctgtaaatgcgagcacctgtgtcaaatctaagacttaaacctaggtggactggttccgtcacaagaaacttaaccagttaagctacgcttcaccatgaagatacatatttatttttggcaattttcatatcatctatttttgtttttgacaattttcatattgcctctaaaattacgagttacaatgtgcagagacacttagtacaaacaatttaaaatttacatataatatttttactctatatatactttagagatatttttagcatattttattaactttatcttatagaggcatcttttatgcctaatatataaaaggtattttcttgagacatttcaaccaatgtagagacacttttgaggatgtttatatgaccaatgcaaacacttacttttgagaggatgtttatatgaccaatgcaaacacttttgattgattccttttaatcagccttggctcccctatgtttaagggaggggcgatacactagaacggataccctcatctcaatcgggcggtaagccccatctcaatcgggcacaacgtccgtcacaggctagaagtcattgatgtgaagagttatctcaatcgggcaaacggccgtcacggatgaatctatctcaatcgggccctaagtaaagcccgtcaccgatagctttgacccatacgaccagtcaaactatagcccgtcacagatgacctatctcaatcgggccacaattagtgctcgtcacagatgactactaacctttatcgggcctaaactagagcccgtcacagatgatactcatctcaatcgggcctaaactagagcccgtcacagatgactactgacctcaatcgggcctaaactagagcccatcacagatgactattgacctcaatcgggcctaaactagagcccgtcacagatgactactgacctcaatcgggcgtaaactagagcccgtcacagatgactatcatctcaatcgggcatttagttatggcccgtcacagatgactataatccataaaaaaaataaattttgttttttggctagcctcaggcctttgctagccatgcccactgcagaaatgacagaaacaaacacagatattcaatatccccagctccccagcatcacccattcatatacatatgcattcacatacacagacatcaatatattttacacaaccacacattcacagccatctcatatttcacatctattcacatatttcacatccattcaaatatttatcatatttcacctgcaaaaccaagttaattggatcaaatatttatttagcaagtcttaacataaacatatgaaatatatacataaatataagcatcacagttacatcatcacagttgcataataagtgttcatcattgcctaaacatataagttcaacattgttcatcattttagtttaagcctaaacattcctttggtgttaattatttcgcggaggatgaagctggctatctcctcgcgaacctcctcaaagctggtaggcagagacttggttattgtaccctacattatcataattctagattagttgatcgatcatatataagtactaaaatgtagttagtctatcagaattgagaccaccgacctcaaactcagccaaagtcttcaccttttctctgtacagaaggcgcatgttgtggcacacatggaatccgcactggtcacctatttgttgcttcaccaggaagtcttttttgtggatgagggtgtcatgtcctgtcttcctgaggcctcctctttgcacgtattgggcccacgcttcatctatcgctagttgaattggggtccaatcatatgcgttcttatcaattctggagtttaggtagtgacatttactccacttaggtgttatgaccagaaggatccaatgggactgtggcattaatatagtgaaagttaattaagtactgaaggaatgtgtcatgctgttgtgtatatttagataacacacttactattgattataggcgcacataatgtactccttgtctcggcaggaccacaaggtgtcgtagatgtagttgatcattccttgacggtcattctggagatttgtgacagtgaccacttgtggatcatggaaggcaacttctggtgcattcttctgacaccattgccaacttaacctacacacaggataaacgatcttgtaagctagttaatccgattgttattaccagattgagttgggcgacaatacttacaaggagtagcacttaaggaggcttgtgtcaaccgctcggagtctgtagaggtcgaatagatccttgaagtcgacgacgatataatttgttggatcaaggaatgactttccatcgtgctctccaaggatatcagtagctttattcggcttcctggcgttagatttctccatgtagtatgcgtgaaggtccttgcaagcggtgcccattgcggcaagcacgtcatctccaaccaatggcatgcctagttggaacccctatggagcgacgtatttcttcttgacctctttgcccttagtctcttcctggcccttgcccagatctagctttcttggagctagaagcgaggactgcacctttcctccccttcctctcccctttgctttgggtttatcgagagtaattctctgaggggaagagtgtgccttcccgctcttcttcatcggtgggggttcatgaatcgccttgctgtcggcctccgttcggtcatccccaaaatccgtgtcgtactgcaactgcacatcgtaagattgtgcatgacgatcttgagcaggaggggctgaaggagcagaggcgggtctctttggtggacgactgcctgatgcagtggttggcctcgctgtaaccctgatctcaatgaggtccttgggccatttgatctcaatgaggtccttgggccattggatgaaggtaccacgggcatttcctagtgagaggacctcgtcgttcggtggatactttagtgggaatagctcatattccggcttcaccgagtcgacttgaacttttgcacagtcgcccctgagttgcgctccatgcactcttgtctctggggtcgacttgtacgcaagtccctcggctgctggaaccgtgaaggtcggcatcaccctaactgtgagggtgcagctcgttggttcctacgatagattaatcaattttttaagaatattatatatcatatggactcgttaagtctttcatgcattgtggacgaaacttttaccgttatgtggtcgacggcgctgtcgaccgatgttggattttccgccacctcagttgatgcgtagctgctgtgtttttgggtgggacttcctaactcttcgtgcgcagcaacagcagcggcctgggtgttctgttgctcttctcggatctcttgcctaatcttggccctcattgactcgagcttttcgtcgaattcagatgtcagctcagctcttatcgacgcccggatcttggcttcaaggcgtgcatctttctccgccttgttggaagaccgcttcttgtactgccacgcgtagtctggtaatccatacttccagggaacagaagacccaatgccccgtgtccgtccacggtgttcattgttgcccaacgctttcgtgaggaggtcatcctcacgtcttcgagagcagacctcttgcgaggcttgttgctcggcaaccaactccttctgcattacaatttagtggggttaaataaactgcatgatcggaacctttgcaaacatctagtttgactagacacttactatagcttcatacactcgttgatcttctggatttggcatgaagattgtgccatcatccttcttctggtacctggccctggcccagttcctagcccaagggtgtgggatatcgccaaacacaagcggcgtgttcgattcctccgcttcttcatcctcatgctgccattcctcttccttaccggcatatccggcggtgccaagccgatgcagatgctggttcttggtctggagcaagcgatatgcctcgctactagctctggactcgggggtcgacttcttcgcatggaattcctcccagacctgttccgtgatccaagaaaatttctctcttggatctggattcgccgggttgtagacgaactcgccgactagcttagtcttgaagttctttcaagcgttgcccataaccttgaaagcagcccgcctgagacggtcctcatgctccgcaggataatcgaagctctccttgaacgttagccaagcaatgtccttctctgcggccggcacgtgcttgatgtcatcttgcagaatattgaacttctgcctccctatgaccccgcagatagacctaaatcgactcaatattttccttggagatgtcggcaaccctacggcgtccaccactgttatgcggaaccgttccttagggattttgttccctgtcctaggagtacgtgcccttgaggacccactagttgtcgtcgacaatggttcgccttgctaagacatcgtatacttttttctaaataacgaaaatacactatttagtgcttcaatggctaagaatccaaaattctaaaatctattagtcacataaataaactaaattgcacatctcacagtaataaaatgaattgaatgtcacataaaaataaattaaacatttcatctattcatctattcatccacattcatctctaatcatctattcatccacattcatctatccataaacattcatctattcaaacacattcatctaatcatatattcatccacatgtaaaatgaattgaatatcacatataaataaattgaatatttcatctattcatctattcatccgcattcctctctaatcatctattcatccacattcatctatccacacacatgcaagtattcaaacacattcatctaatcatttattcatcacattcatcaatcgaaccacattcatctattcatcattcatgcgcgatggaggactcacctgggggtcggcgtcgggcgttgggcgtcgcaggctcggtggaggcggcggcatgctcgatggaggcggcgtcgggcgtcggaggcttggtggaggcggctgcctcggtggcggcggcctcgggctcagtgagggaggagtcggcgaaggaggagttggcggcggcggcgccgggctcggtggagggcgtcgccggggtcggtggaggccgcggcgtgctcggtggaggcggcgtcaggcgtcggagaggaggaggcgacgacgatgaggaaggatgtcgccgggctcggtaggggtcgtcgttgaggaggcggcggcggtctgtcacatcctgattttcgtttcaggatttataaattatttaataaattattattagaatttatattaaatgttcattaatttacaagtgaagttaaatgtgggaaataaaatttcctaaatataaagcatggatggatttaatttttattaaattctccatgattaagtctactctctgaaattttctcggatttttcggagctcaattcctaaatgatacaaagaacagttcagtaattatttgatcattaatgatctaattatcattgttaagagcttttcttgtttaaaaatccttaaattataaattgttgtttaaaaggaattattagaaatgatcttaaaagcctaaaagagaagatctaattttaatttgttaaatctcaatataaaattgggctagataaaattttgttaaatactttacttgattctatagttcctagatttttctgggatttatttgagccaaggaagtatttttaataaatggaattgcatttcatgaataatttaaatagaaaaaggttttaaaatctttcttttggttttgggccgaaagtcagcccaagtctctctttccttctccctctctcctccccggcccagtcggcccagtccgccgagccgccgctctgctttctctctctctcgctgacaggtgggtcccacctgtcagtcttcgtcttcctcgcgccgccgccgccgcccgaaccctagcgccgcgccgccgtcgtctccttccaaattcggccgcgcctttccttctccggtgaaatcaattgaggggaaacaatcttcgggatctcctctaccttttctcttttggaatcatcgtctttttcgctttggaagttcgtggattcgaggtcgaatcggatcggtctttttcctccgaaccctaacctttccttctcgtcgccggtcactgtgggcctccgtcgccgctctctagcccctttaaaaggacccccggtgtcgccgctacccgccgccaccctcgccttcgtctctcgtcgtcggaagcgccctagcaccgtgagacctcgtaccgcagtcgtcgccgtcgctccagccgtgcttcgccgtcgctccagtcgtcgccatcgctcgggaaggttgccatcgtggtcgccatcgcgtcgccgtcctcgtccaccccttcgccgtcgctgaagaccgccggagcactgtcgccgtcgtcaagccgaagagtgccgccgtcttttcctcgacgccgccgccgtccgttcatcttccgccgtcgttttggtcatcggtgagttcgccgcgtcactctctacgtgctggtgccctccgttcgcgtcgccgcgccgtcgttcgccggcgagtttgcaagcccgagccgccgccggtggtgacgtcaccgctgacgtcatcgggaccatccgtcgtggcccagtcatggaccgttcgatctcggccgtccgttttggataggatcgatctcggtcgttcatttccgtgagccgccgccgtgcacccggtccaccgcaaaccctagccgctgacgcaataattcccttttccttttaaaaaataattcattattgcgtcataattcaattaaaatccatataagtgttttaatccgatttaatctttaaaaattcataactaattcattgtaactcagttttatgtggttcaagttgcaaaagttgtataaaataaagatctacatattaaaattatccataaattgaattaaatttatttaatcctttttaaatgggctttaattagatttaatctagtaaaattcttaataaattcatttgaagtcagaatgaggccgttcaagtctcataattcatctaaaattatgatctacatgtttgtttactttttatgtactgtttatttggtttttattagtctttttctttgttttgcgtgttagcttgtcgtttccgtcgttgcgaaggtttacgagtgcgccggaagtatccaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactattgggataattaatgtttcattattatttaatgatggcttaatgatagctcgcgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttaccttttgtatagcatgattcattgtggagcaccagactgagaagtggcggagataagcccacgggggtcgctggggagtccatgcctgtttataagggggtgattatgatccaggaaaggtgcgctgtggtggattatgttgtgcaaggggtattgtcatagctcctttccgaggtaccgtggtggtattgaggcacatggtgacatgttgtggggctgtgtcttgtgggtacagtggtacacctctggccagagtaaaactatttgaatagccgtgcccgcggttatgggcgggttgagcaatgtttttcgtgattagtctcacacctctcacaataattatggatgttatacctggtaataatttgcttagctcctgatttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatctagaaggagaagacgtttggcttataccccagttgagctgcctgtgggagtggagccggagcttcgctagattttattttccgctgcagttttcttcatggtgaggactaagtgcctcttaagtaagtatttatcgttttagttaattggatgaatctgtatattaaattgtcagtttgtgtacctcggctgattcctggacgaggattttatgcacaaataagttcggaaattactagtgaattttcgggcgtgacacggtccgaatggagggcggaggaggctcggtggcggcgactgcgggctggtggcgacggcggcgggctcggcgatggaggacgacagcggcgctagggttctaaggaggtgggaaactgtagcgggacttagaaaaatttttgatccgatctgagaaaccctagttatagtagagtgatgagtcatctcaaacgggcattagtatggagcccgggccctacggcaaagcccgattgagatagattaatctctatcggccgtaaactaaggcccgtcaccgatgacttatcaagatttacaagttttattttggtcttttttctatacaacttttttcccaacatcttgaaattgaatttgaatatatgacaaatataaacagcatttgtaaatactaaatgatttcaaatggaaatatggtcaacaacaaagttgatcctctcatcaggatctacaacttttcttttggtcatttgtgataaaacaaaattagccatattaatgactatacatatcaagtctttgcaataaaacaaaatacttcattcattacaatagataagtacaaatgcatcggtcacaaggtcatgccttccgtatgatctgaacgagcatatgccacatgctcttggggatcatcgtcaaggtcaatgtgaggtcttacatgaagattatggctgtattcttcttcatcgacgacgttgtcaactcctacaattcggcgctttccatccctcacgatgtgcatcttcttgtttgaagggtcttttatgtagaatatctgctcaacctgtttcgcaagtacaaattgttcatcggtgtatcccacctttgatagatctactaaagtgaaaccttccttgtcagctttgacaccagtccgtagattcacccaacggcagcggaacaaaggaaccttgaacttgacgtagttcagctcccagatctcctgaatgcagccgtagtatgtgtttgacccaacttgatcctggaatgcatctatacggacaccactgttttgcactgtgcttttgtcatcttgtttgacggtgtaaaatgtgtatccatttatatcgtatccttgccatgtgtctacggtccaagacggtcccatccccaacaactgtactgtctcatttgggacatccgtggacattgtcacacgattcttgaaccattcgttgaaccaagaattatgttctctgttaatccatgcattagatcgtcctaagttctcatctcggattttctctaagtgctcctcaaagtatgggccaacttctgccatatgttggagtacagcgtaatgagcctgcacgtacgacgcttgatcgggcctaattcttttccttccgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgacttcagaactcccatgtacctttcaaatggccacatttcccttagaaaagccgggccacatagttttgtttgcttcaccagatgaacagggagatgaaccattatatcaaagaaatatagtgggaaaaacatctccaggtgacagagggtattcacaatatcggtcggcaacccatctagatcttctggatctataaccttctgtccaattgcattgaagaaggcgcatagacgtttgatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgataatgtgtggcaggctggagggaggtacactctacctgtctctgcatttcgtatgggctggagttcactgcgaatattcatgtcctgtagatcaaggcgcgcgttcaacccatctttgtcttccggaatattcacatcaggccaccaaactctcac

SEQ ID NO: 22866 - DNA, 1974 bp, Oryza sativa
cgataacaggctccaggaatacatcgatatcattgccgggttgtctcggaccttggattaacaagcacaacataatatattttcgtttaaagcataaccatggcgggaggttatagttcgcaataagaactggccaagtggtgtgagtactactcatgtcaccgaaaggattcatgccatctgtacacagacatatcctcatgtttctagggtcggcagcaaagtctttgtgttttcgatcgatattcctccattcaatcgaatccgctgggtgtctaagcataccgttattccttctctccgtggcgtgccaacgtactaacttcgcttcgttcaggttggcaaagattctcttgaaatgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcatttggacaagcgtgaattctacggacctctaaccccagtggacacagaacatgctttgcttgtatgtcgtcgcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacagaggtgtctcggaatcactgaccaacctgttgaacttcattccatctctctcattctgggatgggtcctcaacgtcacgtaacatgtcttgcagcagatcgtgatccacatcaaccatttcaccgcccaatggagaaggtataaacatgtcatgctcatcttcatcttcctgattatgtgcaccacttctgtctgctgctactccacttcctgattcttgcactccatgcttcacccaacatgtatagcccttcatgaatcctcgttgtatcaaatgaccgtgtacatcctctgcgctatcaaacatattctcattcttgcaatctgcacatggacaacacatgtaatcactgtttcttcttttccgatcctcctccgcggcattcataaaatttattatgccctttctgtactccgtagaatgacgtttcaaatttttcgcatacatccaacttcgatcgattgctacaaaataaaaaaaacaaattacatgcacatcttataagatcagtattgcaaaagtaatacgtgatgaaattgctcaattaatgattaatattactcacttgattgatccattttgatcacttttgggaattttctgtttttcttggaaaaaaagacaaaaaatcgccccctacagcctcccaccaaaatagtgaacagtaggatacagttacactaggtggtggggggtatttatactgtgcaacaaatatctgtaacggccctgaaacaatcaaccgtgacgggcatacaagtaatctctatcgggccttaataaaaggctgtcaaaaaagagtgtcatctgtgacgggtattaaacttatctcaatcgggcctctagttggagcccgtcacagatgaccctcatctgtgacgggcttcgtttagggcccgattgagatatggaaccctcatctcaatcgggcctcaactatggcccgtcacagataaatgtcatccgtgacgggttttagttttatgccgatataccatggctgtgcgaccatatctcaatcgggcgaaacttcggcccgattgagattacttccttgtgacggcccgcaaattccaatcttgttatgggccatcacagatggaaggatctgtactagtgatatttcgtgaactgaggattaatttggggagaattcgctctctgctccgatgaaaccgaggaatgtatgttagaagcaacagaggaactcgatcggtgaaaagactcaggaaaagg

SEQ ID NO: 22867 - DNA, 12066 bp, Oryza sativa
aaaaaaattatataagagttttcttttaaataaatcaaaaatatttcgaagtttataataattactccctccgtttcacaatgtaagtcattctagcatttcccacatttatattgatgttaatgaatttatacatatatatctatttagattcattaacattaatatgaatgtgggaaatactagaatgacttacattgcgaaacggatgaagtcttatgctaatgactcgtctcatttagctaaacaaacgtgctatttcgaacatgccctaagtaacaagcaagagcatatctctaggcacatttatggcaccagatagctagagtgatgcgatgagtggacaaaattgttttgtttatttaggaaaggagctttgaacctttttgctgtgtggcaaatttgtatcttgtttgtttgagtagcaaaacatgtgtctcgtagtcatactttatgtactcatacttcacttgctgcatgtgtctcgtagcggacgagtccatggttggaaattagtggctcggtgatggctggttttttataactattcatgggcacaaacaaataactaactgctataagatagaaaaatttatttaaataagttttctaagaaattcatatacgaagagtttttttttttgaatattgctgattttgtgaaaattgctgaatggaatggttgtattcctctagaaattcatatatggatgtttttttttgaaactatagcttgaaaaagaacaaaccatgttggtataccatgactaagaatgcaacttttaaaagttcaatattggtgatggtttgtcttttacccacacttttcaaaaaaaaaatattggttagttttttttttttgataaagttggtaattgtgatgtcagaaagtaaagatatacacttgtctggtagaatgcatattgtacaactcatgtttatcgatggtattttgtacaaaagtgttaatagcactttatataatttctctatatcactaaaaacacatgtggctgcatcatttgtggtatcttatcactagctggagaatgttcgctcgctgcagcacctcagtctactactacacccttctatagttggtggttcaaggtggtcaagggagttacttacataatcatcaacgaatcaaaattaaatgaagaatgggaaatgtcagggtgtggtataaaaatacattcggtgtcagggtgaccggccggccaggtcgttgtggtctgattatatgaactgaacagtacaaatggttgtgctcaattaatagctagatgttgcaaattaaacaagaggaactcgctgaagactcaggatcggcatatggtatctgagcgttttctgggaagtctttgtctttttcgcattatttctgtttgatttttcatacttcatatatagcacacatgctgcagtggaaggtcagcctgcagaattagcggcgtatagccagttcgtaaaggatgtaactgatgtttcgatggttgtccataatgacacatctggttgatctcggattatgtggttaaaccactacattcattacaaaagatatgaaggattactacattaagtgccgtgcaagatgcatatctcggaagatgcaggcatgcactaaaaaaaacctcatgtaaaaacattttctttaaatatagtacaaatgcagacacacgtacactcaccgctataaataaacaccatatacatatgggtcagcgtatcttgagatagataaagtcaacataggcatcttgttgtcgacgggtcgcctaccactaaaaaaaatctaagacttaaaactgagtgggctagttccatcacaagaaacctaaccagttgagctacactcacttcaccatgtagatgcattcttatttttggcaattttcatatcatccattttcatatttttgataattttcatatcgcctctaaaatttacatataatacgtttactctatatacactttatagcatattttattaagtttttcttatggaggcatttttttgcaatttataatttacctaatatataaaaggtattttcttgagacattttaaccaatgcagagacacttttgaggatgtttatatgaccaatacaggcagtttttattgatttcttttaatcagccttggctcccctacgttaataggaggggtgatatttcgtctaatgggtcttctccatgtcctattagtcttagagacccactaggacttgagaaaccccggcctcaagcaagaaaacataagtagtatctaaattggactcggactcagggctgaaggtctgattgcctagaaatgtgtggtatgaccgcagttcattatccgatcaaaccaacatgacacacttggcatgaaggctctaatccttttatagatttagcctagatttgatccagttccaaagttggctatcaacaccatgccttgtccacaacttgatagaatgtggccttcaatttgaggagtccgcgagcacggccatgggtgtcgtggagagcacaatctcatagatgaacacttccctcatatcgtctagcgtgacagggctagtttcgttggaagaatgccagagtacccaccgtcatcgtcacacttctttttgctttttcacagatgaacacttcccttaatgggagagtttgtcttttttttccacttctctttgctttttcatagcatgctgtaggcgtgaggtgagcctagagaaggttatcagcgtagccaggtaataaaggatgaaactgaaatttggatggttgtgtatcatgacatctagagtgcatattggattatatgaataaatcagtacatttattttgaaaggtatgaggcattagcactagaacatgtttcttttctcaatttgctcaagtgccatggtagatatatatctcctataacatttatggtatgagatagagtgacgaacgatggatgaacaattttttgctattttatttccattgcctgtttgtatttttgttaatttgtgatcaacaaatagacgtagtactccatgtagataacccgcttgttgtgtcttttagcgcgcagatgagaaaatgtctgggacattttgggctcgatgaaaaggtgcatgtgtgcatgcatgggtgtgacaagggtttttaacaacactgttgctttcctcacctatgtcaacatcattaaatattcatcaagattcgtgcagtttctattcttagtatattccattttatttgctaatgtgcacaattttacttacttgacattttacacacaactgaaaccaactagggctcacatatattccacattcaattttcaaatcatatactacctttgtacagtataatgcccatctggtcatcttcgagagaccgtgctcttcgcgccgccagcaaaatctagcgatgtcgattgaatgtccatggctgttctcaccagaacaacgttgatcgccttcttctggctcggagattccaaatggacattgatagattcaaagctagaatacccagtgacctgtgtcgtgcactgtcgagacagttttgtcgctattggctccctcggagagatctccatgttagtggtaataacactgatggtgtggctcttctcacggcgaggccgtcactgttgatgcctccacgggcacatatctgccaacgcagctacctggacatgaacaacaagatgcacctagttagcaccatcttgcgggtcaggtacgagattgtgacctacaagtgtgacttcctccgtgagaattcatggtgatcgaaggtggaagacgctgaagacattgtgtttttcgtgtcgaagaattttaatattggttttggtgttgcaagcatctccaacattagttggaactgcatcaagaagatgaaggcactgaccatcatctggagatggttgacattacaactaacgaatcggatttgcaagagcttaccactctactatttagggtttagggttttgggtttgtcgccatcagctcactcaaagagatctccatcttcagtggcagtaacagtgatggtgttgctcctctcacggcgagcccattgctgttggtgcttccatttgcacacatctaccaacatagctacctggatatgaatggcgagcgatatctcttcaatgggtgccattttgcatgtgaccagctggacaaggtatgaaataatgatatacttgtgtgacctcctctgtgagaattcatggtgctccaaggtggaagatgtcgaagacacgtcattctttgtgtccaacatttcaatatccaattggaaccgcgtctacttatatgagcccatgttgtgtcaccaagatcaagaagacactaacgaccgtcatctacagatggttgacattaccgatatcagatttgccagtttgcagccccaccattcatgtccatgcatttcaccggacaccaacgtcacgttctaccccgccatgaccagaggtggaccaaggattgggccacaattctaatttttaaaagcaatatgtgcacaattcaattcacacaaaaatgttatgcacatgtactgttcacacaaaatgtttcacacactttccattcacacaaatctatacacaaacaaaaatacatatttgttgggtcgtaccacgttatagatgggagcaatgaagcttgcagttctgattcattagtgttaatatcaaccatttccagataatagtcggctgtgccttttttatcttaatgagtacacaatctaggttcagataagtaaatgcagttccatctaatgttggaggtgcttgctacaccaaagtcagtattaaaattcttcgacacgaaaaatgaaatgttcgcttgggcatatggtggagcatgcccaatgtgacctaggtgaaccatggttggtgggttaggctgcacactctaacaagtggtattatagcctaggtttggaaagctggaacaatttccatgggtcacatggtggaggagcccggtaacaagtcttcggggtcagatgggttgatgtgatgagggagattgtttagtccgatttgtaatgggggagattgttgggtttagtcctacataggtaattgattatgggggagcacgacttaaaaggcgaggatagttcttacatatcagactagtcttttaggttgtatatgcctctaagacctaaagtagtggctccgattaggactaggatggagcaaggccggtgtgacctgggttgtctatgactggtgggccgacctgcgcactataacaagcaactccaaatccaaaagaggagatagatttagaaagaaactgaaagtctcttccattgattcaagaaactaaacccaagagtattgagagaaatcattaacaatcactagaacataacatttcctctcaactgactgaaatctttcaggaccaactatatccatgtgaattagttgtccctacttgtaagccataactaaagtcacaggcttctgagaggaagctgtcataactaaattcattagggatgtttctggaagatataaattaaaggaaaagttttggtacttacactaccccataaagcgtcattggagtcggtcgggaaatccggcacctgtcaagcgacactaatgaagtgccttattggtgccggtgctaaaaccagcaccaataacaccctcataggtgctagctctaatttagaatcagcaccaatagggtggacccattttttatttttatgggtgtgacaaaaatagaaaaaaattgccacctatacatggtcccactctgtttccaacaactcacaagattttcacaccatttcatacgcacgtggttttttggttaaagcttcgaaccctcgacctctctgtctacatattatctcttactatcacacctagaaacacttgtctagaaagcaataattcttttgatactactctcatctaaaacttataatccatatttaacaccatatatgagctcaaatgaaaattttatcaactgcaaatctgtagatctcgtccatatctacaacttttatatagatttgtctatattcgaaatcatttagaaatataaaaaattcacttatccaagtagatcgaacatccaaacgacctcaaatcaaacaaatatcatcaacaacaaagttctaagttgtagatctcatcgagatatacaaatttgacataaagcgtatttttcatccaacttcatatgaaaaagttaggtataaaacaaatatatatgagtagcgttatcataggtgccggatttaattgataacctgcatatatatatgaagaccatatatgaaaaccggtactattgaatcgcacttgtaagtgccgatttatttaaaaaaactagcacctatgtgatgtctatatttactgctttattataacaactgacacctacaacttaggggtctattggtgtcaattttttatggaccaacaccaatgagtagttaaagatgtcggtttttatttgtaggcacatagaaagacgaggaaagtctcataggtgttggtttttttaatgtactagcacctattatgacgtttcccattagggttttttatagtgttattttacgtgatttgaaatgtatgatattaaacataatgactgaaccttagatgaagaaacggcaatatctaacacatcatattgcatgacaccagccttcgaccttgatttgactatacactttctcagactaagaactgggtattttctgatctttcaatgcttcacgattgttcagaactttacacaatcaacaatattaatcggcataaataattataatgacacttcttgacatgaagaacgggcacgtgttaggacgtggtatgcctgattgacaacaaaattaatagtgatttcacggttctcgaggagtggaggaggtacaggagtaaccccagttttgaatgtaaaactgggtacatctcggtatctcccgtattagggggttccaaaatttattaaaaataattaggacctattggtacctgtcagtaaaaattctcaaaattaaaaaggcggaatatgcatttgggtgacctggttggtgtgttctgatgtaagggctgaactcagttactagccagatgtaatcacggcatcataatgttcaaagtaactttaaatttgtaaattctgtatttgcctttaattacacgctaccaccataattgaagctgtacattcggttacaagtataaataagcccccttatatatgcaagcatgatgatcctaaagcagataattttgttcacaccaatgaatgtaaggggatcaattgaaatttaaattcgaattctcaccacctcaagaagtccagctttttaaaagcctaaacatgagtctaaatagaaaaaaaacaatagaaaacaatcagactatgcctagggcaatagtagattgaacgcagaaatgtcgattctttctggaagcatgcattgacctatgttctctatttgcagactgctcacgttagtatttacatcgcacacaagaactccaaacaacatgtctaactgtttgagcaggttattagctaataaacataaaccaaaacatggccacacttgaggacgcaagttgtctgcagtactgcaagtgaaatactgctcacttatatgtgggcccatatacttcttttttgttttttcctatttaggttcgcatttagtgatcaatcatattttttgataattgtcatgcatatgctagttagggccttcttaatcatcacacataactggcactatgtctccgaagtgacaaatgaattaagagagtagtatatatttatattgcgtgtgatctttaatttcctgtcttgtaaaataagttattgctagtgtccctgtaaaacatatttatatttcacgttgtccttttgcaacagagcatcaatatatttatctcaacatatttggaatacaaatgcacttctcaccaaacagaataaggaaggctgcagagctagcttgcttgcaaatgacaaatcctgtcatgcaaaatgagctcttgatacatacaaaacagtccatatttcggcctgtcctttactccctctttctctgttccacattataatacgttttgctatattcatgcatcactcatctgtatatactactaacattcatataaatttggacatatatatgaagctcatatatgatccatacatgaatctatttaaaacccaaaacgtctgataatttgaaacaaatcaaggaagaagaaggatttgtaaggtgcatcaatatttaattagcacaacccaatggaaaaataaactgcatttcagataaacataatgaaatttcatgcttgcaaagtcctctgggaaaaggacgatgttggttttggcttaatttcgcacgtcagatcttctcacgaagatatatagggaaaataaacgtctggtttattgagaaggattaagacgtacgattaagcagaagtggcccctaaaaactgagctgagtagaagcagcgatgatctctaacccctcatattgaatgatattatcctgtgacttttattgggcttggcacgctaactagtctcagactgggagttgcttcaattctcttctgatctttcgttatgatttcaacatttttcacctatacacataatcatcaaccccaaagctacataaaaaattgttgatgataataattcttatagacaacaagaaatgtgcgatgtgcatgtggttcagaaactaaaacatacacgaacaatataaaaataagttttactactgcgtgttattctgtcctataaaaataagtttttgctagtgccctccaaaacatttttacattttccgtcgtcctttcacaagggcgcatcaatatatttatcccaatatatatatttgaaatacaaatataatgcatttcggaccaaagcgagaataaaagggctgccgagagctagcttgtaaataacaaatcctgtcatgcaaaatgagctcttaaatatatataaaatagttcatatttcggcctgccctttagcatatataaggtgcatcaatgcttaattcgcacaacacaatggaaaaacaactgcatttcagaccaaatataatgggaaaaaaagagaggatgttttggctttcgcccactagatataagggaaacgtctggtttattgaaaaggattaagaaatagagtataagattaagcaaaactggcccccctccaaactgaaccttaataggagcagctagcgatgatctccaacccttgtattgcatgcatgatactagctcagactaggagttgcttgtcttttgataaatcttttactatttcaacatttgtcacctgtacacataatcatcaaaaaagttagccacataaaaattttgatgagaaggattcttatagacaagaagagatgattaatgcacaccagtatcagagtgtgatgtccatggttgaccacaaactacatgaacagggtgtcagggtaactgcattgattagtgtattctttttgtcttttctctctttttggggggttgtttggtgtattctgacttgtgctcatcaacacaaccgcaaaagtggctttgctcagtttctcacaaaatgtccattctatgggggcaattcttatcgtgccattttttatagcaccaaaatcgattactactcatgtcatgtgtgtaaggagataaattgattaattctaaaggcctaccatcttagttcagcattaacaaaataaaattatgcacaaagaaaaatactataacggagagaaaaacgacgttactaggtcaataagtcgacatctttatggaccgcataaatgccgccatacatattcacaataagtatgatatgactcaaacatctacgtattgtattctgaatcgggcacaccgctcatacgtcagaaatgaaagatccaacttattttcattaggctgtccattggtgacataaaccaaacatgtccacattcgataacgctcacatagaaacctaggcactaaaaacaacaactttggataaagaacaaaatataaggaaaaacaagtcacgtacctcatgtccagagattgggtcgaatccagcatagagcctctgaacccttcatggttgggcaagctatcttctctgacatgccagtagaaatatcaaccaattctggagaatgatcactgccatatgtaggctcagataagtagatacagttgctcttgatcttggagacacttgcaccaccaaagcccgaattgaaattcttggacatgaacattgccatgtcgccggcgtcggtaaccatggaccacaccggcgtttcgccggcggcgaggtcgcacttgtagaccacggcgtggtgaccgaagggccactcgccgtggaaggctcgtatagcgacgccgacgaggtggagctcgccgttcacctccaggtagctgcggtggcacatctgcgcaggctctggcagcgacgacactggcctcgccggagacggcgtcgcgtcgttgtcgccggcgatgttgatgatggagacctcgccgaggcagccgatggcgaggaagctaccatggcagtggacgatggcgctaacgcaacattccacgttcgtctcgatcagcgtccatgccgtgtcaccgacccggcagaacgcgacctccgacgagtccgcgagcacggccatggccgcgcacccgtcgccgccgggcgtcgtggagagcacgatctcactgaagaacacttccctcatcttgtccagcgtgacggggctgacgtcgccggacgaacacctgagtacccaccggccaccgccgtcgttcccgacgccgaccatctccacgcttctcgacgacgccgcggcgacgcgctggtcggccggcgggagcgcgacgcggctgcccgtgaacgggttgagcagcgacacggcggcggcctcgtccacgagcgccagccacccgcgcgacgcgccgacgacgaccttgccgtggagctccgggagaggcaaggagacggtcttctcctccaccaagctgtagaacgagacggtcttctcctccggcggcgacggcgaggtgggagtgggatcaaacgggagcatcaggagcggcgcgaacctcgcgaacggcagcgcggcgcgccacggcgagcagacggagcggaaggaggcggcgtcatggccggacggcagcttcttggcgatgatctcgaggagctcccttgggaggccagagctccagtccagcggtgacctcacgcacgccatggacaaggatatggacaaacaacgatttcaatggaagatggtgagaaggggattgatggtgaagaaagggattcagctgagctcaaacaaatgaatctacaaatggattcatgaccaaagaatttggctagcatgcatttgattgagactatggaagatgagacttggaagatgatgctatatatgagattatttgtcattgtttttctgtgtttctctatgctttttcattgcagctgcaggcatgaggtaagctacctccgttgaaattgtgcattcaatattatcttggatggttgttcataatgaagatatctcactgatattgaatattgcacgattaaatcattgcattaagtatgaaagatatgagaaattaatattacattaagtactttaaactgattctgacgtcaagtggcaagcaagatgagtatataattaagttcacagccgcagtcgtttcttttccatccctttctaaacatgagtaggaggtcgtgcattcctttgtgggtgcataaccactgtaagactttctcctcaatccaccaatcgagtcaatccctaattatatacacctgatccgttgtaaagcacggtaatattattagtaactataagactataaaggtaacccgtgcatttgtgtaggtatgtattgtagaacgagttcgataaatttatacgggcaaaatatcaactgtatggcacctgccacgctttaaaagtattttgatgaactactgt

SEQ ID NO: 22868 - DNA, 3870 bp, Oryza sativa
atccgttccaaagcaaaaacatattactaataattataaaattaagaattaatgtaggtgacacatttgtgcgggcatgtatcctagactgagtttgataaatttataggaacggaaatcaaccgtatgacacctacctaccacacttcaatatataatatttagttcatccctataagcaatatttttgtagaaaattttctaacaaacactaccagaataatgttttagagacattttctctttgatttttctcattatttctctttgctttttcgttgtagctgcaggcatgaggtaagctaccttgtttcccgttgaaattgactggttgtgcattctgtattattttggatggttgtgcatatttaagatatctcgttgatattgaatattagatgattaaatcactacattaactataaaagatatgagaaatctatactacattaagtacttgttatgaattacatccctagactattgggagagtacgagttagaattacccctctaaaaaaaacagacatctttcaccctcaactatcaaactattgctagttgaggatgaaagatgtatggttttcgggtttggagggtaattcgtgcattatggtgaattgtgtttacaaacttaaaggcattttataaaatgtctcaatgtcttatgacatcttaatagatgcacttctttatgtttataagaggatataggcattttttagagtgcattacatatataattaattgcacatttcactataaaatacatccaaattaacataaaaaaaacatatctacacaaatatcacttttaaagatgcatctgcgcatcaacaaaacatatatgcacatttccattcccacaaaaaaatgttctgcacattttccattcacagaaagtgttatgtacatttttcattcacacaaacctatacacaaataaaaatacatttttacactctacggcacatttgactacatcatttttaaactgcacacatgtgcaccagctctatacataatacatttccaactgcaaaacaactttgcccataacacatctctaacatattttccgaacaaatgcacaatttgcatcacaagaggtatacacatttcaaattgcagtgcacattgaacaaaatgaggaaaagtgaaaaacacatcataacatggtgcacttcacaaaccagcaaatgggtaggggtttccggtgaatatgaccatgacgtgcgcacttgcaatgagggcagattgcaccaacatcttatggcagaggtgcagtcgacgacggtcaacggtcatgtgcaccggcctcccgatgatggagacgacttggtgcatcggcgggggtgacggtagagatacagtcaacggagagtacaaatacggcaaactcaatagagtccttggatccgctattgccgtttactcctctgctcagccaccggtgatgagaggagagagagtgcatagaaggtgtggggatggaagataaaggggatgccgggggtggagtgagagagagagagagtagagtatttaaagtgattcatagtttcccattagaacgaaactttctgttgggtaagaagaccaccgcgtcaccgttgcgcaggcaacctgagggagaaaaccatttgcctctcccccagctcaccgctgtgggaagtagcaactagaaaccaagaagctagccaggagggcggtagtggggcttggtttcagcacccctctagcataaagagaggggtggccaatgacaacgatggtgtgacaaggccaggtggcagcgacagcgtgagggggctgcgcaacggagatggcacgtcatgggcgtgtagcatcgagggcgcatcgggagcacgcagaagctcccaccctgagctcgacctttggtactcctcctagatgtggggattcctcaacaggtggcaatgggggtctctaacggtttgaagagatgatggcgacggtaacaagggctccctcctctcggccactagtagacatggcaataggggcccttcctatcccacgtataccggcaatagagctcctccctagcctgtaaatggtcgcggtgatggtgtgctaaggacgatggtgcagtgtgcatcagcaatgatgggggccctccctccccatatatggtagagatgagcttctatataacaaccctccctccagaaccacgtagcccagcccaattgatgggcgggcccacttatacacatcactccattttcactttcatcatcacttcatataaaagggttaacacatgagtgatatgattggagggaaaagaccttataagttggtttcacccttactaaatatgcgcacacagctctcatgggccgcacgggccagatcccaattaggccaggatgtcagatacaacccctcccccccccaaaggggacccgacgtccccatcggtccaactcacccacatagccggatacccgacgtccccatcggtccaactcacccacatagccggataggcatataggcaaatgtccaagaacacatcccctcttagggcacgtccagtgcctgcgtcatatgccatgtcatgtgcctcacacaaagcgcacaactaacgggtgggtccacttacacttccgtccttgcttcgtgtaaatgagttaaaccgggagtgatatggttcgagtgaagaggctttataagttggttccacccttgctaaactagcaaggtggtactaaacatgtgcacacaactctcatgggccacatagaccaaattccaattggaccaggatgtcacattctccctagcctttaggtgagtacagtatagctgcaaaatcaaaggctcggtgatcggccaagaactggttgagctgctggatagtggcggaggcagcgtggggggtctttagacccccctacccctaataaaccattagagctcccattaaaaccccctaaaatttaaatccatatatctattgtaagggagctaaaatagagtttgtctgatattgttataaggcccaaaaggctgaggagccccactataattttatcctggctccaccactgctgctggatgtcccctgacccttgtctatactcgattttttttacattttatcttgtttggaaatttatttgtcgaatttgatctttcgaaaaacttattacgaattggcgcctaggtccaaggcttgacatcgttctgttgaaattataagcacataatgatttaatttattccataaataaatcatgacattgcagatgtaaactagcatgaacgcatcattagatgtacacatgtaaactaagcagtagaacatgaacatatcaaatatgcgcaacatgtcgaacacgaaccgaggtggcggaaagaccggttgctcggcaggaactactcgcggttgcgggagtcgacgaaggcgcgcagcacgcgagcggagaggaagacgagccatcgcggacgaacagggagaagtcgcgcgaagcgcttcccaaaaaccttattgccgccttctcccgatgcaggacgtcgcgggtagaggttccggagacctgctctcccgatcgccggtgcacgccggcgagcgggatggagtcgtctacgagcgacggcgcagcacagagtaggaggcaaaccctagattgatttcacgtgtgttgcgtgaagacggcggctcggtttatatagagataggtcacttgatcagggcgcccgtacaatctccactccgcgtaaccgaaccggataagccacgcgtaacttattcggactccacgccgttttcacgcaccggatttttcggaatatttccaaaacaaaacaaatccgaattttccgcagcaaaacaaaactg

SEQ ID NO: 22869 - DNA, 12618 bp, Oryza sativa
cgtgtgtccgcctcttctctccaccacacatgcttcaagtggctaggagggcatcctcccttttatggaggtccccctctcctagaataagcaaggtggtactaaactccacatgcatgccatcccatgaggagggcttttgtgatttttcaaagaattaatcttcgaacgggccatagcccatctattaattccaacaatcccccaccaaatctcaaaatcccactgagatttgccttttccaaagtactgtttatataccagcggttcgatggagaccgattaaggttgaacatccatctagaactccaagctgcacttactcacaacttgaacagtgtactacgccttgaattacaagtcttgtgcaagcaagtttcactcagagtcttatctggtactagaccgtctgtagactacccctcgggtggagcatataagtcatactcctaggtctttagtaagcttcctataagattcaccaaaatcttcatagactgcgaccaacaatcaagctcacaaaggtgagttctttcaagaatgctctgcaggacagcatcttcgcaaattaaagccaactgaactcattaaggcatagccaacctgccttgcagctcacgagagtacatgcatcttcacatagagagggtactctcctctagtttactaatggtttgttcttcccaggttctaattcacaggatctccgatcacatagattgggttagcaccatagtataactcacatgggtctcaaacccatctccttcaatgcattgtctatcacatttcgtgatagtcccttcgtgaagggatctgccagatttctagctgtttggatgtaatgcaacgttataactccggagtttctcaatttcctgacagacttcaatcgtcttttcacatgtctagacgatttcatattatccttagaactattcactttaacaattaccgtttgattgtcacggttcataaggatagccggcaccggtttttcaacaaaaaggcagatccattaatagatcaagcagccattctgcctcaacagtagcagtatccagtgccgtcaactctgcttccatggttgacctcgtcaaaatggtctgtttgcaagacctccacgaaacagcaccaccacccagtgtgaagacatatccaccagtggctttaatctcatccacatcagagatccagttagaatcactataaccctccagtaccgcaggatacccagtatagtgaagccccaattccatagtacctttcagatagcgtattactcgctcaagcgcacgccagtgatcatctcccggattagaggtaaaccggctcaacttgctcacagcaaaggagatatcaggcctagttgcactagccaggtacatcagcgagccaatgatttgggaatattccagttgatttctagcaattctcttgttcttgcgaagcaacaagctaggatcataaggtgttggagaaggcttactatcaatgtagccaaagcgattcaagatcttctccacataatgggattgcaagagtgtaatcccattctcacctctaattagcttaatgtttaagataacatcagctactcccaaatccttcatatcaaaattttgagacaagaatgatttaacctcatttatcaccccaaggtttgtaccaaatatcagtatgtcatcaacatacaagcatagaataactccctcacccccaccatggcgatagtacacacatttatctgcctcattgactgcaaagcctgcagatgtcaatgttttgttaaatttctcatgccattgcttaggagcttgtttcagaccatacaaagacttcaacaatttgcacactttgccttcttgaccttcaactacaaacccatcaggttgatccatatagatctcctcatccaactctccattaagaaaagctgtcttaacgtccatttgatgaacaagaagaccatgtgaggctgctagggaaagtagcacacgaattgtggtcaatctagcaacaggtgagtaagtgtcaaagaaatcttcgccttctttctaagtatagcccttagcaacaagccgagccttgtacttttcaatagtaccatcaggcctaagcttcttcttgaacacccacttgcaccccacaggtttacacctatatggtcgctctctcacctcccaagtcccgttagcgataatggaatccatttcactacggatagcctccttccagtagtctgcatcagaagatgcatatgcttctgaaattgacttaggagtgtcatccatgaggtacacagtgaaatcatcaccaaaagacttagccgtcctttgtctcttactccttcgaggagcttcactgtcatcctccttagtgacatgttcatgtgtatgttcagtttgttctggtggtgtgattgaactgggaattatttcagaaggttggctagaactactatgtgtattcttcattgggaaaaagctctcaaagaagttagcatcacgagactccataattgtaccaacatgcatgtcagttacctcagatttaactattaaaaatctataggcaatgatgtgatgagcatatcccagaaagacacagtccacagtcttaggtccaagttcatgcttcttcgttattggtacattgactttcgccaagcacccccatgtgcgatataagaaagcgatggttttctcccaatccatatctcatatggtgttttgtccttatttctgttagaaactctgtttaacacatgattcgaggtcaacaatgcctccccccaccatgccttaggtagtcccgtggtgtccaacatggcattcaccaagtcagtctatgtgcggttcttcctttcagcaatcccattagactcgggagaatagggaggcgtcctctcatgtatgatgccatgttcctcacagaataagtcaaactcatttgagaaaaactctccaccacgatcagacctgagtccttttatctttctgtcaagttgattttcaacttctgccttataaattttaaaatagtctagagcctcgtctttcgttttcaacaagtacacatagcaaaatctagtagcatcatcaatcaacgtcatgaaatatcgttttccaccattcgtcaacaccccattcatttcacaaagatctgaatgtaggagttttagtggtgccaagtttctctcctcggcagccttgtgagacttgcgaggttgcttcgattgcacacaactatggcactaagaacctttgacaatggaaaacttaggaattaaacatatgctggaaagccgagacatcaagccaaaattaatatgacataaacgagagtgccaaacattagcctcatcatccacactgccacaaatatggttcacggacttattgtagaaatcagaaagggaaaagcggaacaaacctccgcactcataacctttaccaataaaatttctatgtttaaacacgactactttattagactcaaaaaccaacttaaatccatctctagtcagacgggagcccctaacaagattcctattgatagaagggacgtgctgcacgttcttcagctgcacgatctttcccgaagtaaacttcaggacacaaatgcactcggccacaaatttgtcgggtaagacacacttaaggagttcgagtttcttagccatggtttgtgtctcatgagcctgttcgactacagaacggttgtcagccatcctgtagtcatgaaactgctccatgatatacagatcattgctagcatcaatagcaccgaatttagtatgtagtgcatcccacaactccttagcgtcggtcatgtgcatatacacctcgaccagacgatcgccaagaacgctaagaatgtatcccacaaagagagtagtggcttcctcgaattgcttctgctgaccagcagtaagaattccttcaggtttgccagtactcacccataagcatttcatagttgtcatccacagagtgacctttttctgtcatatcttaaagtgcacaccggtgaatttatctggcctcagcgcatcggcaaaaccagccatagtaaaatcacagcgcctataataaggtttttggattgttgaaattataagcacataatgatttaatttatttgtcacgccccgaactagtcccgagcggaactagcccatgacgctccaaattaacctgttaaccgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggcttggaccaaacatcacaggcgcgacttgggaactaggccgaaaccctaaaactcatcgtagccggcttgctcctggaagaactcctcgtcagcgggatccgctttatcttcttcagcaactggggggagattatttatatagagcaagggtgagtacgggagtactcagcaagccatgggaaataagtgtttaatgtaggcttcaaagaaaggctgttgtttttgcaattatttatttgaactcttttctgaaacaactaagggagtgcttctcaaatgacacgggtgagacagtgcgtctcgtccggtcggagtatgtgcaatgtatcagtcttttgaattgattaagattggctcccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacgcacacgacattactaacccggatcatccagttcgtgcagaacggccacgactagagaccttaaggctttcatgacaaggcattttgaaagccgacacaggttcgctatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccacggttttggaaattcatttagttcgcaagcaccgacccaggtgtcgggttttccaagtcttttgtaaaacccaagttttgcccaagatgtttctcagattttaagttcgaaggcgaccgtcgatacccgtgcagagtgcatgattaccgaggcgcgactaggtgggtacaagggagcatggtataacaattacaatgggagggtcaaatgcaacaaattaggtaggtctgccaatctgccttgcagacgggacaagcagattaagtgcgatcctatcaatgcataatatttttcaagcaacataattaagttcaaatataagctcaagatgttcaaaggtggcttgcctcgctcgagatcttgagcttgatcctcgaaatcctcgtactgcgggtcttcgggctccgaaactacacgtgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaggagagagggaaattagactttcctcgggcggctagggcgcggcccgagagaaaggggctgctcggccgagcttaatgggccggccggcccaagaaggcggcccaaagcgcgcgcgcgggcgaggaggggatagagagagccggtgggccgggtccatcccgcgtggtcccgggtgggacccgcttgtcggcgactcagctcaccgtgagcaaggtgcacgcagggcgtgctagggtttggggagggaggcgcggcgcaggcgcgcggttcgcggaggacgcggtgcggcaggcccacgcgcagcctcacggctcgcggtggaccgcgcgcgcgagggggaggagggaagcgacggaccggggtctgcttgacccggtcgcggccgaggtggcgccgacgtggtgcctacgtggctgccacgtgggcgggcgggaggtagacgacgacgccggtcggaacggacggcagacaacagcggcgagcggcggagcgaaccacggcgatacaggcgaaagcgagcacaccgggaagttgcacaggactaagggagacgagccaatggctcggattcgccgggggatgctcgacggcggcggattgcggcggcggcaaccggcggcaggagaagggggaaacggcgatggcgcgacgggagaccgattcgggcgagttagagcatctacgcgactccgggaatccgttgctagcgtcggattgggcggagctacgctgagcgaggccggcgacgagtgggtgctacggagcacgggcggcgacggcggcgagcacacagcgagcggcggcaacggtcggggcggcgtcagctagctacggggaggctactcgtgctactacctgagtctaaggggaggagatggaatgaggagggagaacggagggaggcactaccgtgcgggggtgatggggcgcaatgacgagaggccgacggcacgggagtgatctctccggcctcgggctggggaagaggaagaagacgagcgcccggagtccccttccgcgtccacgaacgcaccggctctcccggtgcttggcgatgaactgtggaggcgagacagaggggcggcaatggcgtggtggcggcgagcgaaacgggaggaggaatcgatgggagggcgccttggtttataggacgacgatatcggtttggaaaccgaccttgggcggtcaaggcgcgagctggcgctcggcgctcgcggccaaaacggcgacagaggcggaggatgacgccggcgggaggaaaaagggaaaaagagggagagaaagggggcttgcccccttgccactttggggaaaaggaggagggagtgagggccatgcggcagaggggggagctctgcctccgtcccttggaagcacgcgcgaggaggggcggggccaaggcgatgacgacggcgatgacggccgggcggtttggagcggagcgacgacacgggcggcaggcgcgggcaggcgcggcaggcgctgacggcggcggcgactggcccgtcggccaccatggcgcacgcgcgcgcgggaagcaacggacagcgcggcgatttgggtggcgtcggcgggaaacggcagcgagggcggagggcgctcggctcggcgcggctcacgcgcatgcgtgcgcagtgcacgggcagagcgggaaagagggagagagggggagagagagagagagagagagagccggggagggaggggaagatgggccgagagggattcagcccatcaaacccgagggaggcgaaatagacttttgcggagggatttgatttgggaaggatttggattcgggattgaactcaacgatagatcggggatttgagatctgagatggcacggacactagacaacaagcaaagaaacggatttcgcaaatagggtttttaagagatagttttcccgctaggcgccacgacggaacgggcgctacattattccataaataaatcatgacattacagatgtaaactagcatgaacgcatcattagatctacacatgtaagctaagcagtagaacatgaacagatcaaatattcgcaacatgtcgaacacgtaccgaggtgacggaaagaccggttgctcggcaagaactactcgcggttgcgggcgtcgacgaaggcgcgcagcacgcgagcgaagaggaagacgagccctcgcggacgaacagggagtagtcgcgcgaagcgcttcccaaaaaccttattgccgccttctcccagtgcaggacgtcgaaggcagaggttcgggagacctgctcacccgatcgccggtgcacgccggcgagcgggatggagtagtctacgagcgacggcgcagcacagagtaggaggcaaaccctagattgatttcgcgtgtgttgcgtgaagacggcggctcgttttatatagagataggtcgcttgatcagggcgcccgcacgatctccactccgcgtaactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaattccccaaacaggagtagggtattacctctcattgagagggcctgaacctgtctaaatcctttctctctgcatccatccacttttaggtctcgtgcgttaccccgttttattattgccgaattcatgtttcgacagttggcgcgccaggtaggggtgcgtcgagttatctacgagaagtgagatggaaccaattagaaggcgccgaatcagattcaatctagcaaggaaaatcaacctcagcaagttggatcactccaatctccgacgtcaccaatggtggtgaatcctcaagatgcagctcgccaagatgccggctggagccgctatacagtccgtagccaaaaaaaaaaaaatcatctgtatccaagagatcatcggccacgtctccagctaccagcctgcacaaccctgcttgatcgtactgctctgcatggaggtcggccacgggagtcaccactgctatctggacaggcgtgctggagcgatggatgttcacacgcaccggatagcaatcgagcctccgatccagtcgtcgtcgtcatcgccgttttctgttatgctcggtgagattgattgctgagatcaaactggacgcttcgagttcgacgcggactcggcgcctcggcggaggcgtgtagcagtgcgtcatccaccgcagccatctatcagccgtgtgaagacagctactcgccgggatagcaatcatccgtccgcacatgcacttggacacgcaaggatcggctctgcatctacacgcataaacacatgcatgcatggataaaaactgctatccggcatcggctaatttatcgttccaatctattattataattatgatttttttttaatcatagattgatctgccctttgattcttcgttttctctcgcgtgcatatactggcgtttgacggctccatgattacctccgacgacggcatcatgctgaaggactgttggttacaggggcagatgcaagcacagtggagtgcaatactttcagatgcatggacatgcaaattaatcatcgttggcctatccatccggctgacgtcgccctgatctggctggagcgagctgctcacactcataatttgcactctgccgtatgcacatatatacacgtgtgcgagcagattgggagcaaacatgtgtgaggacatatcctagcattttccaaccattgctaggcatcttcatcttcacagccggcttgccttcgccaccgccgactggtgtctcgacctacacggctggtctattatgccgctgttgatgggtgtccacgtcttcaccgaccggctggccttcgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcaccgccgactggtgtcctcgccaatatggtcggttggtcacaccaccgttgatgggcatcgtcatctacaccgccggcctgcctccgtcgccaccgactggtgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcgttgccgtcgactggtgtttccgcttacacggctggcctattatgccgccattagtgggtatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgcccttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgctgttgggcgtctacgtcttcagcgaccggcttgccttcgccgccgccgactggtgtttccgcctgcacggctggcctttatgccgccgctgttgggcgtctacgtcttcaccgaccggccgcctcgtccgccgccgactggtgtcaccgcctgcacggctggcctattatgccaccgttgttgggcgtgtacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtatacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgtccgccgccgactggtgtcaccgcctgcacggctggcctattatgccgccgttgttgggcgtctacgtcttcaccgaccggcttgccttcgccgccgccgactggtgtttccgcctgcacggctggcctattatgccgccgttgttgggcgtctacgtcttcaccgaccggctgccttcgccgccgccgactggtgtttccgcctgcacggctggcctattatgccgccgttgttgggcgtctacgtcttcaccgaccggcttgccttcgccgccgccgactggtgtttccgcctgcacggctggcctattatgccaccgttgttgggcgtctacgtcttcaccgaccggcttgccttctccgccgccgactggtgtttccgcctgcacggctggcctattatgccgccgttgttgggcgtctacgtcttcaccgaccggctggccttcgccgccgccgactggtgtttccgcctgcacggctggcctattatgccgccttgattgggcgttactttttcaccgaccggtttgccttccccgcggcgactggtgttccgcctgc

SEQ ID NO: 22870 - DNA, 10670 bp, Oryza sativa
gcctgcacggatggcttattataccgccgttgttgaccgtataagtcttcaccgacggcccgcctagaccgccgccgactggtgtttcagcctgcacggctggcctattatgccgccgttgttgggcgtttacatcttcaccgaccggccgcctagtccgccgccgattggtgtttccgcctgcacggttggcctattatgccaccgtttatgggcgtatacgtcttcaccgaccggcctgcatccatcgccgccgactggtgtttccgtctgcacggctggcatattatgccgtcgttgttgggcgtctacgactccaccaccggcctgcctccatcgtcgccgactggtgtttccgtctgcacggctggcctattatgccgtcgttgttgggcgtctacgactccaccaccggcctgcctccatcgccgccgactggtgtttccgtctgcacggctggcctattatgccgtcggttttgggcgtctacgactccaccaccggcctgcctccatcgccgccgactggtgtttccgtctgcacggctggcctattatgccgccgttgttgggcatctacatcttaatcgccggtcgtcttgtctgttgctgattagtgcccttacctctacgtctggtttatacagctaccactactgatggacatcatcatcttccgtcgccgactgattatgccgccgccgacttgtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccaaccacgacgtctttgtgaacctcgacatctcggcatgcaatgccatgttattttactacaacaagtggctctccaatattcaggatttctacttggacatcttcaacacatatcttcaatcaagcaatgactattcgacgacaagaagctacagttctcgactctatgttcagttgtttcccaactaatcaaagagtcaggggctacacaaatataaggctcaaaatttgacaaattttatgtcaagctgaagaaatcaattcatcaaccaacgagtcaactccaggagtcattatcttcatctttgcttcggagcagacattctacttcaacaacttcaaatatttcggtttggacaagttggacaacaacaccaactctcctccaagtgaagcatctacaacagttataacattaatttgatggattattgtcactgacattgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatcaaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatataacattccaaaccaggagctaatcaaattattaccagtttaagcatcttttacaatgatgagaggtgtgagactaatcacgaaagacattgttagacccgcctataaccgcgggcacggctattcgaatagttttactctgatcagaggtgtaccactgtacccacaagacacaaccccacatcatgtcaccatgtgcctcaataccaccacggtatctcggaaaggagttgtgacaatatccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaactatgtgcccacaacccaccattatcaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtcaaattaatataaccccaaggtatcaaggaataaggtaatcaagtacgaaagggccataacaaagaataggtcaactccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtatatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaagggttattgcgtcagcgggctagggtttcgtggaccgggcgcacgggcggcggttcacacgaacggacggccgagatcgaaccaatccaaaacggacggccgagatcgaacggtccacgaccggctcacagcggacgaccccgatgacgtcagcgatgacgtcaccgacagcggcggcggctcggcggagcggacggctcgggcggcgcacgcttgccggcgaacggcggcaccaggacgcaaacggagggcaccagcatgtagaggacgacgcggcgaacacaccggtgaccaaaacagcggcggaagaacaacggacgacgacgaggaggaaacggcggaaaccttcgggttgtcgacggcgacgaagctccggcgatctccggcaacggcgaaggggcggacgagaacggcgacgcgatggcgaccacgacgacggtcttcccgagcgacggtgacggctgaagcgacgacggcgcacggctggaacggcggcggcgacggcaaagctagggcacacggcgctagagctcttccggcgacgagaggcgaaggcgagggtggcggcgggtagaggagacaccgagggtccttttaaaggggctcggaggcggcggcaaaggcccacgacggcggcaacggcgaaggaaactcgcggctcgaaggaaagaggtcgatccgaatcgaactcgattccatgaacttccaaaccgattaagccgaagattccaaaggagaaaaggtagaggagatcccggagattgtttcccctcttttgattcgaccggagaaggaaaggaacggccggatttggaaggaaacggcggcggcgcgaaactagggtttcggcggcggcggccgaaggaggacgaaggtcctgacaggcgggacccacctgtcagcgacagcgaaagggcgcgcgcgcggcggactgggccgaactgggccgaggagagagagggggttttgggccgactttcggcccaaagccaaaagagactttttaaaacatttttcaatttaaattatttcttaaatgcaattccatttattaaaaataattccttagctcaaataaatcccagaaaaatctaggaattatagaattaagcaaagtatttgatgaaattttatctggccccattttatattggaatttattaattaaaactagatcttctcttcaagacttttaaaattatttctaaaaattccatttaaacaacaatttataaattttaaaattttcagggtgtgacaaacctaccccccttaaacagaatctcgtcctcgagattcggaggaactggcgaacaggtgcggatgagctgacttcaattcatcttctcgttcccaagttgattcttcttccgagtgattactccattgaactttgcagaaacggataactcgattcctggttcttctctcatttgtttccaggatacggattggtttctcaacataagtcaaatcctcttggacttctatctgctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcccttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgcttcccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaaacgacttccggaataggttgtctttaccggaataaaatgagccactttggtaagtctgtcgactatcacccaaatagaatcatggcctgatgacgttctgggtaaaccagtaataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtcatcttagtactaccagggtgaatggagtataaagtatcatgagcttctttcagaactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctactacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgtggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccgataatatcctgcgaggcctaggaaactgcgaatttctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcaccttgagcttctgcagcagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggaactgcaacaggacgtggagcttgattacggatgttgttgccagcattgttgttgaagaactgacgctgcggacgaacaacagacgaagaacctccctgtggcacagactggggtcctaaagtaagacgcggcttctgattattcccctgttgtgtcttgaattgagcaatccggcgtttcttctgctccatgcgattgtacttgtcctcctgacgaatagccttatccactaatttctggaaatcaggataatctccaaccatgagtgggtaagaaagctcatcattaagtcctcccaaaaacttctcctggcactcttcatcattgcgcacatcttccggagcataacgagcaagacgattgaactcgtgcagatactccgtaacagagcgagatccctgggtaagcgacctgaactccttcttcttgagagacactactcctgatggtatatgcgtcttccggaaagcggcggtgaattcaagccaagtgataggttcagcagtagtcctgttaaggcggaagtgatcccaccattcagaggcagggccatgcaactgatgtgatgcaaatgagaccttgtcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaccggggaaactacttaggacagagaattactttaacttttattgatcttaactgagtttcattaatacaaactaaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagatgctacccactcaatcttggaattgttgcgcttggattcttcttcttcatcactacttatgatgatgaccggaggatccgcttgagctggggcaacttctttctccatcacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccgcgattccggtcttcacgatcttgagcggctaacacagtctccgcacgactttcatccatagcccacaacatctcaaccaaatgcttcgtggtagcatcattctcaattccttcagtctcaaggtaactgccacggtcacttccctggggttggcgaggatggtagcgatactcagtgtcggccaactgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaggtaagtaaataaagtaaaccaagctttgcgagataagttaaaacagttggaaacgaggtcacaaattttgtaattttgaataactggtttcaaaagaaaagaaagaaaattataaaatcaacatgctaaatttattttattgcagcaagattaaataaaacagtattgtaaaacttttgctggtaaatgagccattagtacagtaatagatgtacagtactaataacactgaaataaatttttaatgagaaccattaaaagagattatgaagtacatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagtgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggat

SEQ ID NO: 22871 - DNA, 15644 bp, Oryza sativa
ggttttgggccgactttcgcgccaaagccaaaagagactttttaaaacatttttcaatttaaattatttcttaaatgcaattccatttattaaaaatacttccttagctcaaataaatcccagaaaaatctaggaattatagaattaagcaaagtatttgatgaaattttatctggccccattttatattggaatttattaattaaaactagatcttctcttcaagacttttaaaattatttctaaaaattccatttaaacaacaatttataaattttaaaattttcagggtgtgacagacatcatcaccagcacctctgcttcatcggccctgacatctccgctgttgctaatggatgattatgttttcgccgacttattatttcaccttcatggttgacctactatgcaaatgctgatgagcgtctttgtcattatcattggttgctacactgctattggctggatcaccaacatcgtcatcttcatcaacatactgtcaagcctcttcaacatagcccactctactactgtttgatgagcaatttcgtcatcatagtcgatcatctctgttgctactgacggttgcctttgtcgtcgtcgactattttctttattttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcatcggctgcctcatctgtcaccgactgattatttcgccaccatggctgctcaattttgtcgatgttgctggatgccttcatcttcactgttggctgacttgtctgctgccgattggtttcttcgcctccacggctgtgcaacttcattacctttgattggtgtcactgttttttactaccaatgacatcttccattacttttgatgagcaatttcgtcttcatgttggtcatttcatctccatgccgactgcgtcagctattgccaataagcaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacgcttgatctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacgatgcatcttaaaaggtgtcaaacagtaaagctttacatagctgccccgctgacttttttatatagtcaaggtgctgtttgggtttatcaagcaattgattggatataatatcattgctttttgccacgtaagtgtgcatttttattgaccaatattatggcttaggctgattatatattatggtcatttttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacgagcttttttatagctattttggtatatcactcggatcatgttatttggaggattcacaccgcatatactatatattgatatcaagtcacttggttgattacgattatcaaaaccacttggttggttggattatttattccttgactatatgcttggtttgttcaattaaccacattgtcgggggctacacctattaggtgcatctattcgatgcacctgactttatttttcagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacagggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaattccccaaacaggagtagggtattacctctcattgagagggcctgaacctgtctaaatcctttgtctctgcatccatccacttttaggtctcgtgcgctaccccgttttattattgccgaattcatgtttcgacagtaaccgaatcggataagccgcgcgtaacttactcggactccacgccgttttcacgcactggatttttcagaatgtttccaaaatttcccgcagcaaaacaaaattacaaaaggagccaattttgcggaccatttgacttgcgtgcgtgcgtgtgttccgcctcttctctccaccacacatgcttcaagtggctaggagggcatcctcccttttaaggaggtccccatccgctagaataagtaaggtggtactaaactccacatgcataccatcccatgaggtggacttttgtaattttccaaagaattaatcttcgaataggctttaacccatctattaattccaacacgttcaacatggcagtgcccgtgagcaggatggggctaggcgtggcggctgagaaagatcatcggtagtgcggcccaggaagcagaccctgctacgggtgagcttcctgtatggtaactgtcgatggcagcaggggccgtatatccaccgatgtaaagtgtgcacatgttcaaggcccccaaatctataactactagtactaattcgtaattatcctatccatgctaactataatagcaaagaaatgaaaacgtattacacgtatggaaagcccaacaagctatttgagcaatttagtattaatttgaaagctcaaacaacaggcaaaaaagaatgtatgttctcatgttgtctcgtttgatcaaactaacatccaacatgcaccacacatcgcatcgtctcgcttttttaagactcggttttcccacaccgtcgccgctaggacactacttcgatctttttttcaaaacaatcagcaccgctacttaaggatggttaatgggcacgtacagacggcacgaattaatgaacaagctcctagctgcctgacttctgtgtgtccacgactatacaccaccggccacggcagtgtgtacagtacacggttgtggctatctgtcgtaggtcaccacatcttttcaattcaggctcaatatatactcctttcgtaaaaaaaaaacgaatctagaactgaatgtgatatattccagtacaattaatctagacataccgacagagtatgtctagattcatagcactagaatgtgtcacatccagtactaggttgattttttatgggacggagggagtactttcacataggccttcaatttctaggtacggtcttagacacagcagtaaaatgttatgttctttacccagcagtaaggttgtgttttttaccttatttttctaactatctttctcgttttttacgtgtacatttttcaaacaatttaatggtatgtttttctaaagaattcctattcgaaagttacttaaaaaatatattcaaccattttttaaaaataaatagctaatatttaattaattatacgctaatgagttgtttcgttttacgtacgaaaggattagttccctacaccaacaaccgtaagcagccatggttgtcctggagttctgcagctgctgcggcaacgtcgatgcctccaaacagttcataatctagaactgttatgacagattaataactctattcttcaattgttctttacttcaaaatgagtggcaaaatataatttctctaactagtagtaggtcaggactcacgagttactagagattagcgatatagtataagataggtactcgtatgtttataaaaaatttatggcggtctttattaataataaggccatttttaactcaagacactatacgtagtttctataaacttcacatcatgtactagacactactcttccaatgcaaacaccactatttcatacttaaatttaatactacttatctcacataatgtcttggatgtctcatgcaagacatggtttccttctcttttcttatttatccacttgccacatcattttttatcctaggtggcagcttatttaatgctatagacaccatcataattattgagttgggaatgacctagcatcgatgatccatataaacacaagacagtattttgaccagcacaatgatgcgaatagagatctagtcgttgccgtcgtcagatctcgccgtcccagaggtcgtggagggacttgtacgggccgtccggcgagacgaagtagtttccatggcaggctcgccgctgcggcacgccggcgatcatcgccttgtcttggtcgctgagctcccagtcgaagatgtccatgttctgcttcatccggccctcgttgaagctcctcgccaccatgcacacgccttgctcgtacagccaccttaacgccacctgcatcacaaaccaagagataattaattaattgagttatatattgatgtttgtatatatatagtagttttacataaaactgtaggatataaacctttgttaattgaatactgtaattatgtatgtaattaacccaatcgatcgaatttttggtcttgcattttccttgtttgttaggacgaagggaatattactgttattgattgtgaattcagttatttggggagacaattaggcctggtttagttcctaaatttttttttcccaaaaacatcatatcatatttttgaaaacaaaaaataattacacaatttgtttggaaatcacgagacgaaccttttgagcctaattagtacatgattagtcaaagtgctacagtaacccatatgagctaatgacagcttaattaggctcaaaagactcgtctcgcggttttcatgcgagttatgaaattagttttttcattagtgtccaaaaattcctttcgacatcctgtcaaatatccgatgtgataaaaaaaattcgcgaactaaacatgccttaatagctgtatttttctagtgtgtaggaggaaattagaccagatggcatggcagctgtgttccagaggtgttaggtaaaattttcgcattagcaatgatggggactaacttgagatgagagataacaggagttttttttagaggggagagataacaggagtttagagggtaaggttcatttagttgatattaaatttagcatttgcttcagttactgcaactgaaactacaaccattacatttttttttctcaaagctcaggtaggatagaataaaacaacagtagataaaaaaaaaagacacaacgacaccaaccaaaaaaaataagcaacatattcaaagttttaagtctattgctaaattttcatccaaaatttttaaaaaactgcataacgattaactctaaattctggagcatatatgacttgttgtgtgtccacttcacacctatgaattattgagaattagtttctccaccaactcacactactaaaccccgcccccttttcgaggccaaacaggacttttcagcagagtctattttgattgttgtaaatttttcatttatcaaatttaattcttgtcgtggttattttctcctagcaccatggccattctatacttccataaaccatgaaaaaggtcaaactataataaaaatcattggagtacacaagtttatataacaacaattcaattattttaattgaaacagctaataccattctgaactgtagaagtcaaccagtctgaactttttctttcttagttttattttatcacctgagcaatcatcttgcctctcatggcggcaaccgtcacatctcattctagatttattttccatgtgacggagagaatagtttcaaagaataataattcagtattttaactggagcagctaatgtcaatagaattgtagaagtcaacgattttaattgatttttttcttagttttttttttttttacctgagcgatcgtcttgcatctcgcggcggcgacgtcgtgcagcacgccgctgttcatgacggcgtcggagccccagtgcgcgccgtgcgcgccgagcggcgagtaggcggagacgacgccgccctcgccacacacctcccgcaccttctcctgccgccacccgacgttcatctccacctggttcaccgccggcggcacggcggcgagcgcgagcagccgcgacatcttggcggcggagaagttgctgacgccgatggacctcgcgaggcccagccggtggcactcctccatgccgcgccacacgccctccatgtcgaacggcaccagccgcgggctcaggtcgtcccacgtcagctcgccggcggcgtctttcttgccgatgcgaacgggccagtggatgaggaagaggtcgacgtagtcgaggccgagccgggacagcgactcccggagcgcggcgaccacgcgcggcgggtgcgcgtcggccatggagagcttggtggtgacgaacagctcgccgcgggacgccacggcgccgcagcgcacggcctcggcgacggcggcgccgaccgcgccctcggtgccgtacaccgccgcggtgtcgaggtggcggtagccgaggcgcacggcgtgcgcgatggtccggccaggtcggccggcggggtcgacgagccggtgccgaagcccagcaccggcatcgcgtgccccgagttgagcgtgacgcacggcacggcggtcgccgccgccgccggcgtggcgccgccgtggtgcacgtcggaagcagccatcgatcgaacgggttcttgggattgggtttgtggtcgctgagagtggattcgttgtctattcggatgttaattataaagactctttctaaatcgtgctgagtagtactagtaagaattattagtcttgtaagcttgggagacaagaagcaaagggttagagtcatcacacgttaaaaaaaaagtcaagtccacgacacagacggctttctttttctttttcttttttttacctaagttgtagtgcaaccacaaaatttctaatcgaaatcggaactactacatcccaatttgttttccaacaaatcgagcattgtttccctgctcatcgaaaaaattttcaccactatatagaaacatgtttcatattattaaaaacggtgaaacacattcaaattatgaattgaaattttttttctaacgtacgaaatatagaatttcaaccattgaaacatttcgacacaaagaaacatcaagtacatcggttgaaacatcgaaaaagcaccgtacacacccatttggtattctcgtactccactcctgcatggtcccaacggtgagacatcagtgccaacctcctcaaacacgagacgagacgaaaggtttgaggcagtggtagagccaaaaatttctccagacacatggctcaattaatcaattctccctccgtactcgtaaagaaaatcgttttggacagcgacacgatcttcaaaacacaacattgacttcttgtttctataaaaatatttattaaaaataatatatatactttatgaaattatttttcaaggcaaatctattcatatattttttacatttttaaactcaacagattgagagttatttatgatttatatttataaggtttgacttaagtattgtccttaacgacttactttataagtatgaagagagtacagtataatttacatatgctttagccttaactgccctactcgtggttccacccctagtttaaggagagaagggtcatcgctgcctagccacacgagctcgacgctaaggccaccgcatatcaccgcctttaatcttgccccggaactggatgtactcgtactgaacatttggtgattacccaccaggacttcctgacaccggccaccacgccatcgaaggcttcagggtgtttggagtcacgacgtgtgcgagcgtggcgcctgacactgagcgttttcgatttctaatgtacttggataaaccgttgttttttttcatagtagtagtaatttttttcacaataaatatcaatatctcatttatgcacatcaagtccaaatattagtggttttaggatttttgagtgttttaatggtaaacattttgtgaagattcaatgtagtaaaggaatttatcggaaaaagactgaattaccctatgattttttgcgctcatccaagttaccccctgaataacaatacataacattttaaacccatcaactttgcaaagtggacaaattacccccccccaccccgcgacactctagggcggttttgctctttagtgacacacatgtgatagtcagtcagccaaaacaagtaaaagaaaattttattggacccacttgttcgcccaatccctcttcttctcccctcctctgcgccccttcctaaggcaagcaacactagggttttggggcaatgcacgctagcggagctagcagagttgactcttggcagcggagcaaagtggaaccaagatccaaagaggcgatgcttcgtggtggagctagcataggcgagtggtgttgagttcatggagctcaccgtcaatctcaccgctcttccacttcaagcttgaaaccacctgtatcgcctccgccgtgagttcaccattgcttccgtcgtatttgctagatctaagttgtgttgttgaggccataagggagcagtaggtttatgtgtttggtagcacaacgagggagcggaggaactctagcatcgaccgcgcggtggagttggtgctgccgaaatgacgctgtggggagagattgagagagaagaggagctggacaactggcgttcgacgacagcaaccaagcagcgtccgatgatgctctagcagtagatgaagaaagaggacatagcaactgatatgtagggtccactagcttgatatgtaagtatggaagcatgaggtggaggctgacatgtggggccagcgccacatgtgcgcctacgtaggaccaaaaccacattcaaatcgatttagagagtaatttatccggattacaaagtccacatttaaaagtgtttgtattgttatctaggggtaaatcggatgtgtgcaaaagttcaaaggtaattcggacttttttcaaaattcatttgtacgaattgaatcgaagttatttaaataattaaatagacatgactaaggatcggattgcttatcatttcaattctatggaacgctataatgtttcattggacagtcacatgttttagtacgatcgtgtcatagttacagcagaaaagtgaaacgccgaaaagtgaaacgccgcataaaaacaacaaaatactggtatgtttcactagataattgttccattggaatatttcattctgtgtgtttagtcattggaccaattgtctggaaatattgcattgactcctcaatgtttgcatgcaaatatcaatatatatttgtaaatatgacgaattgttctttcgttattagtcaaaagaaaatgagtgtgttcggctgccatttgtttagcagcggctgcagcaattcaaaattgctgcagcttacagcgactttgaactgccgcagccgcagcggctgcagcagccatacctgccgaacagagccatacctgccgccgaacagagccaatgttggagagaaggactatcatctgttcttaggaccatcgtatttttgtaagtatattcttgcatattcagggagtttgcacttacccctactctaggaatatttggcatcaccaaacatttcaagcatgcttatagcatgcacaggtaatacgagcacgcaagtattgtgatgtgaatgtggcgtgtttaggttttgtacgtacgtctagttgcctaaaagaccaaagagtttgaaaaggggaggtggtcttttgtcactctccttgtcgcttatgcatatatgctttatggaaccgtttattaattactaataactaaagtaaaatagtttaaattctaaaaaaattaatttatgggtataacttatccttactgatttataagcacatactgtaaaaaagactataattaaaaaaatcacaaaaacaccttgaaaattaagttttaataagatggcttataaacataagcgaaatgagactatacatgtcccactttgatttgtcagtaactacatttgattggatcatagatagattaacaggcatccacaaaaaaacagtaactgcaagccacagggctccatgagaaaatggaatataataataaataatgtacataatgtctcatgacattttgcatatttgcaatttcttttttgttatctccttttatctctatggatggcaatgtttgcatccattctcctttttttttttccactggactcttcccagtgaacataaccgacaaagaactactaggaagctagtaaaattgaaagaagaaaaaagaaagaacaaagaaaatttcagagttcagaccaccccaactttcagaaacaactcctccctttgttctaacaaccactactagagcttgcttttgtgagggttgaacataacaaaggctaaaacatgaaggaaaatgaagcagccagataaattcttattgtgatctgagaccaggctacctccatgatctctgcctaccctcttcctttcagatcaatcacaacgacactaatgttatctgaactctccctgccgagggcgaggcgcgcaaggagagcagcggcacggtagcagcgaggctcatattcttggcctaccgctgctgccggagcaccggcgctgctggaagcggcttcgccgctcctagctgcgcgacgcccactggtggggctcccgtcttcaaggcattgtcgagcgacatcgctggccgtctcgtttgagatcacatcccacatcccatcgctcgcgaggatgaggcattcgtcgtcgacggtcctcacggttatggtgatgtctggctcacatatgacttcaggctttaggtacttgtctcctgcgtgaacatatttagaataattgagagtaacatacatgatactgaattagtttacataaagaatctcataaagtaagtaatatacaggaaaggaaataaattttcaaacattccaaatggtattgcattgaattctagtaaatgagaagattcatggtattacatagtattttcaggaatcctatttagtttcatgaaagaaaaaggagaagatgacacatataaacctaacgaactagtgaaatcgagaacattattatggctacggcatttcaagaactccatccaaatatttaagccacagatacctctgaagctacaatgaaaggatacacagggaccagcccttttgcaatgaaaagcttaagcatcaaaacaggggcaaacgtgagatgcagaaacataaaatattctataaccactcagtaactactagaatgtagggaaatttgtactgcctatatcaagggaaggtgatgtatcatgtataagcctataatgacaagttggacagataagtattttgaaagaacacatttcctttgaccttttgggccaagtaaactgcttccttctgctgcacataaattatattatcattatattaattaatctactatataaagtaggaatcttcattgattcaaaatacttaataagtgataagtagtgtggtgcttcctatatgtgaaatgggcaattcctacaaccaaaatggtgtgtctgtaatataatacaaccctctccaacttgaaacctgatatataaacatactaccactgaactctagtttaaaacagagcttgtgagatagacagataaaaactattttaagaaaaagtggtttatcagaaacaacatcagatctgcagagacaatattttctatgttatttgattataaacattcgatatgaagtacaattatatagttttgaaatcaaatagactgacaaggttctacaatggtgcaagttgagcttttctctattgtcaaaaggtccaaattattactacccaaggtatttcctttgtcaatcctgaaagctagattaaaaaaggtgtaacatcactattgggaacttaggatacaacagaggacaacgtcactagcctaatcaaacatatatgtcccacttatttatgaagatcatttcttttagtcagttggttaggttacaatcagagcaactaataaaaagagctagcactttcacagatggtgaatcagagatgaacgcgtgtcttttatgtctaatccatctttcttctttcagacatctgataatataactaaatgaaataacaccatacaggcactgccaaatgttaggcctaatggctaaagtgagatggactgggtacatatggtcattttcttgataagccagataatatggcacaaaccggtggggtcagtgatgtgactgtgtatcaactcaacaaactgccaagtaacatctactagaagctcattagaagctggaattgtaccttttatctttgtcatagttaattgtataaaccacaaaaaaaagttggtaccttcggacagatgcaaatatcctatgtaactaaagtgtaaaaaaccttaaattcatagggtaccatgctattgtcatattcataaccttcctgccacgaaacttgcatataatacttattttcctcatagtcttaaagcaggaacatccttatttgacctagattctgtcaccaggcagtttttgattggtcaaggggtggaaagatgcagagcaataggttcctttttatgtttggaagaacatgcagagcgacaaatgtaaccaccctttgtgatatagtattaccttccgatcttttgtttatttccatttcccccaacctcgttgggggcaacatgatagtttaagaacaactggacacgtcttagaaactgacttgccaatggagcttcagtggtttagcccaatgatcaagcaaaaccaaaaggctagtgaacaataaacaaatgatatccagagcaactaaactagaatggcaaggcattaccaaccatatataattggtctccctaactccagattatgtgcacaagtacaactcctgactacttctattagagcaagtttaatattatagccaactactagctccaatttatctatagccaatctaatagctcatttatacaatagttacataatacactattaatacctggtcccaccagtcatacacacactgcgtattggagtctgtgctatagctggctacaaatctgtaatctgctactcttctctctccttatttatcttcttaaaatatgtttgcagctggcttatagcctactattgtacctgctcttagcagacttcttttcgaaacatttactcattgagtacatgtttccgcgtgaaatcaaaacccacgccaagacgaacacgtgagcgacagaaattggttttattgtggctccaagttctatccaaagctagctagctacgcaaacattcagattgtgccacccactgctagctgtatcatgtggtcttaagtgaatcatgtgtgcagctagcagccaagacattgtagcccaggacacaggcaatttcagttcttctacagcagagtagcaaacacaacacacaaagatagtgcctgcagacagaatttagatcaatgatgatgacgatgacattacctaatgctcgcgacatggcgaggatgccacgcaccctcggcccgttgaggtacaccacccggccacccaccgcctcgatccgcgccttctcgtccggccggtccggctgcataattcaccgtcaattatagtaccatgtaatctaggttcgtcagcagcaagatcacacttatgattagcaagatacaagagcaagattaggttaatcacactaccacatccagcacgaatattgtcgcaccaaccactgcccccatctcctacccccctcatggacctaccacagccaaccacacccagccaattttccccttcttttttccccctttccacagaaaaggaagctctgaccagtgtgggtccacaatccatctcaggaagagcaaaaataaaaaagaaaaaaagaaaaaaaaagaggcaaagggacagcaacttcacagtacacaggagcagggacaggtggcagaggtggcggccaaccccctctcactgctcacgtgggccccaccagacagcagcaaagcagctggccccacactctgaccagtcttatccccccacgtgccccgcgcgagagcaacacgtgtccccctccaggaaagcgatggattaaggccctgtatagatgggactaaaactttcaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattagtcttaaaaaatttgtctcgtgaattagcttttatttatgtaattagttttgtaagtagtctatatttaatactctaaattagtgtctaaagacaggaactaaagttaagtccctggatctaaacaccacctaaaacacttcggaatcccccccccctcccccgcccaacaccacgtgggccgcgcccctccgcagccacccccgaggttcccacaaattctccaaatggcctttgccctttctactagcattaatgagagggccaaaccaaaaacagaccataataagagaagaaaaaaagataatagtaattattttttttattattattttttaatacgaggtgataatcttttttgtgatgacgctagcggggtccacgtcggcgagcacggcaaggcgaggcgatccatgtctctccgacaagcgagagcgacctctctctttttctccggtcgccggcggccaaccacgcgtcgccggcgagacagccgcgcccgcgaaggttccggagaggcgacacctcggctggggcccaccccccgcagagtcaacggtaaacggcagcgcgagacttggaatattttggcaggtacggtcaaagccgtggtgtgagggacacgtgtgcgtgtgaggagg

SEQ ID NO: 22872 - DNA, 979 bp, Oryza sativa
tcctccatcgccgccggttgccgctggcgcagtgccgccgcctccgccaccatctcctccgccacgatcacgtgcatttgctcccggcacagcgcggacacctgcttttttttttttgtccatcgatcacaccaaaaaaaagagaaaaccaaacaaacacacgtcactgatcgagcagtggtagtaaaaaccaaaaacgaaaattaaacgacaaattttataaaaaaaaaacgtgtcgacctcggtttcgatggtgctagaacattgccaggtggatcaaacagtgcaatgcggtacaacacaacagcagcattttcgcaatcaatcaatccaatctctatctctttttctctctctctctctctgttttttttttctttctaacccaagattatgatgagtaggattagcatgaaataatgatgggattaagcaaaggattagcgggggggcgacgtacatgggggccgccatggccgtcgaagacggcgaagaagtgcatcggcgagccgtcgagccaggtgcagaaggagggccggagcgagacggcgtcctccatgtcgcgcatccgccccgcgagcgagacggacccgaacgcgacgggccacaccgcggccgccgtcgacgccccggacgggagcgggagccgccgcgccgcggcgccggcggtggaggagcacccgtcgtcgtcgcggtcggacgagcagtcggaggaagccgccgacgaggtcggggacggggacggcgacgcggaggaggccgggaggctcctcttctcgcccccaccgttgctgctgttgtccccgtcctcggacgcggcggcggcggcggggacgtagcggcgcctgcgcaggcggtggcattcctgggcggccgcgggggggtggtccccatcgccacccggcatgttgacgccggcgctagccatcaccatcaccgatcatgggaagggaggaggaggagagggaagaggaggagg

SEQ ID NO: 22873 - DNA, 2642 bp, Oryza sativa
cgcgtggtgcgcgcgccgtcgggcggtttggctgcgcgcctctcttccctggttttcgccctccccgagcccggtttggccggcccctgctgctgctacatcaccacccaactaccaaacaaaccaaaagagccccatcctttgacatattagagaaaagacgaaatgatatatttacaaatataaaataatttgtaaattaaaattttatatatgtatttttaatgttctaaataaagattggaaaataaactatgataaaaggtcctaaaatcaacttcaaatctaaagctaaaaatttaaatcctgactgataaacataaccgagaaggtgaggctgaaagcttttgactctggctgggattagaacttgcatcatttgtattgaataatgggaaacaaaggtcggtgataccaccaaaacaaaatgacgggagaaagaaaaaaaatctttttttttgcccctaattagcttctagaatccttctatatgtgggagcacgtgataaatttggatggtggccaggctatatttcttagtgtaactcatttttcaggtgcatttgtaggatttcatctcttacctatactaaaggtgttatccatctccagcacggtggttcctgaaggatggaggaggaaggggcagctaccggcgaggagatcaaccaaaagagggatcaaaactattttaaacacatctactaaagagtaaaaaaaatcaaagtaattttacctctataacatggtaggacgggtgagcaataatcttcccttctttcctctcttctcattgataacgagatcaccggaggtgttgatagtgagataggcattacaagtgcgatgccaaacaatgaagaggaaggaaccattcacaagtttgtggagtatagtatacgaaggaggtggaagaagagatcaccttataaacttgcctctatcattatgtcgcctcatctcacacgtctttgcatcgcatattaatgagaagatatggttaaatgtttttaaactaccacatgttatgcatgcacctagacgttgttcccaacctccacaacgctggatccaccatccccgacctcctcggcgatggatctacccctcccaagggcgccgccggtggatccgctcctcccatggcctctagccgtagatccggcatcaccgtccccaacctcctcggcagaggatctgcccctcccaagaccgttgccggtggatccgcccctctcatggtctctagcggtagacccggcatcaccatccttgacctcctcggtggcggatccgcccctcccgaggctgccgtcgatggatctgcccctcccatggcctctagcggtagatccggcatcaccgtgcccgacctcctcggcagcagatcggcccctcccatagcctctagtgctagatccgacatcaccgtccccgacctcctcggtggcagatccgcctctcccaaggcccccgccggtggatgccttcccatggcctctagcggtagatccggcatcaccgtccccgacctcctcggccgcggatccgcccctcccaaggccgccgccaatggatccgcacctcctattgcctctagcggcaaatccactactcccatggccgccaccgcccaagcctgccgctgttgcagcccaaagccagtcacctccacctcgaccacccgaagcggttgctgctatgtatggggagaggcaaagggaaggtggagtggcgaagtagaggaaaagccaccaggagagagggaggcgatgggagaatgggagaagtcggagtaagacattgtgtcttatagccgcgctccagcccttgccttttatatcttgtcggtattttctcaatcgatagccccgagagctgtaaagagacccataagcaaaaaaggtggtttttttcaaccgggctcttaagcggtccatatgtaaaaattggtttgtctataaaaaaccaattttcacttatgggtctttgggatcccttaattatccattttcacatgtgggtatctttagctagactgcatgtaaaactggagaggatgtgtttacaataatggttttgtagtagcgtggtttgcataattttcttgttttaatttccttgtactttttctcaatagattgaggcaatgatatgaagtgcaatattgtcgatgtatgaatatgtgtatatcatgcatgtatgaacaatatatagatgcatcatattgctttgtatatcttttctggccgggttgatacctacttaccaatactgcctgttcaagatcgatcagcggtgatactctctagtagtatcactgtacattgattgccctctcttcatgttactaattagaaaaccagcagtgacgccgtttatgaactctcctaacgggacggctggtggcagtgatcgttcggtcgttcaagaatgtttttccaatgtaatgtgctaatatagggttcttaattaatgtggacgcaattaacatcttaggccctgtttagatccatttggaatagcaaatagcaaatggcaaaagttttggtggtaaaagttttggtatcgcaaaaatactagttggtgtttagatgcatcctaaacttttgccattctagcactaaagtgagtgatgaact

SEQ ID NO: 22874 - DNA, 3598 bp, Oryza sativa
cttctccatccaaccccacttgtttttcatttattgaggggcattaattaaagtatttttcttcttaaccttaacctctacatatcaatataaaaatacttatattttaaaagaaatatagtaatagataattctccttttttttctctcaaaaagacatgcaaggcagcaacaagcagccatatataaatgggaacaagtacacaattaagatgctcggaggaaattaaaccagagataaaccattataaaaaaggaagatatactcccccccttctctctctctatttcaataactgcaacgtcaattctcttccaacattaaccaatgctcccttcgttttatattatcaatcaaactttgagaaagtttgatgaactgatgaagtatataaaaaagcatagcaattggtttcatttcgtataacattgaacatatttttttatattcttatttatgttataaaaactattgctatattttttctataaatttgaaaagcaaggcagaaacaagcagccataaaagggaacaagcaaacaagatgcttgaaggaaattaaaccagagacaaaaacgcgttataaaaagggaagatatactctctctctctctctctcaataactgatgataattttcttgtttctattccctccattttatattataaatcgctttaatttttttttaaaatctaacttcgagaaagtgaaaaaatatagcaattggtttcattatgtctaacattaaacatattttgatatcttttatgttgaaaaaatattgctatgtttttttataaatttggtcaaacctaaagtggtttgacttagaaaaaagttaaaatgatttataacatgaaacagaggtagtattattttttatatactcaaaaccatattgttagattcattttgtatagaactttgtaatagggtagagtttcaaaagtatttgcaaatctgaaaatatcaaagttcaacacagccccatccttttcatatgttccctagaatttcatttgcctcgtataattttttttatttttctactatgtctactatattgattagaccacctactttaagttatttgtgaagtttattagaccacctattttaagttatttgtgattttttttaaaaaatatattaatttatcatgttaataaaataaacaatccgcgtcaataatatgaaaaaaaatgtctcaaacagcgtcaacgttatcggtctattctgatagatatagatatagatagagctagatatacatatgcatatagatagatagatatagatatgcatataagatatatatagatataacaatgtcatatatactgccatctgcaaggtcgtcaccctcggctctacaagactattgcaagagtccaacttttgcacgcatagctagtactaggatcatatagctactaagctacaaatggcgatagtaattttgcttaattaatctagtggccgtcctggactcctggtttgaaaaaagtctagatagctcacaaatgtacgcaagatacatgcatgttacctcactctcaaaaaaatatcattttttatccagctcatatacattaatacaaagagcaattttacggtcattgaggtaccaagaggtaccaaatttacaatagaaaaaatggtacctcatggtacctactcaagaatcgtagaattgctctaatacaaaactaacagactagaatacttttaccaacttttatcaaaatacaatacaataattgtttcaaagtcaaagtttttcttaagacaaacgaattgataaaagatgtggctatttgagattgaggatgttacaatactatggccctgtttctttcagtttgggattattataatctagattattaagtcagattactataagctagattgttataatttatataatttatagtagaataaccgttggttgtttctttcctagattattagagcctagattattgggttttgcaagtctaaagagggagtggggtggcatggtgggtaattttgcacccaataatctggaaaaagctcacctaaatgagcttatcaaattataataagctggactctagattataataagctacttcaataaggcttatttgtttctttcagcttacttcctatatatatatatatatatatatatatatatatatacttttgttattggcgctcacggccttggagattttgtgttgttggcggtaattaggtagatgggctctactaataagaaatcaacgaaggtgcatgcacctcccaaagaggaaacaaatatgaaccagtccagtacttgtactgttcttttttttttccaaaaagggaactgttttgtgttgcttgaatcagtcggctatatatttagctcttattaaatactatctctgtattttaatgtacgacgccgttgattttttatccaatgtttgaccattcgtcttattcaaaaaatttatgtaattatcatttaatttattatgacttgattcatcatcaaaatttatgtaaatattttcatatttgtacaaaaaatttggataaaatgaatggtcaaatgttgataaattctggtggtgggagattggtttgattaattctggtttgtcaagtctagctatgtttattatgtttatgatatcgttttttgagattcctaaaggggttcttcaaaaaattgattattatagatcccgtttcttttggcaaggggatgaacataaaaaaagtatagattgacaagatgagatattatttgtcaaccaaaaaatcagggtggacttggagttcataatttagaaatataaaaccaatgtcgtttaagtaaatggttatttaaattaataaatgagcaaggtgtgtggcaagatttactgaaacgaaaatatcttactggtaaatcaattactcgggttgagaggaaacaaggggattcccatttttggtcaggtctgatgaaggttaagaattcctttttaaatatgggttcctggattattaataatggtgaacaagtaagattctgggaggataagtgactagggaactattctttgaaggaaaagtacccctcgttgttttctatagttagaaggaaaaatgcctcaattgctaatgttatgggttctgttccgcttaatgtttcttttagaggagttttagttggtcaaaatctaattagatggcataatttatgtgcttccattgtgcatattaacttaacagacgaggatgaaatttttagatggaattttcattaaaatggccaattttctgttcgatctatgtacttagctttaattaataatggttacatagagaaaaataaaattatttggaaacttaaaatgcctcttaagattaagatttttatgtggtatctccttaaagggattgttttaactaaagataattcgactaaaaggaattggaatggtagttcgagatgttgcttttgtatgaaaaatgaatcaattcaccaactattctttgagtgccatttttctaaatttctatggagagctatacaattcttttttggactttatcctccacatagtatatc

SEQ ID NO: 22875 - DNA, 7660 bp, Oryza sativa
tttggaaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaattaaacttgagacggcaattatgcatttatttgccaacttcaggtggaggttctctattagaattcagtagttaggggatctttttcttttgttggtgtctattagtttgcttagctttgtttctgctttcgtgaactttctgtgtgagttctgtaataattggctgtaactctttgagtaaaggccggaatgttacattccattatctaaaaaaaaacgttgataaaaaagtcaatggcgttatacattaaaatatggagggagtagttgcttagcagtaataagcaaccaagtgggataaaactgttgactaactcaaagaaagtagctgcatcgcggggttgacctgctttccctctctttgttactcagtagggcgtagtttctagcccaagctagaggtggggaaaatgaccacaactgaagaaccgagttctcaaaaaagaagaaagttctaaaaaaaataactgaagaaccgaaccaaacaaagaccaagactagattgaacaggactccaaattttggtcacaaaatcagtcataaactcctgctaattgagtttgataaggttattttggtcatatgtcccaattaaccgaaatgacaaaattttaaccgaaccctaatagaagcctaatatcccaagaagtatcaaacccctaacatctaactaaaccccgtctttcccccacgctccactcaggtgatgacatgttatcattcaccctagctcccagctaccacctcccttgcctctcccctccatcctcctctttataccgtccgcttgcattcttcctatcgtgccgtccaccatcagtgtcgtacaactgctaacactttacccctgctgaggacgtcctttgcctccagcctccttcttcggcatcaacgtcacccaccttctccggtgccgctcaccccatcacctactgtccaagcgtcgctgctccccaaccttatttgccttcctctttctctcattccaaggtcacttaaattcctaggtattgtagctcacaatttagaggtaaagatgggagcttgattttctttaggttggcggttggggatcgatatatctccacgtcatccatcacagatccatatttcagctatgtccataacttgaaccgacaaaaaccatatagctcgatcttcaccattttgcaatgcaattcgttctctatacttagggtgtgtttgaggagaaggggattgaggagattgggaagatacgtaaaacgaggtgagccattagctcatgattaattgaatattaactattttaaatttcaaaaatggattaatatgattttttaaaacaactttcctatagaaaatttttgcaaaaaacacaccgtttaatagtttgaaaagcgtgcgcgcggaaaactgagactcaatctcccctatctcccccgaaagaacgatgccttagatgactgaattttactcaaaagagagaaagaccgagaccgacacaggaaggctgaaacactggaattaattaagaagacaaaggtaatatatgttcttggttgcttattagttctgattctgatcgtattgattaatgtaatatgtcaaaaacattataattgggacttgggaactaaacaatatcaaattagaagccaatatatatcgaccactccactcaaattcgaagcaaacattctagccctataaactcaaattcttctctactacaaactttcaaaataagttagctatatgtatagtttcgtataaaagattaacttatttttggaacgggggataatctatagtggttttacgataactcgttcatgtataatttaaccgttgatagttttatttgaaccctaaaccgttaccacaatggtaatcccagggcccaggcaccctggcctaggttacggcctggggccgagcccaattagcaatagaaaccccttattttaaccctagaaatcttagcccataaaatatggcccgaggcctagctgaggagccgttagaaagatagagatagcgagaggaaagacaatgactgtggatcgagtgatttctctttgctggttccatcactcatgctccaagatcccttgcgcatcgctccccaccccgtctccctttctagcaatatggtcgtgcgctcttcgtcatagcgtcacctcaggctccaggctccagtgctcctctgtgctagcctgtaatgatcgggtgaggatgcttcgcttctcacctgctccccactctggtgaggacaccttccccatctttccgaggaggcggcatggcggcatcagccaaccaacaaggacatagctattagaaactcggagcttatcaaaatcctggatccaccagtttacaagattgatggcttgagtgaaagaggagataatcggcacatccgagttaaaaaagatttgaaaaagaggagctccaaaagcaaagaaacagaaagcacttgtgccagtagctagctgacccacgttccggcaacagaaaacatatggaccatagctgccacagtagtgccatagctgttggacggtactctacacttttgataggtactaacactacacaagtgtgtttactccgtccgacgtgtcaacgagaggtctctcaggctgggtgaaaagttatatgacacgttttaaagcattaaacgtagtctaataaaaaataaattatatatttcgcatgtaaactgtgagataaatttattaagcctaattaatctattattaacaaatgtttaatgtagcaccatattatcaaattatggcacaattaggtttaaaaaaatatctcgtaatttacacgtaatatgtgtaattaatttttttctatatttaatactttatatatgtatcaaatatttgatgtgataggtcggatgaaaagtttttgcgtgggaactgtttcgcctcactctctggcatctgctacggccggtggagcccacaggcggtgttcctccctagggccgtgcgccacgtatggtgtcggagctccaccatggaggcgccgtccatatgagtatatgaccctataggacacggcgccatacgcttttacacgtggcagatcacttttacacgtggagtataacgaatgtggaaatcatgtacagccttttcttttttatttagagctggatttttggataggatcttcgtgagaatgggaagggagaagattaagaagttgcgtctgatgagatgagccattaattaaatattgattattttatacttaaaatacgatttcgctagaaatctaccgtgtgactttttcccggtgattttacggatttgctgaccgcacgatggtggaggctgcatgcgtggtcagccggtcgggatgatcttgttcgtactgtgctcgtccctttgggcatgaggagtggagacgatcgccggacgggacgaccttctctgcacttgaatcttgtgcgtaagtctgaaccaagccaaagctaggatcccacactaattacaccaccatgtggccatgcctaacaaatctaccatcgctataaacctgttctattcaattctttttttaaaaaaaatttaacagatataattacaatacaattatagtgtaattatactgcaacttatatataattacactgtaacttatatgtaactaaattacagacatatataactaaaattacatttgtaaattcagttgatatgatatgtaaatgcactgtaattttgataaaaataaagtataagtaaatatgtatttgttattttttttaaaatataaaattacagtcctacataactaaaattacatttgtaaattcagttgatatgatatgtaagtgcactgtaatttttataaaaataaagtgtaagtaaatatgtatttgttattttctttaaaatataaaattacagttttatataacaaaaattatatttgtaaattcagttgatatgacatgtaagtatttagaatataacattacagtcctatataactaaaattacatatgtaaatttagttgatatgatatgtaagttcactataattttgataaaaatattgaataagtaaatttgtattagttattttattttgtagtccgttggatataaatctaagtgtaaaaaaaaaatctggtgatttcttattaaaaatcacccgacaaatgtgtaggcatagtaacttttttaatatatatttttaaaaaagtaccgttgattaggaagcgtacacgcaaaaaaaaaaacgagataaaccttctcccttttcatcctaaacgactatgcttaagtgttgtttcgttgtctttagaaacagaatcggtggcatctcgtcaaaaattgatgctcggtcggtcaggaatcaaccatacttatcaatttaactattttttaagtgtttacgggcaaaagaaacaagaaaaaaaatcaaaattttatatattgctataaatagtaacggtcagataccacttctatacctactttgaaaaatcagtaattttctgatcgtcacgtagccgctttcgtccgtcttgtgcattttcttcagtcgtgcgagaatcctatttgctcacgatcctcttttcgccccgcgcttcctgttaggatacgtataggctacgatagcataaatcaaaattttctgtcgcgtaaaccaggaaccatgcaagtattagatcatagatcgttaccactcgacgcgccgcgcagtggaagaagacgttgagaagtcgaaggaactctcgggaagtagcgcgcgtcgatgtagagaaagtagtcgatcgcatcggctcgaccttctcctcctcgtacgttctcctcgccgtactcccacgctgatcagcaccgcaaaccagcgacgcctctaccggtatccacacgtacagggacggaacgccacgcgcagatgtgctagcacccgcgcgcggctatggttttgctcggggagggaagtgacggctagggtttctcacgtgatgcaatacctccgccggtcacacccctcacgaatatataggatccatcacttgggcctccaaggcccgtaggaatcctattcggatccctatccaaattaaactcatattggatctccatccaatccccttattccggcccattaagcgtgcgaccctataggttcatatatactcggttgtaacccgaaaactccttttcggtccacgcgtcaacagcggcccctagcagaacgtattgacccaccgggcatacataaagatcatatcggctgaacctctagtatatacttgtatgaaccccttacctcacgatatcaattaagctcaaggctagatatgtgtcgtcctctaatagctcaatcattcactcgaacctgttgatagattatataatttgtgattgactcctcaatcacctttggcatggccatgcacttccatattctacaacatcgaggggtccagagatatctctccataggaggggcaaatcccatcttgattatttatatcccactacatgtttcatagcatacccgaaaactacttttataactacccaattacgaagtagcgtttagcaatcctaagaaagctactacatatgttgggaaccatgataatctcaggtctaaggattcagcaccaacactaaatgagatcactgatgacacaacacatatggcccttgcagtatctcatgttgggtctatctaacaacatgttcactaacatgtgtctacattattaatttggtatctctataccatgatctatgagacatgatcatcaattaatacatgtgctgatcatctaaacatatttgtttcacatatgatatttgatcagggatcctttagaaatagcaacacataacataacataaagagtctcatgaaagaatcacatattcattaaccaataatgagttatctatttcaaggaacaatgtcggataaatatgtaaacatagtatgtgatacaatcatctctatgattgcctctagggcatatcactaacagtctcccacttgcactagagtcaatcatgaatgtatcttacacccattgccctagtgtgtgcctcatgcttaggctgagggagtggctttgtcaatggatctgcaacattcaaatctgtatgtattttgcatatcttcacatctcctctacccactatctcgtgaatgaggtgataccgccgtaaaatgtgtttggacttttgatgcgatataggctccttggtttgcgcaatggcaccacaattatcgcaatagaggtccatagggcttgaagcactagtcatcacacctagttgagaaacgattttttttatccaaacagcctcctttgctgcttcagaagcggcaatctattcggcttctgttgtagaatcagccactgtatcttgcttcgaactcttccaactcacagcgcctccattcaggcagaacacaaatctagactacgatctaaaatcatctttatcggtttggaagcttgcgtcagtgtaaccatttacaacgagctcttcctgtcctccatagactaggaacatatccttagttcttctcaagtacttcaggatattctttacagctatccagtgactctcacctggatctgattggtatcggtttgttacactaagtgcatatgaaacatctagacgtgtacatagcatagcatacataatggatccgattgctgaggcatatggaatcacactcatcttgtttcgctcatcagtcgtttgaggatactgattcttaccaagattaatgccatatgacatcggtaggaaacctttcttagaatcttgcatgttgaacctcttcaacactttgtcaatgtatgtactctggcttaatccaactagcctctttgatctatctctatagatccttatgcccagaatatatgctgctccccataagtctttcattgaaaatctatttctcaccgatgtcttagcggattcaagcataggaatatcattcccaatcaataatatgtcatctacatataggattagaaacaccagtgcgctcccactaatctttttgtatacacaaggctcttctttgtttttgacaaagaccaccgctttgactacttcgtcaaaaggaatattccaactttgagatgcttgcttcaacccataaatggatttatgcaatttgcatatctttttagctgattgtggatcaacaaatcccttggattgtgtcatgtacacatcttcatcgagatttccattgaggaaagctgttttgacatccatttgccatatctcataatcgaaataggcagcaaccgctaaaacaatccgaatagattttagcatggcggctggcgagaaagtttcatcataatcaacaccttgaatttgtctgaaacctttcaccaccaatcgtgccttgtagatgtaaacatttccat

SEQ ID NO: 22876 - DNA, 649 bp, Oryza sativa
tgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaaca

SEQ ID NO: 22877 - DNA, 1690 bp, Oryza sativa
cacaccatcaggtggatcaaccaagttccaaacttgattgacatgcatggattctatttcggatttcatggctccaagccatttctcagagtctggtcccaccattgcttcctcataggtggttcatcgttgtctaacaacaatatatcacattgtcctgtagttaacaatgcatacctcgcaggtgtacgccgtatcctttcggaccttcatgaagccggtgcttccacaactggttcaacaacaacttgttcaacctgttgaacaacatcttgctcagcttgtggttgtgtggacgttgaagcattttccggtgtttcctgaatttcttcaggtcgcaccatgctcccactatcctttcttgaaataaactctttctccaagaaaacactgtgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatttttaggaaagacaaactgggacgcttccctgtccatatctcatatgatgtcttatccactgattttgatggaaccctatttagggtgaacgcagctgtctctagagcgtaaccccaaaagcatagcggcagatcagtttggctcatcattgattgcaccatgtccaacaatgtacgattcctccgttcagacaccctattccactgaggcgttcctggtggagtgagttgtggaacaattccacactcctttagatgattgccaaattcaagactcaagtactctccaccacgatcagatcttagatacttgattgtcttgcccaaatgattttgtacctcattctgaaattccttgaacttttcaaaggactcagacttatgcctcattaagtagacataaacatatctactaaagtcatcggtaaaggtaataaagtacccaaaaccacctctggcagttgagctcattggttcacatacatcaatatgtactagtcccaatagctcacttgacctttcactttgacccgtgaaaggtgcctttgtcattttgccaagtaaacaaaattcatatgtctcaaatgattcaaaatcaaacgagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgcccacagatctaaaaccataaccctctggttgcaaacaagaagcagagataacgttcttacacaaagctggaatgcaataacaattatttaactccaaaactaatcctgacggtaaagataatggcagagtgccgaccgcaacagcagcaactcttgctccattgcccacgcgaatatccacttcgcctcttgctaagctcctacttcttttcagcccctgcaacgatttgcatatgtgagcaactgacccggtattaaatacccaagaattagtagaggaagtagcaagattaatttctgtaacattaatacttgatgtggaactct

SEQ ID NO: 22878 - DNA, 1678 bp, Oryza sativa
ccttggtcttagagttgctagtactcatgatctcatcagagtttagctttctcttttgaccactcttcttgttgttgggcttgcgcttatgcataaccatcacatggttggagtttttcttaatgctttcctcggcagtctttagcatcccatgcaattctgccaaggtcctgttctagttgttcatgttgaaattcattataaacggctcaaagctgggagggagcgactggagaataaaatctgtagccaactctaggctaaggggaaagccaagcttatctagactctcgatgtaaccaatcattttgatcacatgtgggctcactgcattaccttctgcaagcctgcacgcaaacaaggactttgaggtattaaacctctcagctcttgcttggtcctcaaacatgttacgtagtcccgtgattatcgtatgagcatccaatgcctcatattgcctttgaatcttaggggacatagtagcaagcatgagacaacttatatcatggtattcattgcatcgcctttcatgctccctacattgagcagcaatagcattgttgggcaagtcaactggaaaaggctgtgtaagcacaaactctttgtgctcttgcctgagaacaattctcaggttgcgataccaatccatgaagtttgttccagtcaacttctctttctcaagaatagaccgcaagttaaaattggatggtgtaggagctgccatgatgtatgcaaaatcagcaccatgtttacatttaacctttcattaaacaatttaacaaaatatacttccactatgtattgtgaaacaaaattccctctagtaatatagtgagtcaagatcctcattttattagtgtctagtgagctttggcatcacagctagacaactatcaaaataggtaagcaacaccttgctaatcacatcatatgtgactcttgtgctgttggggtgacatctccatgtccaacccaacctatgccccaaggtccaaaactgttttgataaccttgtcaagtaaaccaataatctctgcatatagatgtccgacatctatcctattttatcatgataaaaagtgacactttactatggcaaacccatcacttatgatcacaaccgtaataggtgcaattattggaagagcataaattacacttaatttttctgagagaatctatcctaccatgttatatcaaatatacaacaacaataaagtaagatagatataaaaacctaagagaaatctaaggggcaacgcacacggcggtcccgttttttctacgactcatgcaaaggtcacggggtacatagatctcatctacgacccgccatgtgaaaaccttaacggcgtaatcaaattatgctgaaaccgagtcaatctcattggctcattttttctcattggcgtgcgttccagtggacatcggactatccgatgaacacaatcgcgctcggccttggtgagtactagacattccagtgaagtcaccaacacacattccgatcacctaagaactcatctacaacaagatagatctcatttactatactgtatatcaactatatgcaatgatctagatcataagctatacatggcggctctgatacccgctgttggatacgatacgcataggctacgatagcataaatcaaaattttctatcgcgtaaacca

SEQ ID NO: 22879 - DNA, 4804 bp, Oryza sativa
gaacctgttgatagattatataacttgtgattgactcctcaatcacctttggcatggccatgcacttccatattctacaacatcgaggggtccagagatatctctccataggaggggcaaatcccatcttgattatttatatcctactacatgtttcatagcatacccgaaaactacttttataactacccaattacggagtagcgtttagcagtccctaagtaagatactacacatgttgggaatcatgataatctcaggtctaaggattcaacaccaacactaaatgagatcactgatgacacaacacatatggctcttgcagtgtctcatgttgggtctatccaacaacatgttcactaacatgtgtccacattattaatttggtatctctataccatgatccatgagacatgatcatcaattaatacatgtgctgatcatctaaatatatttgttccacatatgatatttgatcagagatcctttataaatagcaacacataacataaagagtcttatgaaagaatcacatattcattaaccaataatgagttatctatttcaaggaacaatgtcggataaatatgtaaacatagtatatgatacaatcatctctataattgtctctagggcatatcactaacacttccttcgtctgtgtactttttaacactgggaacatggccgggtttatgagtgggatggatctggaagaaaggtggagttgggatatgacgccacatgacaggtgggctaagactgaatataactttttcttatgctaggagatttttttttcattttatttagaaaaagtttctttgagcaaagttgactggttcgaaaaattcaaaggtctacaatgttataaatcatcatgggtcctagccaaagcaactctatgttgttgatttgtttgtgtcgataagattatgctcccacatgacgcacagttgttatcgaggtctgatttaaaacgtcgataagattatgctcccacatgacacacagttgttatcgaggtctgatttaaaactagattacgatgtgagacacacagggtttgttgtcttttttttcagtgtttaattctaattctgttatatcgggccctctactccccgttcgctctttctgactaaggtttggcatgcgccatttccctccataattaggcgactaccctctctcttcttttacttcctcaacttcctcacattttctttacttctcaatcgcattcgatgcggcaaaatgacggtgtatgattctaaggcattagaaggtgctgcaagtgaaaatatgtagataattgatgttggtaagagcccgccctctagaaccgcacagcgcagcccaatcaacgggtgagcctggttacacacaccaccccgcatatactttcttctacgcttcatgtacttaaagagttaatccgagagtgatatggttagagggaagatgccttataaattggttccacccttgctaaataacaagttggtactaaacacaagtacacagctctcatggatcacacaagctaaattctaattgagtcaggatatcacaatgttacatcactagattcatttcaatatgtaagaaagtttttctagaaaatcttagcgaatgttaaaggtggtagattagaaaaataatctatttttgagtaagttaatgaaaaatatattttctcagagggctcatatcatgaaaaacaaaccctaataatctaatatttatatatttattataattttggtttacatgtcctaacgcacgtgtatttttctagcatataaaaacgatgatcgatctgtcaagaatttaaacagcaaaacagctaactaatctcggatttgggttacccaaattgagtggcagtgtatgacaccaagtcgctaacaaacggatcgaaccgtgaactgataaagaaaaggaataagttcactttgactcccttaaaaagtgactgaatctaatccatgaccctaaaccgcaaaaccggatatctcgacccccgaactattgaaatcggtgcaatttgactccctaggtggttttggagggcggattatctgacatggcgctgacatggcggtgttgacctagtctgtggggttgacgtggcgcttacgtggcatttgaattaaaaagtatctgtaggacccgtttgtcattcacacactaaaaaattgtggagcccactgacatgtggggccccacatgtcatcatctctttcttcttcctcccttgtctcttcccttctctctctccccttccaccggccgcggggagcacgggctggaccggcgacgggagctgagctcgccactgccacggaggtcggcgccggcgccgctggaggcgagatcgaccggccatgcaagtgcgtgagtcctgggcctgggagcccgacgggattggaccgccacggagctgcacgttggctgcggcccgggcgccctggctgaatgcttcatgccacagctcgtcagcgtcatgcgcgcagccgtcgagagggtctgcgtcgtgactcgtgacccaccaataaaatcaaaaaaaaaagaaaatcagccatccagtgcaaattcaccacaaaaacacggtgaaaaccacctgttaattatgaaatctccaccgcgatgcaggagatgggaaagagcaggtctcggagttctctttatataggccggaggggaggaggtcgaccgcacggacggaaaacggcgccggcgacggtggagctcccaattgaaaacaccggtttaagaaatcgattgggggcaatttagtgcgggattaagtgggatttgttggggaaattgatgcccactacacaaggaattgatttttgcaattaatttggaggagaaacgatagggcagggagatcaacggaggcggcagtacttgagtttcatgggagagatgaacagacgacggacaaaggtggaagaagctcctggcgagcggggcccacctgccagcgcatggacagcgaatggaagagaaagagaggggggaggatgaggagaggatgatttatgtgggccccacctgtcagtggtcccacccgtacttttggtgaatgacaaatgagtcccacacatatttttttttatttataatgccacttaagcgctacatcaacgccacgtggaaaggagaccgagtcaacactgccacataggcgccacatcagcgaaaccgtcctccaaaaccgtcgagggagtcaaattacactggttttgagagttggggggtcgagatatccggttttgtggtttagggtcacggaattttgagggtcacaaagtgaacttattcctaaagaaaatacagaatgaattataatcaggccgaaagtacagcccaaggccgggccaggcctatatatgtattcatactgacccatgttttcgctggccttagtctgaccatcaacaagaccaaagcccaaaggccatccaacaaactagtcaccctgcatctctctctctctctctctctctgtgtaacattttgattttgtttgaatgcaatttgatcccaaaactaaaattctaaacactaattaaattaatgcgttgcaagtggagcctaaatagctgacgatggacccatcaatcaatactaatagcacttcttttactatctaaaatactatcgcaactttttttaagaaaactttcaattgtaacagtaagtataattagagtataattcaaatgcaactgtgccgggtgagttttttctttcttcgctccacacaaatctcgacaggatctgaattcccccccttttttccttcaaaaatctcactgcaatctaacagtctataagttacggacatgtaaaagtttttttcacccaaaaaacttgtaatattctttagcattatcatttctttttgttacattcagatgagttaatgctttgccatttctcttgacctcttgccgccatttaatcatacagtagagatgtgtagttggattcttagcccaaaatccgtcataaacatctcattccatccactaattatcttcgttttttcaattaagttataatgttattcgatcgcgatattttcactcgtctctcccagtactcatgagctacgtcctacgctttctcctcttgtatgccaacattttactttattattttcttagctactacatactccatcctaaaataatttaaacctgaccatgagaatatgagtctgaacaaggttcgtagttaggatttaatgcttttttatgacagagggagtatataaattcagtagacaatccttaaactaatttattaattcgtcaaattccagccgggtcgaaaaactcctatccaaaacgtaaatgtctgaaaccacaaaccatttattgtttacccaaattaatttccacgtgcgtacataaaattgtccatttcttccgcatatagtgacagtaacaaagaacaataattaagcaccagaagaactaatgaacagtcaatcgattaagcatgcaaaagttcatatattgatcatgacccacactactaactaactacttacttgacactctacctgaagattaattatatatgttcgtccagcttcaataaacctagcctgccgaacacatattacatatatataattatagcttggtcatgaattaatacaaatgcatgcgcataagtaactaatcaattaaagacaacatcacgagagttaataattagttatctaagaacaaccaagcctaagctcaagatccaaccctttcttcataccaccaccgac

SEQ ID NO: 22880 - DNA, 19189 bp, Oryza sativa
attttttaagcaactttcgtgtagaaacttttttttaaaaaaaacacaacgtttagcagtttgaaaagcgtgtgcgaggaaaacgagagagatgagttgggaaacttggggtaagaacacattctaaagtgcatgacatgtggggtcccaggctacatgtatgacagacatgtgggccactgcatgtcggtcagacacacacaaactatatatatctggttagtgattttcaaagggtagctagctagtgatgcatggaaagggagagagagaagccattgaaagcagctggtttttgccaagatgtacaaacggcatgcaatcgatgtgtcgaccaagataccgtcagagcgatgagagccaatgtggggaagactatgtgacatgtgtttgcaacccctgcagaagctttccctgcaggacaagacacccgtggctatccagccatacatcagatgcaagagattaacctgctggctttagggttagcatccatgcatgcagatgcagtcacacagggcccaccatttttctgagctcttgcaaagctagtcttcgtcctaggagactgcacagttgcatatatatttggatatggattttcatctctcgaggggatgtcttctctttgcatgtcatcagttataaaaaaatttgacaacatagattaatatgaaatataaaactccaaaaacgtgcaagaccaaattcaacttccacaagttgcaacaaaaagaacaaaataaactgaaaatagttatcgtacattcgcaactatatttgttatttttgttacaacttgtagaagttaaattttaacttatgtgttatggagtgatatatttcatattaatctatcttaccaatttttttaaaatattttgatgactatttaggtggcatgcacgatacgaggggttatcacttgagggatgaaatcgctttccacacacacaatttatctaattgcagagatctagctaggtttgcactgtgatctgagctaggttttttgcttgcttctgactcactccagctagctagctgctggctgcatctgcttatatatatgcattgttcagagaggcaaaaggagtagtgatatgttaccgatgccctgaaagcatacttggccttactccatatatatttgcattcaactttggtcagcatatgttagagtacactgctcttgtgttcatctttcttcctttttttttcttttgtttcacatatgtaatgtatatgtatattcgagcttcatcattggttaggtgtcatgtctagctgcaagacatcacatcagtcaatttaagttgttcacagctgaattgaatcaatgaatgcatggagtggttttcatttttttctgggtcaactcggtcgaaagattgaaggcctgcaggcatgctatgagctcttactggcttgtctgacgagtgaacaagccttttggcagtttgcactgcatcccattggccagcatggggcgggcaattcaggcttaggaacacatgatgctcttagaaaggtgaagtaattgttgctaaaagtgtactagagtactagctacaactgttctccccaacacaactatatatgatccttgatggcatgatgtcccctgaaaattgagatggtactattatctctttttttttacttgatgtttacaacaatatagatacaatcttcagtgcatatgtttggtcattcctttttattatgtatttacaacaaaaatattggattttcagtgcaaattttcagttcaatagaatatatttgattttaccattatatttgttacaattaaatcattacaataagttcatattttgttatatttctgataaaatatataaatatgattatattgctaattaaattaattttatattatacataagatagcgaattataatggttgaaacattagaaaaatacttactgaaacatccaaacaacaacatgagcaacatttataaatgaattaatgaaacactagaacatatttactaaactatccaaataacaccacatgcaacacatgcaaataaaccagtgaaacgttagaaaatatctaatggaacatctcagtaactttcgatccggtgtttcggaaaacatctaatgattatatatatatatatatatatatatatatatttcgaatatagataaagggtgtgttcgctgcagccggctcccaatgtacgcacggaaaacagagcggtccattagcacgtgattaattaagtatttgctaatttttttttcaaaaatggattaatttgatttttttaagcaactttcgtatagaatttttatttgcaaaaaacacatcgtttagcagtttgaaaagcgtgcgcgtggaaaacgagagagaggggttgggaaaatgggcatctgaacacagccaaagtgtgtgtcgcacaacaattttcgtccgggattaaaaattattaaataatgtatttctagaaattaaattaaaagttaaagcaatttaatcaagtgaattcatgagggaatcaaaattttcctttaaaaatcgtggctggaaatatttttctaatattctccgtgctatagtatactctctgaaatttcctgtgaatttttggagctcaatatctaattttaacatcacaaagttcattaaatccattaaataaaataaaaaacaaatttaaatctccatccttcactttgggccgcttcaggcccaaagcccttccttcgtcccttacggcgcccactcggccgtcctcctttccttttcccctcccgctcggcctccctcctatctactcccttccctgcccagttcgccgctcggctcgctcctctccttccccgtaagatatctcgcctccctcctctcccccgagccaccgaccgttgggacccacctgtcagggttatccacttcctccggccaaacctccatggctgccagcctccaccccacgtcgccgccaaattcagtgccctcccgctcgcgcgcccgcgtccaaacagcttggaccggtcccctccacatcctccaccatttcccccactctccccatgaagatcaccgccggtttgacctgatgcgccccacatcgtcgccccacttcgccggcgatttccgcctcttttagcctcatgccgcacctccgagacctataataaccctccccatgcatccctatatcaatttcccatcttcctgagctctcctgtgccccaaaaccatcccctcgccgcaatcctgagctctgccacttgccgcaaaactccggccaatcgttgccgctggtgtagtcactgccgcaccgcgccgaggccgcctctggcttcgccgccccacgccacgtacaacccgtccaccaccctacttccccaatccattgtcgaaacgccatcttccctgcaaacccgagctctaccgccactttgctgactccggccggtcgctttcgccaccctagccaccgccgcaccgtgcagcctccaccacgcccctacgcacctcagccaccgcaaccctctcctccccgtcaaggtgaggtccaccccgtgctgccaccatcggccgtcgtttccggccgttccacacccgttttaccctccctaatccctccatctccctcccgaggccgtcctgctcctcagctgcccctccgccatcgccggcagccgccggaatgccttccgcgccatcgtcccacgggttccgtcgccatatccctgccacggagttccccgtggctccactcgcagccgtcgggcacttggtgagtaccccctcctcctcctctcacggttaccctctcctgcgcctccttccgcgccgcccggtggtaaccggcggtgaccccaggccacgcgcagccagttcgtcgccgctgtctgctcgccaccctctgccttggccgcccgattggtcgccctgaccaatccgggccgtccatgaggtggacgtgcgcccgggccacatgtggacctggttcgccgtgcgctctcccattgtgccgctgacgtgcgaggcccgcgtgtcggctcgacctctccttgatgacatcagcagtcccctttttcttttgtaaaaataattaataattgcacaacaatttgtatttaattccaaaaattgatttaaatggctcaaaacttctaaaagtcatatctaattcatacgtactccaaattatgccactcaacttgtaaaagtcatctaaaattgacttctacatgattgtttacttttcatgaactgtttatttggtttcgcgtgccagcgcgtagattccgtcgttttggaagatcgcgatgttgaggaaagtgtttgaatgatcggttgaagaagcaaggcaagtcaaacattccccttgagcatattaagcctactttataaatgttttactgtttgcaaataaaattgcatgttttgctaatttcgtgggaataggttttacctatctgcttgcttgtgccatgtttaattcataaccatcctttgtcaaacttaggtgataattttactagctcgtgtcacttatgttgatcttgcttggattatatatgcttagccatgcttaattaccactagctcacttaatgggataatcacattatttacatatagtgtcttgttgagctgcgagctcgacacattggaccgttgtttaatggtcgtgagtaatccaataaaaatatgtcttaatggtgggttgtgggtgcatggttttgctagtcgtatccatggcagttaaggactagttcgcgagaaacccttggaagacttaccgcacttaccacaagcaagaatgagcaactgctggacttgtagtgtagcttgtctctagccgacgttcctaggcaagggtgagcgtgatggagttcggatggaccgtgctgcagtctatgcggctgccggattcagcaaggcaccagggggacttcccactgccagttataggggtgggggcgaaacacgatgtaacgctctgctttccgcgtggcgttaaaaagctaatttaacgaaaaccctaattgcgaaaatttcgttctttgagtgttgagtctaagttgtaccaaagatctcaatttaaatctctcctttggtccatcttcgtgcaatcaaaaatcgcctcatcaaaaattccccacctcaagatcccaatcccgattcaagtctccaaatcaattccgaaattcacttccttcctttgaatccttgacaatattcgccccgactccaaaaatatccaaagttccattttgcattcttctccaaacccaaatctctccaaatcaatctttcagcaaaagtctattttacctccctcaggtgttgtgggccgttttcccccttagcccacctccctccctcggtcgtttctcctccgtcagcctcgcacgtgcgttgcacgtgccgagccgagccgagagagagctctctcactctctctgtttctccctctctctctcgttttctctctctcgcgccgacgccgcttcccgccgtcgctgcccaaaatccgccactgccttcgctctttcccgcgctcgcgcgtggccgaccggccggtcgttgccaccgtcagccctgccacgcctgcgccgcgcagccgcccggttgccgccgcgtcaagccctggcgtcgcctgcatcgtgcgctgccgctctgccgctccatgccgctagcttccaaagccgagagaggcagcccctctctcactccctctccctcctttaacttttcccgaaacagcaaggagtagagctccctttctccccctcctttttccttttgcccgaccaccattggcgtcaccgcctgccaccgcctggaccacgggcgcgaccgccagctcctccccttgaccgccctaagtcggtttcctcccccaaaaccgacttcccgcacccataaaacccaacccgagcccctccctttcctcctcgtttccttgcccaacctccatcgcgccattgttgccaccccgccctgcagtcgccctcgctgtctgtcgccgaagcaccagggagaccggtgcgtgcgtggacgcgtgacgcgggactccgggcaccctctccttccccttccccggcccgaggccggagagctcgccacgcaccgccgccgcccatcactgcgcccggctcagtagtgcctccctccgttctccttcctcgttctccctcgccctctctagcttgcatgatagctcagttagcccctcgaacgcgcgtagacgccgccccgagctccgccgccgctcggcatggccttgccgccgtcggcgccccctcccggaggccgcctctcgtcgccggacctccacggcgcctccccaccctatctgatcccagaaacgaaacccttgagccccggagatgctcccgccacctttaattgagtcctcgtcgcccctcggtgatttcccctttctctcgccgccggccgccactgtcgaattccaccgctgtcgaactccctctagcgaatccgagccgttggctcgctccttctcgatgccctcgtcactccggtgtgctccccgaagaccaaatccgtcgcgcttgctccggtgaacatggcctccgtccgccatccatctcggcctccccttcttcctcctcccgccggcctgcgtggctgccacgtaggcgccacgtcggcgccacctcggctttgaccgagccgagccggtcagccgcctcctccctcccccctcggacgcgcggtccatggtgcgccaaccggctgcgcgtgggcccgccgcatccctggtccatccggtgcacgcgcatgaaccgcgctcacccgaaaccctagcaccgccctcatgcgccgctcccacggtgagccgcgccaccgacaagcgggccccactcgggaccccacaaggtggactcggcccaccggccctttctctccctcacttaccccgcgcccccttgggccgcctctccgggccggccggcccattagttcggccgagccgtgcctctcctcttgggccgcacccaagccgcccgaggaagtctaaatcatatccctccttcaatttctttccaaaaagggtttaataaattattaaatcctttttcctttagacagaaattccttaatccttagaaaatccatatcttctcaaccgctcatccgattgactccgttaaacttccaataattccgtaaaaattgagatctatctaatggtactattatctagtctaaataggatctttattttgggtcttgtgtagatttttaattgtttgcgtatagttgcggttaccggattttcgtcgatcgcgggttttctcgaagattcgtgaagcttcgtgaagacctcgagcaaggcaaatcaccctttgaccaattgctcctataattggaaaatcattattaatttgtttgcaacttgcattattagcaacacacatttatagcatgcttggcctcggtttgcgtgccaaaccgacggacctacctagtagtcgcactaattcctgtaggctgtactaccctgaatccttgtcgctccacctttgtggtacttcggtatccgtgctctctgagcgcgtataccaactattccacatacaccgttgtttgtcgataatctgagaaatgggtttgagaagcctttaaaacccgacatgtggtgtcggcgtgtttgaaaataaaatgaattgtgaaaactcgcgatgcggatgctgtgcctgggtggcactgtcccgtattcgcatataaggaccgattcctttgggaaattcatcaagcataacaagtgcaaccacatggtggtatgggacaccctggctaagtaattagctgcttttgggaaatcttgtataccaatagaggcggaaagccgggatgtgggggtagaggcatcctgggagtccgaaacagaggaaggcacccgggagtcctaaaaggaaagccggagttggcccgatgttggtcagggagaccctctatgtggcatgaggtaacccagagttagctttggaaatgccttgtcgcgaatctcccttttccagccgtgtgtcatgaacacgggttaggtgatgggagcaagttcgtgttgtgtgggtaaagtgtacccctctgcagaggttaaccaactgttcgaacagccgtgcccacggtcatgggcggatgtgaggtggttcccgttgcgtagatttgtttgcctgtgctttgtgaaaagttgttgtggattgggaatcgtaaccagaatcagcctaagtggcagatggatgacctgagtggtcagaaacgaatctgtgtgattcgggatgtctgcgggcatcatagactaggcttcccgagtggaagcggattgttgtgctgctgggcagctggactctgggagtccacaaaaatgaaaaggctctgggagccgcctaatcaagtgaaatggctctgggagccgagaagtaatgatctgaccttggaggtcggtacattaccaattgagttgttgaaaagcatctcttaagccgaatcgagacgcaagtctcttttcaacccaaacctaaaaagaaataaatcacttagtgatttcaaaatgatttcaaacaaaagatttgcaaaacaaccttgcctctcttccaagcttgcattaaacacctaagttcccgtgacttgctgagtacgaaagtactcacccttgctctctctctctctctctatatatatatatatatatatatatatatatatatatatatatatatatatatatatatatatagttcctccgcccggatgctgaagatgaagaaaagtgaagattagggtttcgtcctggttcccagccgtcgcctgtggtgttgggtgttagaccgttggttccactgctgctgctgttgctggtgtttcctcgtctgtgtcttcggttgtattctcaggctgtcctgagctgcaacctaagttaaggtaaataagtcctctacttattttaaggatttgcaatgattcatatttgtcaccgtgggtaccagcactatgtcctgggactggtactatgatcgcggtttcgtaggaagcggttcgcgccgtttttcctacgacacgctcctgtcaggtgctgttgtacggcggtgccggattggggtgtgacacacgaggtgtggtgcgcttggttaggggggagttatgcgaagggtcttgtcacaatctctcgcatggtaacgtgttaggcatggcatggtgtcatacggtggattgtgtctcgtgggtacaattgtgcatctctggtcagagtaaaaactatttgaatagctgtgcccgcggttatgggcgatcgatcagcttcaccgtgatttgtcccactctattaattaaattgacttaatgaactggtgtagttcaagtggaatagttgggtttgttcaacatagttatagcattgataagtggagatttaatcttgagttaattaaacaattgttttaaactataaatgtttacaaccgtctttacgcaaatagccacaaacctcccattgtctccccttgcatgtctgtatcattggtgtggcttgctgagtacggtggttgtactcagccttactgttactcccccttttcagaagtgttatgcttctgagctgaagacagagttagaggaccaaggcttataccccagttgagttttgcctgtggagtggagctaaagccatgctaggatcacctttttccgctgttgttgctttctttttgtgtgaggactaattgcctattctataagtatgtacgctttatttatgtttggatctgtatattaatttgtcgttttgtgtaccttggctgattcctagacagggacttaatacacaaaatactctagaaatttcggctaaatttctgggagtgactgtgcatgcaaaatgagaaatccattagcacatgattaattgagtttaaataatttcaaacttaaaaatggatttatttcatactgtaatggtacttctacatacaaaattttcatatgaaatgtatcatctagtagtttgagtaccgtgccaacagaaatcgatgaaaaatatgtattttaatcagaaaaaagaacggggcttagagtggttttgacaaacaaacagattgtgttgccactccgataatttcgtgtagagtcgtattcggagacatttaattgtattttttctctcaaaaacggaaacaaatatggcatcaatgttattgggtagatatgaaaaaaagtaagaaaaccgtgtatagatgcctaccaaaagtaggaaatactttttttttcacctacaaaaataaaaacttaaaaaatgcttttcataggcaggtcctaaagagagccacccgtggaaatcgatttacagaaacattcgtaattcagcccgtgcaaaaaccagcgatttctataggcacatggttgtaggtggatcagaaaacgctcgtgtaaatgggttatcagccacctgtacaaatgttttatgtagtagtgcgttttactttttctttttcttagaattcctctaatttattagaggtgacacatggcagcagggtttgtaagaacatcaccaacagcatctcgatatcatttcctatctggtattttggagatttttggttaaaaattgcatccaatagattctcaaccaactctcccaatccttccagttaccaattgagttcgctcccaatctgtctaagggcggcgaggcggcagttagggttgcatgcgagcgtgatctcatgagagcgaggagtgaaaactgatttctgttggaagtatcctaatgggcccacctttttgtttttaggaaaccaattatagctaatgtgttggagggatgttcttggtgatgcatgctcatgtttagtggattttaagaatatggataatatggagattgctacctatcggacgtatgacattttgcaaaaaatcggacggtgtttcaccacatgtaaaaaaatgtttcaaatgtttcatcactcattgaataatgtttcactaaaaaatgttttagatgtttcattactcgatgagaaatgtttcaccacttggaaaaaaatgtttcaatcagataaaacaatgaaaaaacactggttgcaacattaagactctattatgcaacatcgaagaaaacacatcgtacatcatgtgcaacatccgatgaaacatggatgaaacacacaaataaaatagagtgcaacaaacatatacaatatattgcaatgcaacatgatcgttaagaatgatctcatggctctattcagagaatttcataaagggacattacccctttatagcctaaactttgggatcatcgtgctgctgccaaaaaaggctgatgcaaaacaaatttaacaatataggcctatttgcctactgagtgtaggctttaaaatttttacaaaagttggcaccaatagaattacagcggttgctcacaaagtcattcgcccaacccaaacggcgtttttgctagatagaaatatcatggaaggggtggtgattttgcataagactgtccaagagttacacacaaagaaaatggatggtatcatattcaaaattgacttcgaataggcttatgacaaagctaaatggtagttccttcagcagacattacgaatgaaagggttttcacaatcatggtgcaattggatttccaactgggttgaaggaggaactgtaaatgtcaaagtcaatgataatgtaggaaaaaaattccggacatgcaaaggcttgagacaaggggatccaatgtccccaattctttttaacatagtgactgatatgttagccattcttattaaaagagccaaagccgatgtccaaattagaggggtaattccacacttagtggatgatggtttgtccattctccaacatgccgacgatagaataatatttcttgaacatgattttgaacaagcaaaaaacatgaaggccattcttgttgaacatctctcggggctgaaaataaactttcataaaagtgaaattttctgctttgggggagctaaggaaatgaaggatcaatataaacaactgtttggttgtaattctggttcctttccattcagatacttaggaatccccatacactatcgaaaactcagaaattctgattggaaatgtgtggaggataggtttcaaagaaaactgagcacatggaagggcaaaaataactcctatggtgggatattggttcttcttaactcggttctttcgagccttcccatgtttatgctattcttttttgaaatacctcgaggtgtacttcgaagactggatttctaccgatcgagctttttctggagcagtgatagccagaaaaagaaatataggttaacaaaatgggattatatatgccggccaaaatatcaaggtggactgggtgtcctaaatcttgatatcatgaatagatgtttgttgagcaaatggctattcaagcttcttaatggtgatggcctatggcaaaatcttttacccaacaagtacttaaagggtaaacccctctcccatatgtcacacaaaccaggaacatctcaattttgggttggcctaatgaaagtaaaagatcaattttttcagtatggatcttttaaacctggtaatgggatagagataagattttgggaagacacatggttgggcttgcaacctctcaaatatcaatatccttctctgtacaatgtggttcgaaagagacattctactttggcagaggttacgagcacaacaccgttgaatgtttcattctgacgatcaattgtaggaccaaagttagttgagtggaatgatttgatttctcgactagctaatataaccctgtcaaatgaaaatgattgctttatttagtcgctacataaaaatggccatttttcggtcaaatccatgtataatgcgatcatcaattccaatgtaaggatctgtaagaggatcttatgggaggtgaaggtaccactaaaaatcaaagtatttatgtggtttcttgacaaaaaaaagtaatcttgatgaaagataacttcacgaagataaaatggaggggaaacaagcaatgttgattttgtaatacacaagagaccatccaacatcttttgtttgactgtcatgctgcacgttttgcttggcgatgtgtcttctttgcttcaatattccctgcccacaatgcaaaagatatttttggtaactggctaaggggagttcctagacccacaaaaaaaataattttatttggagctagtgctctatgttggtcaatttggcgttgccgtaatgatatagtttttaaccataaaaaaatgcctaacatcatgcaggttatcttcatatgttctaattggctccactcttggtgtatgatgctttcacagaaacaacaggatactatgcgcaatggtgctacacgcttggaattggtacgtagccaaggaacttttattctagtttggatagcgtagtacctacagaatttcgtgatagaatctacgtgattttaaaaaatattatttagtagatcatattatcggcaaaagttggggatttgtcccatctcgccttttttaagctcttttctgttcacttctggactttttggttgtgtgcctatggacagaagccggagatgtaacccatttccattatctaaaataattgcaatgcaacatcaaatcaaaataaagtgaaacagcttactacaatagagtgcaacaagctaaaacagtaggatgtaacatccctaaactccaactaaataaacccgtctccgtcttcatcaaaataaacccacctccatcttcttcatctccggtcgccggcgagtccacctccatcaccggcggcggctgttcttgctgtagcgccactacgcccaccgccggcggggatgggggagataggtgcagaggtggtttacctggcgaggccaatggagggcggcgttggagcagcaggagaggagcccatcggggtagaggaaggtgcacaagcagccgagcatgatgccaacggcgaccgccgccgcgatgcacgaccccaccaccgtcgtgtcgtgccgcccccacccctgtcggcgtggtcgctagcctcctcctccctcttcgcgtggtcgcgagaagcagtgctacggtgttgaggggagagaaagagagaagaatgatagagataaggttgatcggtggagagaaaatagtgtgatagtggttaagtgggacccactcggtggcacatctgattttttgcgccgtatcgaaattccgttgtaaagaattttcgggataatatccatgaaagtgacagagacgtaggcatgagtatatgacacttaatttgtctattcgttgcggaaactggacgagatggaagctgttggctcttcagagtacatccggataaaaatacttcctaaacatacattgttgagagttgcatgctttaatttgtagtagtacgtacgtacacgcaagttttattttaattcatagcataatgcccgtgcttcgctacgggtaaacaaaatttcatactaaggccctgtttagtgcccacgcaaaaattttacaccccgtcacatcgaacgtttgaacacctatataaagtattaaatataggttaaaaaataactaattgcacagattccaactactttgcaagatgaattttttaagcttaattgcttcatgatttgacaatatggtgatacagtaaatatttgctaatgacggattaattaggcttaataaatttgtctcgcagtttgttgacggattgtgcaattagtttttttattaatgaccgaacaccctatacgaaaccctatataatacccaatatgaaacgctaaaactttacgcccctagatctaaacatcctcttaaagtatatttcatgataaaaacaaatcacaataaaataattaataattatgtgcttatactacatttcttggtaaaacgaataacaaaataattaaatcctatgagtaacattcacaggcctcactaacgcaccaagatttttaatttccaaacaaccaagaatttttggatgaaaaaagtggcacgaacgagaccagagctacacgaacgtgacaccgtgttgtgtcgaccaccaccgtcgtcttcttctcctcctatggcatttgaaattgacaaaaatcaagaggagacacaagcggacgatggacgatggacgaaaatcaagccgagagaagttgcgcgctgcggacgacggatctctgtttttttttgtccgctgtatgtgattacgagcgcacagacacaaagggtgtagctctcggtcggattacggacgataaaattgtgacgattggaaaattactaattttttaattagttaagatttgaatacttcagagcagatgatttttgacaaaagaaaaacattatgatcaattatacgtcgccacgccagctgtcacgagtaactaacaaatgaaggtcgtactatatatgtactcacgcagattgacgctcctgggatcagtaatgcccatggtctttttctacatatgtcattttgacaatctagcaacacacaacaataatcgtcatttgatacatattccatgaatgattgatctcttttgcatttgttcgtccctttcgttttcaacttggtactcgtaatttcttttaaagaacaactacttgcaattcccaaacatggagtactacatttgtctagcttccatcaaagtatatatatatgaaacagcaaccttcaattaatttagctctcgttgatcgattgatcgatcagtttgcaggctgtgttggctgcatcaggtcagcaattaatctagctagtcatctacggctagataacccttgcagttctcgtctacacacttctctttgcgaggtacgtatgtgttctctttgtcttgttaaagttaatttcgtaaatataatatagattatttgataaaataatggaattaaattatagattttgaagaattgtgtcaagctggaacctttttttaattctcaataattttgtcatgaccttgatgctagaattcttacagcgctatggctttgcagtttcgtgacatatatgcatgttcattgctaaacctgtagattattcgtagataaatcttcttgattaaatatatatgtttacaataattttattaaactataataaatacattcctgatcaagaagcagaaactttgcagagccgttgttcatcatggcaggcgagcaaggttcagctatggccaacagaggaggccgggcaaatcggaaagaaggggaggacgagctacgaggctggctgatgttgctggcgacgctgacggcgtccatcacgtacgcggcggcgctgaaccctcccggcggcgtctggcaagccgacgacgccgccaaggacttcgtcgccggctacccggtcctcctcgacaagtcgccgtggcgctactacgtcttctactactgcaacgccacctccttcgcgtcgtccgtgtgcatcatcgtcctgctcgccaccaacttctacctgagccataccagtgtcatggtcttcaacgtgctcgtcgccctggacatggccagcttgggcgccgcgttcgtcgcgggctcgtcgagcagcaagcggtttacggctttcaacgcggggctgatggtatgcctcgtcgtgctgttcctcctgtggaaactgaagtttctcatgggtaatgatcaagcaggtcaaaatcctgctagtggaggtgtcgccaatttacaacatggcaacagtgcattataaatttataataatgtaaataaatttctctgatttaatcatgtcatggtagatgtataccggatataatgcctgctgcctggcactttgctatggaacctaatgatgaatttatacgttaaataatgttgaaatatggtatatggatatattttaaaatttaatattatggaaatgatgtcgaggatatatagcatgatgatatgattagtcagtacacgatgtgatatatttatattttgagctttagaagttcataattattattggatgatgttgcggtatatttacatattacctttaggatctaatatttactagcgggtttcaattttatacaagatatactacattaggaatgtttatcgtgtcattacaaaatatttcatttttattggctagaactagattatttaatattaaccgattggatgaaagataatattacaagatgctattgaaggaactagaaatgtaagtgccggttccaaagaagtttaatccatctcacaacatgccattttaaaaaggtaaatcctattccaatcatcctccaggtgaccaaaatttaaaaattctgtagctcatgtatcccagcaagttaggccgtctccaatggacagctcttatctagctcatagagtgttttaatcgatgaacaggaccgctagctcttcttcaagcgttagctcgcacgctcaccgaggcggtgccctctcacaggcacgctcgcccaggcaatggccggcactatgccgagcgcgtatgagctagcagccggctcataccgctggataaggccttagacaaactgagccaatgccacaagcaacagtggcgtacattcatgcacctactcctctatgggtagatctatttagagaagcttctagcatctatatattcttctacaattttcagctcccagatttttattcatgtactgagaatatatatagtttcagaatctatatttacgccaaacttttcatgtactgaatatgaagctgaaaaactaaacttttctagcttccgaatcttaagcactcttagacagtacttaagccagtgacgagcatgcgagtggtttggacggacaaacacatcgtgcccgctctgataatatacataccattgtactcggagacatattaaattttaaattggagtttttttcactcaaaaagggaaacgaatatggcatctctagtatcgggcatatatgaaaaacagtgagataaatatgtatactgcctaccaaatacgaaatattttcttttgagcataataaaattcaaaaattcaattttatggatgggaccttaagagagtcatctatgaaaataatttttaagggcagttggaaatttgcccgtgcaaaaccggtgatttctagatgcacacgcgtggtggcaggtgggtataaaaatgcccgttatcagccgcctacaaaaacgtatatttgtagtagtgtgttttgctttgttttccttaattttttctctaatttattagaaatgacacatgatggtttaaaagcgtttttagtatatttaatgaatttttaagaatataatagatatcccatgacagggacagagatgtaggctgagtataaaatgacgattatggttatatatcagattgacgctcttgggatcagtaatgtccatggtctttttctacatatatgtcattttgacgatccaataaacgcatataacaataatcgtcattttatacatattccatgattgattgatctcttcttttgttcgttcttttcattttcaactttgtactcgtaatttcttttaaccaacaacttgcaattcccaaacatggagtactgcatttgtcttccatctcaagttcgacatatatacgtacgtactaacgtacgcatgagagtatgtacgaaacatcgacctttaatttggctcgttgatcgatcgatcagtttgcaggctgtgtgtagctaagctagctagccatcgacagctagataacccttgaagttcacttctctttgggaggtttggtatgttctctttgtcttgttaaatttaattttatgaatagaaattctttgataaaatcatgaaattaaattataaattttgaagaaatgtgtcaggccagaacttttgaaattcttgattttgtcatgaaatcgatgctaaaacttttggctttcaacgctgcgctgatggtatgcctcgtcctgctgttcttgtggaaacgaaagtggctcatgatgggtcgagcagcggcgaacccaaatcctactagtggagatgtcgccaatttacaacacgacaacagtacattatagtgtaaataaatcgctgaattatatcacggttttacagatatgtatatgtatactagataatacctgcctgg

SEQ ID NO: 22881 - DNA, 2814 bp, Oryza sativa
tcatccactaagcttgggggaaaactgtggagtgtggacgcccctgttcctcattcatctctctacccctctcctgtcctcaaatggcttcgcccttcgggtcggagtcccgaaccccgtcgacgggctgtagcggcgacgacaaccaccaaatctggtcggtggtcctcccaacgacaggcagcagtgaagacgcggtggatctagaggctgccgttgtcgctctgcaatggcctcataaacatggtgcttggcttctatgacctgcgggattggcggctagcacagttgagctcctgagccagaaggtaggaggagcaggctggcgttttcaccatgtagcgctggcgcggcaagcaacgcggtggctgcgacggtgagggcacgcgtcgaggtggccatccgtcgtagatctcgggggaccccatcctgctagccgcactgggaaggtggcatcatcctccccgctacgctagcggcctagcgccagaacggtccagcccggactagaagcggttccagggcaagggtgcttcaactcctttggacgaaggaggcctcaggcgtgggaagtcctccaagatgcgccattcctctggcaagcgcgctcgtctctctcaggagtgtggtgtgtaggagactgaagacgatgggggcaatgttggaagcggcagaaaaagtacctaccccaacatctgcattgtgtactttttcctacagtaatatttcatttggtgggaggacgatgcatctcagtatcacacatcttagcacctattgacagtgcagattgtaggtgcaggcgaacccaagctcaaatctgtattttcctctctctctatatatatatatgtatatatatgtatgtatatttcctctctctatatatatatacagaatcattttcatatatctataactaatataaatattcatatttttccttttgtcacatctaatttcgtccgagttttgtccatacgcaatccgattaagttagcaatagcgatggaaaaaaattgcaaaaaaaaaaatggcggccgccgatgccaccaccgcccgcctccactccgtccaggccgccgcccctcccgcctcgccgagccgcagccgcctccatgccgccggatctggcggaggtgaggtccggccggccacctacacactgtccgacccaccgcctctatgtcgtccgtcaccaccaccgcggcacctcccctccccccgatctcgcggaggggaaggcgttgccggcccttcctccgctgccgcacagagagagagagggggagaagtggagacagtgagggtgggggagggcatcgcggtggggagagggccgctgccaccggatctacccatcggagggcgccaccgcggccactcgcggtggagaaggccgccgttgctgccgctagctgtgggagagggcaccgctgtggccgctcacgatgggggaggacgtcgccgtcgccgccactgctcgtgatgggggaggtagccgccaccccgcgtcggtcgcgagatcaccggccgccgctgaggatgatggggatcgcggtagggcggtagctgtcgccgtcgccgccgctgctcgcggtagggcaagtagccgccgccccgcttctgccgcgagatcgccaatcgccgccgccgctgctagcggtagaggagggcatcgccccggccgctcatgatgggggagggcaccgctgtcgccgccgctgctcgcggtagagaggtagccaccgctgtcgctgtcgctgctcacggtaggacaggtagccaccgcctcacctcggaccccagatcgccggtcgccgccgccactgccactcgcggtgggagagggaggagaatgagtttagggttagggtttcaacatggaatgttttatatatatctcgagtgatcctaaccgttcgattgaatccgacggctcttaatgcatctaagcagacttgggccacatgggccatgtgcacttaacaggccaagttgtggaagacattcggcccatccttatgggcctaattgagttttatctattctgagttgatttaaactatttctccattaacaaacttaatattttcctatgtttagtttttctttcttcatgttaaattatttatatctaaatggagtcaacaaaaaatttaattgtatatttgtcatgatatataatttaaatttggattaaaaataaataatagagtaaatttcattttggaccactttttattacccgtgttttgctttcgaccaccccttaattaacgcattcactttggatcagataatcttacctttgttgcattttggactaccctaactctcttctcaagcatatgaacaatttcgagtacgctggctccgattcatcagtgaactcccaccactttataccctacaatttatttgacatatgacaagtttgatgtagatagataaaatatttgagtgtgctccaaagtgacacaaaggtaagattttctggttcaaagtgaaaatattagttaaaggatggtccaaagcaaaacaccagtagtaaaaggtggcccaaagtaaaatttactctaaataatattaattatttcttgtatggactatagcctcttttggagaatattactctcttccaatattacttattttataattcataattttttagtccaaaatacaaaaagaaaactaaaatacacaaaaaaaaggtttgcagtacaggagttcggttagtttttctttcccttttcatccaggagtgttggtctgcccctcttttctttccgctatttttagcgctcccat

SEQ ID NO: 22882 - DNA, 1106 bp, Oryza sativa
accccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaa

SEQ ID NO: 22883 - DNA, 11690 bp, Oryza sativa
acgacgcggagcagcaggacgccgcctgcagctcgtagcgcatccccgacgacggcgcgccttcctgtgacgacaccgccgccgtgtcaggccacaggatgtccgcttcttggaactcttccatggcggcctggccggccagcgctcgttcccggttaacctggagcccttttcagctgtgaccgcggcgagccggcgggcattcttatactattcgtcttcgacgctcttgctagcggcattgcttgggacccgaagtgacgtagggggcactcttccccccggtgctgattttggaatcttggcgaggtagcaacccatgtggggttacttgctggagcaccttaatgtgagagcttgagcttgcctaagttacagctaattcattacctaaaataaaagttacagctaattaagaggccggcaccggtctgattatctgtggctgtaaaatcaagtcctaaatcgtcttagatatgatgaacatttcttggtcatgctcccacctatctagaacgtgagccgttcgatgatacaaccatctgtttagtactgccgtatgtctggataggttgttgggtgaaaatttcggttcccaagaactgcttttagagcggcggggggaagtcagtgtggcataggtgagcccaaacaaactcaaatattcctagtatctgttgcaaaatttctaccacagaatcctttcggaaattaaaattttaatggtgtagtgtattcgatgatgagtccgggctgctgcccgttgtagctgggcggtggctccgtgctgggtgcaaccgaagtttgcagctgagtgacaaggtagtgtctcctggccgaaggttgagcccacaataattgggcctgtattccggcactcgtggaaatccgtgggcttgtggcctacgagttgtaacctcttcttgtccctacatacatatatgggccatattttgctggcctaattgccggcccgcacgtcatggttctcccctgaattatgtcatgattcctgcttgcggcatgattcccccagcggaacagcatgaagcaaaacggctcaaaacctgccgactcaaaattcacggcgctcacgtcacgagttccgacggtcgacggatagcacagtcatcacagagttcgtcaacagtctcaaacaaaatgctcgttaacaacagcggattgggccaaaatcgccggtcaccaaccgagccaaccaagcacatgcaacgctgtatccccagcactccagcagcgtttctcatcgatcggttagcgcgctacactaaattaaaccttccacgcgtgcagcatcgcgctcgttttaccctaagcgtgaacgcctcaagggaagggataatcgagcccctggctgcggttggacacgccgaattcaatggacttaaaccgaggtagaagagcagaactgtagaagcgtgactgcgtgagcatgtgaagtggattgtgagttgtgactgctcattagccgtatggctttctgcgtgccgggccttgctccggccgatcggtctaaaaaaaggtagtataaaaaggggcagatgatccctaccaaaacggtgcaataaatctagattggggcagcctaaccagtcaaaatgtagcagtctcaacgtactctgatgaaagggtgtgggtctagctggtctagtggtgttactcaaatactccaatcggtcgggctgcatgcgagatctgtgaacagatttctcaaatgtctgcatgtggcgtgtccgggagattctccttcgcatcgtacaatctcatctgtagcgtttttaacacttctttatttttacgctgatgaacatgataaatacttcatccgttctaaaataagtacagtattccactgtttatgtttaacgtttaactttttattttatttaatttttttatgattagtttttttattgttattagatgataaaacatgaatagtattttatgcatgaattttttttatttttttataaaacttttaaatatgacgtgtctacaacgagaccgttctctgtatagtcataaccagctacctcaatctcatatctaattgctactagtatactcaaaagtgcatgtattttttttcttcttatggaattttctcttagattagtcattcgatttacgatccgattacaccattatgttcataacaattaaatctttataacaagatctcacatgactatatttttatgaaaaaatacaaattacttttataatatatgtaaattacttttagattacattaaattacttcttagtcataaaagtaatttacctatattatagaagtaacttaaaaaaaataaagtaacttgttacgacattaaaagaaatctatacatccataatgttattcataatattgtgagttgtttattttataatcatttttagtcagtgacgtaatttgtgctgattaaatttaatttctatatagacccatgtttttacctccataacggatttatttttgatgtcgtgataaggttactttctttttgttttaagttacttttataatttatgtaaattacttttagactttactaaatttactataatatgtctaagaagtaatttaatgaaatctaaaagtaatttagatatattataaaagtaatttatattttttcatcaaaatataatcatgtgagatcttgctataaagatttaattattacgaacacaattacgtaatcggatcatagatcggataagttatttaagagaaaatttaatttgaagtataagtggttcctatttgcttgaaacataggggataaactactctctctctagcgtagcagagtgcgtcacatgccttctgattcggtttgttctggccttcttggcaatatcggcatgtggaacagatcagacgactacaccagcgtgtgggatcggacggccctagatgcgtcgcgtgataagaccagatcgagaggcttctcgagatagattttacgttttaaataagatgaacggtaaaacgttaggcatgtatacccacactcaacattcaacactggtgatcagtcaatactaacaatcaaccgtgactagtgactccaacgagcacgtgcaatccatgcatccctccccactgtgcagtacaggcagccgctgtcctgttcagtcgatcactgcactcccggtctgactgctgcacgagcaacccgactcgatggatcacgatctagtcgccctataaataccaagctccgatgaccccgggcgtgtcgtgtcggccggtcggcgtctcgtttcgccggcgcccgcgcatcttacactgtccaagccagcgcctgcgtgcaggtcgatcgccttctaaaaccggccagcgcgcgcgtctagtgcagcggctgggaatggagcgggtgtcgtgcgtgccgctgcttcggcggctgcttctcttggccgcggccgggctcgcgggcgccgagccgcaggtgccgtgctacttcgtgttcggggactcgctcgtggacaacgggaacaacaacaacatcgcgtcgatggcgcgggccaactacccgccctacggcgtcgacttccccggcggcgcgaccggccggttcagcaacggcctcaccacggccgatgccatctgtaagccgatgtgttactgccgttgattacttggtcagttgatctaatatatatagcatcacatttgtcgatcgatacgtaccatgcaccattttgtagctcggcttctgggcttcgacgactacatccccccgtacgccggcgcaacaagtgagcagctcctcaccggcgtcaacttcgcctctgctgcggccggaatccgggacgacactggacagcaactggtacgcacgtacgcacagctatacacacgcgacacgcactgacgcacacataaaccaacatgtactattcgaaccatgcatgtgtttcgagcgttgcacgctggaaatagcccacacgtatgtacgtatgttcgacacagggtgaacggatcagcttcagcgcgcagctgcagaactaccaggcggccgtgcggcagctggttagcatcctgggcggcgaggacgccgcggcgaaccgcctgagccagtgcatcttcaccgtcggaatgggcagcaacgactacctcaacaactacttcatgccggcgttctaccccaccagccggcagtacacaccggagcagtacgccgacgtgctcatcaaccagtacgcgcagcagctcagggtcaggatcgattacactcgagcctgcaactagttactgtgttgacgatatatgcgacatgacactggaactcaaatcttgtctgcgtcactgtgttggatcagacgctgtacaactacggggccaggaaggtggcggtattcggggtagggcaggtggggtgcagcccgaacgagctggcgcagaacagccgaaacggcgtcacctgcatcgagcggatcaacagcgcagtccggatgttcaaccggagggtggtcgtcctcgtcaaccagttcaaccgcttgttgcccggcgcgctgttcacctacatcaactgctacggcatcttcgagagcatcatgcgcacgccggtggagcacggtacgtactccaaggcaagccccaaaacgagatgtgcctagaactgctacgttatcttgacgggtgggccggtgtgctggctcacgtaccgatggtttcagggctggcggtgacgaacagggggtgctgcggggtggggaggaacaacgggcaggtgacgtgcctcccgtaccaggcgccgtgcgccaaccgggacgagtacctcttctgggacgcgttccacccgacggaggctgccaatatcttcgtcggccggagggcctacagcgcggcgatgcggtccgacgtttacccggtggacctgagcacgctcgctcagctctagctaaggtgcctgcgggctacgccgtgccgcatcaagaattgtccaagatcaggatcaagacttctctctcgtgattgtgcgggaattaatacgcgggaggacgccggaggtctcatatgttttgcttctatggtgtagaacttacagaatatgtgtgggcatcttatacttgtatggagtatatcagtatatgctagttgcagacgttttacagtgcaactgtaactgttgctacaatgttactgaaagagaaacagaagaaaacaaaaacaacagtctgtatattccagtttgtattgctttcaatgctgtctgatgtacaaccgcattgtgatcgacagtgaagcaacaagttgcaaaactatttccagtgaaacacaaatctatggtatataatgagttgattttctatcaatcatgcatacaatcctccacacgaaatcaacaacaggcccaactgactgttaaaaataggatctcgatgaacgtgatgaacgagtggtgctgccctcatttcgatctttcttccacatgccctcaaagctcaggaagcatttgagaggtttcacctgttcaagacaagggcacagccaaagtaaatcaatctgttacttgaacaatttctctattactatgacagaatgttcagaagaccattgcaatacagcaggaaagacattagccgctaccttccaacggtttctctgagatatttcattctggatataagacaattgttcaatgatcgttctaaagtcaggcctgctagcaggattttcactccagcattgttcaatcagcctatcatagtgtggagcagaaaagtggtcagttcagggtgaaatagtggcacataaaagttcaaagttccagataggcaaatggaacacagattgcggaagcttgtacgcaagaagattgcaatggaaaatatgtcataatagtgctccaaacaatttagtagttaccacaggcaaaacaaaagaaggaatgcttactctctcaatccgtaagcataatgctttggaggagctctgaaaggtggcctttctttagaattatgtgccttctcaatttcattatttttcttgtcataaaaagggagacatccttcaatcatctgaaaatgtttggaatatcagtacaaaaactggtcttctagggggctctgggagtaggttcagcagttttactttacagttcatagtggcacaggaatacagaatgttgcatagcaacacttttacctcttgaagtatcaaagcaaatgagaagacatccactttagtatcatattcttcatttcgcaggacttctggagctacatacctacctgcaacatatttgtcatgccaattatcagtgcagaaagaaggtaaacaaatgtaagtgatgatattttggaacagtaagatggatactaatatatagctcaaattcagtatgaattttcttacatgcattgcctggagaagttacagctttctcttctctaacttttcttctccattttagcatcttacacagatcgaaatctgccaccttcagatgtccagtgtcatccctcaatatgtttctgttgtcttacacaatggatagaagaagcctttacaaatcatgtattcaaagcatctggtctagaaataaaataaaagtagtactcacgaaggctcaaggtcacggtggatgatagcttgaggtttatgctcatgtaaataattcatccctctattagatttcagagagaactgcaaatcagtcttcattatagcaacaaaaaagtagaaccaagagattcaggtcatgataggcaaaccttgcaatatcaagagctaatttcactgcatatgacggttccagagcccctttcctactcaagtgcttgcgcaaatcaccctgagaacaaaaattccaaagttctcatcaattcactaaaaaaaggtgttttcatactcaagtgcatgcatagtcatgaaccatttgacattaacagaatactaataggaagttaacaaagctagtgatctgtctttgtagtggggctcaccttctaaaaaagctagaaacagaaagtagttagggaaaagtccatctagtctatgaacatattttggtggaccaaaacagcaaagttaagctcggtacacatatatccagcttgcactgatctattgtgcttgtgaccaaatattagcagctagaaggaaagagtgaaggctaaattggcattaccagttggccaaatatttccaacaaaagaaaagcaacagctaagacaaggaaaaacagatctggcattgccacttgagaatggcaacaacattttatcactcagaactatgaatgaccaggtaactagaaaagttcatctaaagcagcagctcctattgcagtttatcaaataggtctcagatctaaagatgatcagatatgtgaataatgcaaatttaaaaaagcgctgcctataggacaaaccttgggcataaattccattacaatcatcattgggctgctttgtgttacagcacctaaaaattgcacgacattcggatgccgtattagttgtagcacatcaagctcatctctgaatgcttgtctgcaatgcaaaccaatctaatctgtcagggaactacatttttcagacggagtctacaattaagtgaaaaaagacgagtaaaacagtaactgaatactactcaatggaaccaacccacactttgttctcgtccataattagatcgtcatcaagcttcttaacagcaaccagaatgcccctccatgttgctttcctaaatgtaccctgagaaacagatgaaaatgatataaaacataattgacgaaaattgatggagcaacctaacatatttaaaattatgtacagaaagtaggggtcagcaagtcaacaaattagaaacattgtgactggcagattgtgtctctaactgaaaatttcaaataagaaagaaaggctaacatattcatatatacacacctttgatataccatttccattagtgaaatctagctcgttcggggaaatctcgtactcaggaacctcacggacatttttaacatgcataggagcaatcttcaaaaaaaaaaaaaaaggaaataaattcagaaaacttgaacatagcagtacatcaggaagacaaaatgcccgtacataatagttcggaagtaccttaagcttggagccatgcttttccaagatcttgatcacatcatggttctggtaatgcaatgcgtctgccaaaggctgccagatggtagacaaatgatacaacactcgcatattaaaatagcaacctagaaataaacatatatattagaagtattatctcgaatccatctccctcggtgactaagaccatgttcgcgtcaatcaatcattgtacttactgactaaaacttgcatctaataccattccatgggagttcccaattcaactcagattatccccgagtaatcatgaggtttttcagctagagcaataaaatcaccaatagcagcaaaacaaaacaaagttcagggaggctcaccgtgctgccccactggtcctcggcgacggcatccgccccacgctggaggagcagctcgacgacctcggcttgcccctcgcaggcggcgatgtgcatcgccgtgcggccgtcggagtcgcggaagttggggtcggcgccggcgtcgaggagctcctggatcccctcgacgtcgccctcgtgggccatgtacatcagctggaagcccatgaccccgaccgcctcgctcgacccctcctccgagctctcccccgcaccgccgcggtcgggcgccatcgacgactgcttccccagcttaaaccgcggggtcgccgcggccgtcggcgtgcttggcttcggctccatgtggcggcgcgggcgcgggcacgggaggcggctagggttccgatggggaggacgagacgagacgagagatcggatcaatcgaagactttgacggcggaattgagtagagcggcgagaagggggaggggagaagtactagcaggcagccgcgcgaggggaggaggaaccgagttgggaaaaaaacgggtgggtgggtggctgagctggcaacacctccaccaacagaccccacgtatgaaaccgaaaaggaaagaacggccgcaggatccccggatgtgcgggtgacagctgggccccgctgcttaatgcggtagttttgcggttagtgctgtttgctggttaaagcattctcttcgaaagacaggagagaaacagttttgtgttccaattatggtgtttggtcatttggagtacagggactttacgggattattattgtacgaattagcttaaatccttaaaaaaaagttaaaagccttacacgctttggatgtagactaagattattaaggttggacatgtaaaaccataattctattagtgcactttttccgtactcgtaaaggaagttgtttaggataatgtttaagttaaaccttaggaatacaaatcatgaataactctcaagttgttgaatttgaaaatgtaaaaaatatatgaatagatttgtcttgaaaaatactttcataaaaatatacatatatcacttttcaataaatatttttatagaaacaacaagttaaacttgtgttttggagaccgtgtcgctgtctaaaatgacctcctctatgagtacgaaggaagtataactaattaagttttaattatttaaaataaaaaatgtactattttaaaacaatttttatataaaaagttttcgtattaaatacaatatctaacagttcaaaaaaaatatgctaataacaatcgaggtaaaatgtattaatcaaaaaagaaccaggcatatgaccacccaaacccaaatggcgaacacccaggaatgctaacactgatggaattgatcaactaataaatgttatacttccttcgtttcaggttttgattttagtcaaagtcaaattactctaagtttaactaattttgtagaaaaaaatagtaatatttttaatccaatactagtatattatgaaaatttatttaattatatatttaatgaaaaaatgatagtgttataaatattactttttttatagagttagttaaatttatagtttgattttgaccaaatatcttatataactaaaacagaggaagtaaatgtttagatcgagacatgtcggctgcttaatactaagaaaaaggcatgttgttcgcaggagacatcagatgtccggtccaaatctcggggtggttagcgagggaaacactgctagccagtagtagcaatatcatcatgtctttatgacgtatatactaattactaataagataagagctttaggtagtatgaaacgagcattatatatgttgtaagatagttgatggctggagatgcacgttgcggataaggactcgcatgatgtaatggggccttggtgttgtcatcgtgacgccggaacagaccaattggggataaaaagaatcgtaaagcgtgtaggtatggacgaacactatgctgtctagaagcaaagacgccttgatctcctaaagaaattgttgtcgtaaaaatctgaaagtgacattttgcttcttgttcattcggcgggagatatataaataaaagaagacgtagtacaggtctctggtccttgatggttgctaggagacgagctgacgaggaagtattatccactaagatcagggagatatataaataacgaagtattatccactaaaaacattgaacttctctagctgcgtacaatccagcctaagatctgacgagtgaggattaagcgtataatatgagtggtacttatctcaatgttcttttacaagctgggactaactcagcaaaggaaactaaatttttctttagtatttgacgtttgccactttttcaggaggagatgcccctgatatttgtctactttattcgaaagtaggatcgcatattcagataagcatcctctccgatgctgaaaggccgtcgatgaccgagtcatttcgttttctcttcgttttcctcgctgttttattgccttctttccgattatacaaggcaccagcgcattttcaacgtagctgaaagcgcgtacccgaccggccgagccgaccagctgcttgtgcagttcagctgcgtgactgtttccgttgcccagacgggcataagacgacggccaaaatggatttcgtccgcgtctcctcctcacacacgtaaatgatcgatgccgacgcgttttagtacggggaaagaaagcagtcagcttgggccactgtatgtcttcgatttgagttggctgttgttctgactgttcattgggccaacccggggccaccagctacagataaacaaaaatgaaaaaacaaactcagatcactttattctattcgccccgttttctttgtccttattctcactctagaatatttgattgtattagatctatttattttatgtaggagcggattctgatccctcgagaggacacctccttattttgtacatcaaatttattaaaaaagtgaaaaataattggtatagtagatcaacatgtaatatgtttttccataaacatacaagttcaaatttgatttataaaattaaaaaaaaaacgaatttgactacggattacacgttctatccaaagttaaaatttgttattttttctatttatataagttaaatttgaaagcgatatatcacatattgatctactccctccgttttttaatagatgacgctgttga

SEQ ID NO: 22884 - DNA, 3882 bp, Oryza sativa
acagcatcatctattaaaaaatagaggtagtatcttactatttttttaaaaaaaatgatgatttttttagtgacaagaaaaacaaaaggacattccctggagggatgaatagagtttttattgtatctcttcttactatatagttggtacccactaagtcataattgctataaagcttgcacacagcttgccacatcatcgacgcatattagctgtcagatatccagtttgctgttggcaaaaaaaaaaagggaacaaacctctcccttgacgtctctgcccagtgggctgttggtccaagcaacagaagaaaattttttcgttcccaatggacgaaagtggcccacttgataaacacgtactccacattattttgtcggaaagaaaaacacgcaaccaatgagtaaaaaaaggaaacatgcgaagattgatcaacaatgtttctcagtaagaattctcaaatctcgctgcaacgcgcggggcatccactagtatttgtaatttgcactccacgtccaggtgtgtgcacgcctgtgcatcccctttagtaaaaaaagaaaaaagtttatcacattgcagaactacactatgcatgcggcatgccaacgaagaataatgaattagaagacaacatcaataacaatacttacagtttcaggagatgagcgtcctcgctgatgtttcctaccaaaaggaaattcatagaagaataaagaggtcgggtgtcaacctagccggttgcatcctcacaacacgagatgtgtaaagcccgattattgatgttccagcataaaacttgtaccgcacaacgctacaggtgctatttccgagaaaaataagtcgaagaatccatagcatgcatgctattagcagaatggtgaatatattattccttcgaaacacagcatgcatataaataacatgccagtacgccaccatcatcctttgttgtcatcttcactagtgaaaaatttagaaatgatatggtacgaagttaaacaagtagtctttgtagtacttaaggcagtttatgaaacaaactattgcaaactaatactcttttatttagttcatgatataacaaagcatgtaaagtgtgcagtgaacaaatttcctgttggatatgtataactggcaacaattgatattttctagtccctatgaattcatacactaatacaatagatatttgcgtatattatttttcatctattgacatcgtcaagaaacatgtgtctcgtcaaactagaatcagaagatgaatgatgtccattcaataataaggatgacaaaaaaagaggagggaaagtgaatgtttaaattgttctcaggttttagctcttaccttttggagaacattgttatcttcactaggagatgcttcccctttcaactttggtatcagccaaggagtcgatgttctttttgagtatcgtttaaccgtatcagatattgggcacaatcacacaattgcaaccacactgaagaggtcccaaaagatggaatcgtaaaagaatgaatggcaggacaactataaaatcttatcttcgattccatcggcttatgaatctgatgagatcaaaagttgacatacagtggttaaacatattggcaacattctcatgtaaacataagttttgtttctaaaggttacatttagtgcttgaaacatactccctccatccctgtccagatacatagctagaagttggttttttataggacagggggtgtgctgctgatctattggttactatctaccctcaattgtaaaatcatgcgagcgcttaactgacatatgtattcaactctacgccatgcactgtaacaaaatatggacactcatcatctctgatttgttggatgttgccacttcctactgtaaggtatatatgcacatatcctccatgtgaagaaagagctattagattctactttctctaacatcaggtagaacaaggaatccttatcgtaaaaagaatgaaagtaaaaaaaaagaacgaaagtaacagtcaaatttggattgcatggctagaatttcatgtgctaggaagaatatgtatgattgtaccagaaacttgtgtacatggcctaaaagataagctgccacatactacctccgtcccgaaataagttaatctagtacgggatgtgcatgtccagatttgtagtactagaaaatgccatatcccatactagattaacttattttgggacggatgtagtatgcttatgactcgtaagctgtttttggcatggccaaattaagattaaataaacatcaacttgggaacaaccactactggaagtttgaaataaatccatgacctcgccctgtggatatgtatcgaagaattgtggaactaatattaatatacaatcagttttctttttcttttaaagaaggttctctacaggatccaactagctacccaccaaaatatacacactagtattcaagattagtcatcaagcctcaagtaaaaaaaaaaggtaccaagcttagttgaagaaaaaagtcccctcgtactgagaatactttagtaccaactatattagctttagaaactacttctgaaacgttcttaataacatgtcccgtttctctttctcaaaaactagatttttgggcaaccttagttgaagtttttctgaatttgtaggttcaccaatgaaaacatagatgaaatttaatcttagacaagcattttttattagaataaagggttaattggtccatactattgcaaatatgcctgattggaaatctactattactattcatgataccgactgagtgccgttccgtctagttttttatcggcacccatccaagtcacccttctccatagatacttatcatttaagcgtctaaaatctgaatactataacatgcacttcagtttcatatatagcatatgaaaaaaagaataacaaatgtcatgcttaacacaatgcgatgataaaagtatgtcatgtaaacataaatctaaataaaaggtacaaactacataaccacaacctacattattctcaaatacagaaagattatacatccaaagataggagccaagtaattagaaaattgcatttgatttctaggtttcctccataaaaccaaaacaatactagcagtaggaagcctttgtggggaaggaattttaagaaaacaaaagctctcgaaaaaaaaagctagcacaactcaaacaagatcccctacatgggagtatggcatgatattagcatccaactttggaaaaagtgattatgacaaccatcgttccctctttataagaagttgaatgcctagactcaatttttccaagtccacattgaacaaagtaataacatgttccagttccacaagagatgtctggtgtgccaactgtggagcccttggttttggctcatgtcatacatgacgtgttagatccatttagaccaactatgccccttagaataacatacaacgataggttacttctggcaggtgctgagctgaaaccatctgcaactgtgcataaaccaagagtagatattggtggcaccgacctgagggtgttctacacattggtaaagcaaagacctatatgcttccatgttggaacatgttctaaatgttgataatgcaactccattacacaagaaaaaataatatactaaacttgtttcttctacttttacatatgcaaaaggtactggtggatccagatgctccaagcccaagcaacccatcactaggggagtatttgcactagtaagccatttataaatttgtcttttccagtctcagtgggatacatagacaccccgaggtcatggttgtggacatcttctgggtgggacagagttcctgtgatgcaacgtcccacctgacgtggt

SEQ ID NO: 22885 - DNA, 5009 bp, Oryza sativa
atgtcagtgaccacggccctctgaatttacgtaagaggatctcaatcccttcagtgacctagtcccccttcctctatccccccctctatctactgattgatgtccttgtttaacatatcttatgttgtgtgtaggatggtgatagatatcccaggaacaactggagtcaactgtatgcatagcatctgttagcaaatttaatttcatcgtaatcttttagattaaaaacaacaattcctaattttcttagatgtgttcattgccccataatcaacaaaagtacatattaattgttacaataaatagttcgtatcttactgaattgctatatgatagccgactttatagcaattcggtaagaaacaaaattcattgaagaagcactctatagccaatggctagtaaccatgagatatggagttcatgaatattaaaaagaaatgctaaaatgaactatcagggagaaggttagaaacaaatttaaactaaatccatgcctacaaagctacaacatgtcaacaatgctagctacttgcataggaaagcttacctaacatgtgtaacatatttgctaaatccctgcctagctaccggagctttgcagtttagcaaatatgttacattaagtcattaactttgccgcttatgtcaatagttatccccaaaaacaacataaaagatgcagccattaatgagcctaaacgtaaggaaacaagtgaaaagctaccatatggcaggaagagtactaaataattatcggaacaagttgattcttgaacccaagaacaagaagaagactatgttcaacgtgtaagtgctttattcaccacacttttttttagcttaatattgattcctagatttttggggtctaaagatgactatctacaaaaattcagaattgtgtgttgataaaatggcatacacaactccctgaaaagtcacatactaaatgagattaatatttcatattcacttcatctatcaagtttatatatattgttgaggggtagtggcatcaacacagtgttacagctaggagctacatattccctagcttaagactaaaagtataagttaaatatagctaaatcaaacacctaacatattttgtgctaggctaagcccaacttccatatagaagttcaagtttcatagggaggagacgacatgttatggaacatttaaaatagtaaaggtttaaaagctaaggttcacccaaatagacttcaaaatgatttgacaaacgaaattgggggatcctgaagaaaagacgaatctgcatactatagtagtgcatagcagttatgtcaattggaaaaaaaaaatacaaattgatttcgaatatagatgaaatatcataaaactcttgcaggtcaagacctcatgctttatgaaagaccggaactgagatatggtatccaccggatggtatttgtgttattccgacaacttggcaggggaaccgtttttgcaccagagatgcgacacaacttccattgtagaagctttgcgcaacaataccatctggacattgtggccgctacatatttcaactgccaaagggaagccggctctggtggaagaaggttcaggtccgagagttcttaatggacaattggagactatcgattgttgtatggcctttacgaagtggaatttcgaaataacatgcactatagtattgagtgcaccgtaaaaatctatttatgcaacacgataaatagctctaactaccacgacatgtacccaagaatacttatatataatgtcaaaaagaaatgtgcctttgatgatgagacggaaatttttcgattacatagaagacgcaaatgcgcgcatgagcaaacaactacacatatacatcacactcacatgcccatgtatgcgtttctaacaaacgctcaaagagatgaaggctagcggtaaatctccgatctcactaaatttctattgaaaatacacccacatgtgtgcaatatttgtaagcaacacggtttaaaccctggtgggtggaatcatgcacccatgactccaccaccacatcacatgtgcttatccagacgaaaattttcattacaaagcaattatcatagcacaagtgctataggcctcacaaagcaaatattaatggagtattggtttatttactttgatagaaaaaccactagatgcaacacaaacattctgtgcaaaaatcattgttcacaataagacaaataattttctcctctagagtgtgaacaaaaccgttgtaattgttaatacattattcacttcatccatgcatcaagaagcttgtcaaactcttggtcaatttgggtgggagcaaatcatgaatttctgtactatatgcatgaacatcaagtaataattttctagtcaaataaagacaagttatttcattcccttgggaatatggctaaccaatcagtaatttagcatacacttatttaagacattaatctaattcctaaggcttcattcgagaaagtagattggcttagctttgtcaccgcacaaggaacaagaatagcctctagcgtatgattagttaagtattaactattacaaacttgaaaatatggtttatttgattttaaaagaaacttctatatagaaagtttttgcccgaaaacacaccatctagcagttcgggaagcgtgcgcatggtaaatgaagaagttgtaaaagcgaaacgaggaaaagaacacaccctaagaatttatgtagaagcattggagaatggcccaggtgtttgagatagattaaatgagttttaattattacaaatttgaaaaatagatatattcaatattttaaagcaacttctatatagaaagttttcgcatgaaatttaccatttagcagtttgaaaagcgtgaatggaaactgaggtaaaatatgcatcttaatcagaaaagaatggggccgtcacaaggggattataacctccaaccctaggctccgttcttttccgctatgggcatgatccccgatctcttaaacgatgttgtttttgggaaataaaagtaagtttcttagaataaagttttaaaacaattagtagtattactgaaaaatgacatttatgccattcactaagtcacgtttggtaattaaacatacataatacaggctcagtaaatgagagttgagtggaaagggggtggctcaatttcatatcttaaagaagatgatgaaatcaacagaaaacgaggagcatatgttggagtgtgaacccggataacggggatctagcaggaccctcttttggagctagtcacgtgtgactaaggggctcgagcccctctagagcactagaatggattaacacaaagttgtatacaagtccggttcacccagaggtgtaatatcctactcccattgttgtgatctctctctttgtccttgaaggatcttacaagtttatcgactactcagagtagttctgcttcctttctcttcttggtttgattaaatgtgttgaagtctctcctaagccacctagcttcaaaccccatatccttccacggtcctaattctccccttataccttctctagggaataccacctgaccgcagttcgaaggaagattttgttcatatcaacattaggtacaatacgtcttgtctgctgcttctcttctcgcctgctccatcagccttggggtaggccctagaggggcacaccgtgagtggggcacggtgagagcttgccacattaacccgcccaatctatcggggacttggggccacttcaagcagggcccgttttgtgtggggtgcaacaacagctgccacacaccccgcttaatccatacaggctcgcctcgttgggtgtggggcccacttgccattgcttgttgagaggcggtaaaggtgtagttctcggtgagagcgcagtagtcaaccacgctcctccggtttcccatgtccatacaaggaccgacacggccatgctttttgcctcggggtttataaccgtccgatcatgcataaatgaggaggagttaagaacttgaagctagcccaagcacattgtttaacctctgtttgggaactggccttggggtgccttgagggttccgtccttcataatctaggatgggccacgtgccaccccccaaatcgattcctggtatgggtaacaagccgaatgagaggacacgtgcaacttcatggtgcacgtcgtctccttggggaccttggttcctcggtcaccaacaaccttactgtaaggaatacggttcctgtgagataaaatttgaagctaatagtatattcttttagtggaggagtaccagcgaggaggacaaaaaggacatgtaactatttgtcatgtttaagatgtggtgtttaacaatttactactcataatctatgacatgtgggtcctcatgtgcatatgatatgtgggtcacacctaaaagtaacaaatagttaaacatctcaaaaaaaaatccattgtaatttcggttaattcgatttgccattgcaaatatgcctttttagataactaccattacaattcgtttattcatagtcgtgccagtgaaattttacaaaattggaactgtgctactaccgtcacattttccatccatctcctcatttgaacgtgagacccactcgtcagattcatcttcttcatttcacactcccttatcttcttccttccccatctcagtgtcatggcgaggagcgtggggagagcaccttgatgatgcgggcgactaagctcttgttccaataaaggctggaggaggtggtggcggtggaggcgaaaggggaaggggaagggatgggaggaaacttggcccgttggcacaagcctgttggtcattgtctcatcctaggaggtcgagcgacgacgatggtaaagtaagtcgaggaggctaaggaggtcaagcagctggggagagctctcctaggtctccgtgaagctctcacctttgtcttccccctcccccctttgctcctcttcatgccatcgccgttgaagctaa

SEQ ID NO: 22886 - DNA, 6195 bp, Oryza sativa
tacagtacctcatcaatacttattaggtatcagacgatttctactacgtagggggtgatacatacaaggtatcagagggtacctaccaaatatcaggtgattcttactaggtattagggaccgagcaccgagacgtcatctccggtggccccaccctccacgtctcatgctggagcttgtcgccggcggccgtgtactccgtcgtccacgccccacgctagaggtcttcgtcggtggacgcgtcctccaacgtccatgcctcatgtcgaagctcgtcgctagcggccacgtctttcacattgaacaagtcctccactgtccacgcgccacaacaaagctcgtcgccggtggctatcgtgagcaggtcctccattgtccatgccacgccggagcttgtcgccgacggcttcgtcatcctcgctccacgtttatccactccggcgagagttccatcccggccatcgtagtagcccacgctcaccggctccaactccatgttcgaccactccggcaacagctccatccctgccgcagcccacgtccgtcggctccgacttggcatccgatcactcaggcgacaactccatctcggccgccgctgcagcacacgtccaccggctccccgtcaacatctccatcccaagcgctgccatggccgcgtgcagcctccgaattagtcgcctcgctcagatgtggtggagctgattgcatcccattccaagagatagaaatgagatgccgttgtatagtatttccgtaagcataagcatgagcgaaaagatgggacgattaggtggaatgcaagtcagcccacttaacactccaatactacagaaaacatttgtagcgcttaactgctcgtacacttaagttacattgatgagattttcttattatagtatcctttggtgtcttcacactaagataggatagcttatcattttgtttgtacttattataagcaaaacagtttgttgacgattcaaatatagtttatgagtaaacttttatatacgtgttatggcgatttataaataaatattcaaagaaaatgtcgacgggctatacctgtaaacgctatttgtagagtatggagatcgttagaactagggtatatgcgagatcggatctaaggaacaatggacaaggatttatattggttcgagccttcaagttaagtaataactctactcctatttgtatgtatgtatgtatatatggatagtaataccacacagattacaatagggaataggacgactaaactaatatgccaactagaacttgttgagaacggctcgacaaaatctatctggtgaatatagcggattgcttctatatgtggctttggctatgagttgtaactcgatgtccctttctggacgggtgaggtcatttatatgtaatagagatcacgttcttctccaaataagactcggagaaatgaaacatgacatgggcttaaggagaccttatcactcccaagtaggactctgacaccatctattacgagaagataattttcttttttttatctaccatatttccttaattaaaagatacattcttgtatactatcgggtatatggtattgctgtatttaacgaaccagtgtataagaagtatgccttattgttgacactaacaaaactgcaagaaaaaaaagcataaatcaaaatttaaattttaaaatctaaacttgtacttatgcttataagttgaaggctaaccgaaacaagcgaaaaacactataaactgtaataataccttaattatcataaattctgctttacattgatcattttggacatcgagtcattgatacagtctctgcacatattttattattgtattttctaactatatgtttataaaagaactattagaaatataattatataaagtgtttatcatgacaaaaactatcactatcgttttcttatatgaattctaaatatatatataagacgacaaaaatcgtgaaacggagcaagtaaaaacattgttaactgaacgtgagtacatttttacttgtggaaagttacaaaattccacattccaggagtgggggtacgcaagagaaaggtgaagagtaaagacaaagcttgccctggaggaaggggaacaccacgaggagtcgaggccacaatgccacatggatacatgattcccttggatctgagcacaccgcccccaagtcaggtaaaagggacagagagcccacatgctgagctacccagcttctactcagccaacaaacaaccagaaaaatggtccttgtccctactccttaagatctccctcaagaccaactccatgacaaagcaaatggcataaaagaaaacgaatagcactgaaagtaatgtcgcccattgcttcctgctagtactgtaccaaacaattactccctccgtcaaaaaaaaaagacaaaccttgatttccgtgtctaacgtttgactgttcatcttatttaaaaaaattataaaaaaaataaaaaaataagttacgcataaagtattaatcatgttttattatctaacaacaacggaaatactaattataaaaaaaatttcatataagacggacagtcaaacgttggcacgggaacccacggtttgcctttttttgggacggagggagtagctattgaattattatagggtgtatttagttcacgccaaaattgaaaatttagttgaaattggaacgatgcgatggaaaagttgaaagtttatgtgtgtagagaagttttgatgtgatggaaaagttgaaagtttgaagaaaaaatttggaactaaactcggccataaccaggtgacaaatgagtcatacacctaggccctgtttagttcacaccaaacttcccccaaacttccaactttccatcacatcacatcacattcaaaatattcctacacacaactctcaacttgttttccaaactactaactttccccaaacttttttccaatttcaaaaactaaacgcagttgtactgtctctcgtgctatctctctctccccaaactactccattaatcatggcgtggatgcaggcacacagcataaaaagttggctaaacagggaccatttctgctcgccaacatgcgagctttgacattaactccaggctcgggccatgagagggatatgtcctcgtttttattttaaggtttggtattgtgattcatggaatcatggtggttatagtaccattctggggctaggccgctagggcagtgaattgaattcactgaattaacttccatgtctgcattctggattgcttggacacgtttggctgcatcgcgttggaaagtacatatttgatctcatctctggaagagccagaaattatatattctgtcatgtgcacttgtgcagcatgcactactccgtacacactttacacagtgcacaagctaacaaactcctcgttgattgagaccaagaagctgtagaaaataccgttggggcgttgggcgattaaaactatgtcagagctcgggatattatagggggtagcagtcgagtcacgtttactcgactcgtaactaaattcttctgtactactttgtgactgtatatgatatattgtgatgactgtatatgatatattgtgatgtagtactacgaatctaacatatgtatgttcatatttatattattagaatacgttatatttaatactatattagttttttttatgaaagagagcactctttttcagcctccttgcattggcaaatggccgacaaatttctagaagtgactgttgaaaggacgctgcaggtcttttgtgatttatgggtttaaggctggatttacttttgccaaagtgaaaatccaagtaggaaagtggtttgtgcctgaaggttcctttcttcggatccactctttgcagagttaaccacttcacctagtactccaactgtccacttggtcgtcgattctgttaccgtcgagtttcctttctgcatgtaaaatatcagaaatatcgtggcggtggaaccatgcatctacctgttgacctagtagtaaaaacggccataaccagggttagtacctatgtgtcaagtcttcagagcgagtacaatagcaaactatataagtcaactgtaagcacatgtggagaagagaagagagaaaaggaaagcggattacagatttataaccagctgcagcacgaactccaatacgttatgtgtgtatgagatgtgggaccatatattaatagtctattatataaatgagctattagattgattatagatgaattggagctaatagttggctatactcgtaacgcaaaaagatcctgagctacaacgaaccagttagggtgtgtttagttggagaaaaggaaatttttgggtgtcacatcagacgtttgaccggatgtcgaaagaggatttcggacacgaatgaaaaaactaatttcagaactcacctggaaaccgcgagacgaatcttttgagactaattaagccgtcattagcacatgtgggttactgtagcacttatggctaatcacggactaattaggcttaaaagattcgtctcgcgatttcccctataactgtgcaattagtttttctttttatctatatttaatgctttatatatatatccaaagatatgatgtgatgtttttgggaaaaaattttgggaactaaacgggcccttactgaaccgtaacttgccacttggtagggttaggccatgagcccatgacgagaggtaataaaggcttaaagctgcagaatctaggttggttggagtagtaaaaaagattcaaccgaggccaacgagatttcaactcccgcgtgataatcgaaaatgctattggtaccaacttgagataacctatactagtgtggtactgtggtggagtgatgttgtacagtacggagcgaatagacacggtggtgtggcatcgccggactatgaccagcgtgtcgtgaaccgcgagcgggatcccacatggacaacaaaggtcggatggggctaaaattttttactccctgtcacatcggatatatagatactaatttaaagtattaaatataaactaataaaaactaatttcataaattagctaatccactagacgaattttttaagtataattaattcataattagtaaatgtttactgtagcattacataggctaatcatagattagttaggctcggattaattaggctcaataaattcgtctcgcgaattagttcaaggtcatggaatgagttttataattaatctatgtttaatactatcaaatagcgtctaaacttccgatataatatgtactaaaatttagtctctgcaaagcaaacagggatcgatttcattggtagagtacgaagagattgagtagcgtgactccatggaggaaattgttagggaaagttcagttccgatcctaaagtcacgttccagcggtatcatctcggtacttacctactacaaacagaggtcgtgtcggtagaagccacacgcttagattaaggtctagtgtcagatccggacttggcgaagcaaaccccagacccacaatcccaggagtggcaagcggaacatgcatacaaccacccctttgtccaacaccaacgccaccgacaatttccgtcttgacttgaggctttgcgactcgacgagtgattggtggatcggtggcgtaatcgcggcttagactgcggatcagcggatgacagtctctccctaccccacaggccactcgcccactcgccgacacgcgctcgtgatgttgctatgctgcgtagtgtccgcgaactccgtgggcctccggctctctccgagtcgtcgggtgaaacgggccgccggcacgcgccacgcggccttcttctactacatggacgcgactgtttcggcgtgggaaagaaaaagtgtcgcggcgagccgccgaggcatcgcggctgcgctccgcagtcgcaagcggccaagcgcaacgacggcgacacggcgtggcgcgcggagcggtgcgggcagcggcggccccgtgcggcaggcagcaaatgcgacgcgagagatcgcacgattcccttcccggggaaaatatgtagtgcaaaccacgtatgtaatggaaacttggaaactaccattggatcgagaaatggacgtccgaaattcgtccacgtcaccataaattaaaatacaactcatagtgatgt

SEQ ID NO: 22887 - DNA, 2438 bp, Oryza sativa
actatgttgcactcatattgggatggagggagtacatgaagttgtggagatcgtaagctatcatgagcaagaaaaacagatcctagatcaacaacaacatcaagtggagaaaggtacttcggttccaggtgtcgcttttttcagcctctcgcatcacccctgcacaggcgatgcggggggggcatcccgaacccaccaccaccaaactctctccttctccgcctcgccaccgccaaagtgaatcgtcggaaaccgcacgacgagcaaggatggcagcggcgggggctcgggctgcctcctagctctagcatggggagcagatggtgcaaggtggggatggagatggcgcggcagtgacgggacgagcgcaatggtggcacaacagcttcccagctgagctcgactatcggagtgggctgagtcaacgaccggagcggaggtggtgcaagggggacgtgtcaaaaaaacacgaggcgagacggttgaagcctagatgcggctaggtccacctcccctgcgaccaaatccaactcccccacgatcggatccggcgccatggcggtgaatttacctaggtggagcaggggagcaggcatggaaagggcgcgatggcacatagaagcattccaggcatcgtccccatgaaggcgaggcctgatacggcacccgggtggcatttccgcaggggagcgggcatggagagtgcatggtggcacgtggaggcggagccaaaatctggtgccctgacggcgcttctgtctgggtggagcaggggagcggcgcggcaagggtgtggcgacaccacaacctagcgccgcccctgtggaggcggaatgaggaggatgttgaggtaggatgcaaggtggcagatgtacatccgtggatgtgttgttgctggagaggcaacgcggaatgttgttgtgacctcaaccgataccgtccagatgctcggggatggacatttacccctaagatggaggcttgcaacgacgtcagcgcgatggtgtggcactgacgcatggaggcaggcggaggctggtcgactactagtatcggtgtagtggtgtccacgcatttacgatgggtggttggtggtggagctttagagtggcaattgcagaatgggagtgaaaggtagacaaaaatctaggccagtttgacgggccaacaacggcggcgccttcgggcatcgttcttccttgttgaagcttgtctctccttccctggtagggctgttggtgaaaaccttatctagtctccttgagaaaaaccttgtctagtctccttgagacctggacaaatggcggcaacgctctttgtcgcgcttcctcctggagacgtcatgtaggaggctccattattgccaatccgttgttagacagtctgtttgaagctcttggatgacgacaggtccgtacgagagagagggatctttcttctctctcgccctctccatttactaccttttgccctagtgacgttgttgaggctaggtgttcagctatctggagtcgactctgggcactacagttgtagctcttttgttggtttagagacgaccggtcatgcttagcagcggttggtctaatgctggtcccttcctcggttgtgtgtttaggtgccatcggtgcatggtggtggcgtgtttgtttttctttttattgactttagcctttcagggttttagtattgtattttttttcctcctctcctcagtgaaaaattgcgctattgtgttattcgtttaagaaaaaaatagctcctagcatgttgatcgattcaagagcagtaataataagttagtcggccaaaagtccaaagagtgaaagccaggtcgtagtttatttcatttttgtgagtccaatgtgcaatttgtctgtaaactcgatcgataagaactagagcctagagttggctacagaaaactgatctactagctgatagagacactactagaaaaaaaaaacatttatacaggtggccatatcctccacttgcatctaaacgcttgcgaaaatcaatgatttttgcaggcagctaaatccacctgcctgcgaaaatatttttcagtgcaaaaaaaattggcagccccccacccctatcctccgcgcgctatcacgagctgtgccaccacgagctcatgcgtcggcccgctactgccgccgacctcctgcctccacaccgccgccgctgctacatgcaagtcgccgccgccggccctccccatgacgtagctggatccaggaggagaggggaggggagggaagtcgccgtccgaatctgggagtgggagcgccgccaccgcctacgatgacctcctgcctccacgccgcctcagccactgcatgcggtcgctgccggcccaccttccccacgacgcagccggatccgcgaggggagaggagcgccgccgaccttccgcctccgccgctacatgc

SEQ ID NO: 22888 - DNA, 2881 bp, Oryza sativa
ttatatttcacgccaattttcgtaggcggacgcataaaagatctgcctgcgaaaataaattttcataggcggacggtgagattcatcccggtttacatttttgtagacggtcatttggctccgagggtcatacctttctgaaaacataaaaggtcaacgttgctaaaaaatcgtttttctaatagtgagatggaccaattaaaagttcaatcttcggaaagaaaaaaaaaacaacgaagaaaagtgctcctaaaatataagttctttctccctaccaaatcaatttgacattattatggtactagtagttctcctaccactatatgtatgttccttcccttccgtagtaaatattaaatcagcactggaatcatcctcgtttctatcagctttgcctcatcgaaaggaacttatgatttgtttatcgaaaaagtgagtaggcatgtagtatcaatctacacctgcaaacacacaatttcttccttggccgagtagatcagagcggtggttaggcgacaaacctcgtcgcatcattgtcctactcactccggattgtttatgaattggttttcatcactttatctgcatctggtggcgatacatcggacgagctaatccgaaggagcagggaaagggctccccgtgtgttggcgttgctatccgaaggtagaggtgacatcgtcgtcgaccctactactcgcgtcccattggcctggccgttgctgctctgtgtatggaaaactatatctttcttccattatcatttattatttgtcggcagaaccaactagggttcttgattcctccttccattttctaccgcaaaaacaaatttcacgtgagacagtacaaaattcctcttaaatccttgtatattctcgtaggaacgtaactctatgctagcggcggtgatgaatcatttgccggtacattgtacacgctacggcaggcattgtttttttttttctgttaaggaacttatcctagtcgatctcctacgtgccacggcatctactggtcatgtcattggcaatcattgtttagttgctgattagaattgcaatcatatgttcctgacaagttgtactgttgtacaagaatctgtgatggaaaccatgtgtgcatcgtctacgcgtgccgtctcgcccatagcgaatcccaaaccgatcgttttttttttcaggaagattgtaaaccgatctctcacatgtttgtaattataatcgcattcaatatgttgtgtactccgtacttgtgtatagctcgtattatagaccgggagatctctggtttaatcagtgccagcgaagtcatgacaagtaagaaaaaaagaggggggagagtcacataccgagtacgactcgccaattatcagttcatagttttatatgaaattaagaaaacaaagaaacgttacaattggcatcctaaacagaatacaacttgatagtattaatttaaaatttattaaattatatgcaatatctataaatgagactccaaattgatttttgttaattttggatttcagactaattaaaacatgaaaaatgtcgacgtttgaggtcacgactacggtatttccatggtatggagatcgtcagtaccagggtatatacgagattgaagtaaaacagatggagacaagaatttttacacaggttcgggccccttatctggcaggtaatagccctactcctgttgaccaaagccagtgttgctcttattcatctgaatcacacaagtacagtgtttgggataacctatctagctgtcatcgacttggcggtatagataaccaacacgtagtcgataacagggtagtcttcctcctcgagtgcgaacttatcgagatcagagatggtgctagatccctcttgccggcctccgcatgcatcatattaggtctgtctaggcttatatctgatgtcgatgtttggcggcgtgtgttggtgtctattctgacttgtgtgttgatttatcctcctagggggctggtatttatacccatagatgtcaccttgtccaagtagaactagggagaccgatatggatacaatcctaatagtatttgtcgtttctatatagaactctacttgtccttccttattcagaacttcttctatatacgaggtatgattttgtataagacttggtatatggtgggtctctccgagcttaatcgattactattgggtatgtggcacccataaccatgataaaaaaaatcatcaataaaactcaaaacctagtacaactcaatatattactccctccgtttcacaatataagtcattctagcattttccacattcatattaatgaatatatatattcattaacatcaatatgaatatggggaatactataataacttacattgtgaaacggaggaagtagttatgaattcttgaattattaaatcctgaaatgcgctaaggattacgtaatttggatggaagcaaagtagatcgatttgcacataaagataagatcacaaatattttttaaaaaaatctatcggacctaatggacacatctccaattgtcaaaaagcgtagcaaaaagaatctaataaagacaagcaagcacattccctaaaggttgaatggaacatatttggcctcatcttttcgcttatgtatatttatcaactaaaatttaaattttcaaccttaaatttgaaaccttaaatttgaagttgttttggggttttttttcatcgtagtttatttttcagcctttgattttagatcgtttagaacacatgtagtataaaatttttatttataaattattttttatttgtaaatatgccgtttggcttagtttaaaaaacaaccaaacgatggggctgattgatccttactttcttgggaga

SEQ ID NO: 22889 - DNA, 742 bp, Oryza sativa
agctccttctactactccaccactgaccactccactccacagctccactccaccttctagaacaatctcagaggctctcccactccgcatagtcttcccatagcaaccccaagaccatcgcacaagcgcaaccgagccgtgccggaaacaatggcggtgggcaacggcctgatcctgtaccacatcctcgggctggcctcctgcatcgcgctggtctacttctccctcggcgaggtggacctccgcgacgccctgccatccctcccgttctcgggcggcgcctcgcgcgcggcggcggcgtccctgcccttcgtggagcggcgcggcaagcgcctcttcctggacggccggcccttctacatcaacgggtggaactcgtactggctcatggacctcgccgtggagccgaacacccgcccccgcgtgtccagcatgttccgcaccgccgtctccatgggcctcaccgtgtgccgcacctgggccttcaacgacggctcctacaacgccctccagctctcccccggccacttcgacgagcgcgtcttcaaggtaaccaaaaccaaacccatccattcccaaattccccagcagtaagaacgcgagatgcccactggtgcggatgctgatgcgcgcgcgcgtgcaggcgctggaccgggtggtggcggaggcgtcggagcacggcgtgcggctgatcctgagcctggcgaacaacctggacgcgtacggcgggaagcggcagtac

SEQ ID NO: 22890 - DNA, 936 bp, Oryza sativa
cgccagtctggacgagaagctcaagttcatgacgcggtggatcaccgcccacgtggaggacggcgacggggagctggagaagcccgtgctggtgacggagttcgggctgtcgcaccaggtggagggcttcgaagacgcgcaccgggacgtcctgtacagggcggtgtacgacatcgtccacggctcggccaggcggggcggcgccgccggcggcgcactcgtgtggcagctcgccgccgagggcatggaggagtaccacgacggcttctccatcgtacccagcgagaggccgtccatgatgcggctgatcaaggagcagtcgtgccggctcgccgcggtgaggtacggcgaggagggggccaggaaggtcctcaagacggtgtgcgcctgatcgttctgatcgtttcttttttttaaaaaaaaaaatcacgtcctagcttcttgtcctcttgaagaaaagaagaagaaaaatccagcgacgaaatgcgcaggagaaaatcagtgcgaaatcgcacgaaatagagtgtaatcaatgtgcgtgcacatctgcgtggcaaggttttgcgcagatcggcgccgacgtttgcagatccgccgacacggcccagtgggttttttttttttttttttttttttttttttttttttttttgccttctgtcttttgtgtgtgttgtacgtgcccttgacctttgatatgttaaatcattgtcgagtggcaggggaatccagttatatatagtcatcggacagtgtatttctgcgcgggaggtttttatatagctgcctgtaagcataataaaaagaggcaaatacaacacttaaatgtgatcaggtaaagcattactaaatcgattgatattgagatgattttaattgcgtcgccctggtccaaactttcaaagacggatgtcagattttgcaatatgactaggc

SEQ ID NO: 22891 - DNA, 26486 bp, Oryza sativa
ttgggtttgtaatagtattatcgctgaatttgtaaccttacatatgtatttatgtgacaaatttaatgctaaactagaaaaaatgcccgtgcgttgcaacgggtgaatgctattttaatcttattattgttatacggtttagttaggataaaatttattttagaaattcacttgatattttttttagaaaatcatgatatgcaattaggagtctgattttcatctcaagttagcacgtgagtttttttaaaaatatttcttataagactcttttgtattttccaaaacaaacgaacttaaaatccgactcaaacacggatctgtatttccaaaagcaaataaatttaaaactgactcaaatacagatgatgtactaaaatgccggaaaaaaacatctccaatttttttaatattagagataggtagtttccagtcattagcctttcggcttataagctgctaaaaaaatttaaatattaaagtcttaattttagagttaattcgacggttttttaactgtagtttatattccagcattgtcttaaaccgtaaataatacaaatataaaagttttatttatgaattattattttttcttatatgacattttatgagttatcagtcgcagaccaaatgatttgtttcatggttttgtgatattatggatctaaatatattgttttatgataattttattaaaatatagttacgtagtttctaaaatttactcaattttttttcgatccatgcaaagatcttcggcatttttataagaaacggccgtgtttggtggtgggtgttgggaacccatcacccacgcacggaaaatagagcggtccattagtgcgtgattaattaagtattaactatttttttaaaaaaatagattaatatgattttttagcaactttcgtatataaactttttataaaataacacaaaagacagaggggagctgggaactcctgtatcgaacacatacacagccctagtagatgtgagggctgaggctctactccttgggaaaagtaacagggagtgtcgggcggaaatttgagtgaaaaaaaaaatacatgagtgacatgtagcaaaaaccaaaatgataaatcgaaggcccatgtgggtcttgatctatgaaggccggaaatgacagcccaacccactggagcaacataatgtgtcgtccccttgggccaattccataccctcatgtaagcccattcactatccttccaggctttccagcccaccgctccaccgatctcgtcctcccttttgcggcttgcgaatgtcaacacactgttttcccagtgccccggcggccagatctcctcatgccactcgtgctcttgcgcgacgcctccccgtcccgactccagaggaccaggttctcctggaagcagatgcgcggcgcggttcacccgccgagccggacgtcgtcgtcgcctccgaggagatcagctctgatcacctccgtcccggcggttcttgctctggccttcctcctgatccttgccgccggcgtattcctctactccggcaccaccaccacgccgtcccgggccgtcacctccgctggccgcgtaaacgaagcacgtggcgggggccatgctctgctgtccccgacggtggggtccataggtggtgcgcgcgccatctgggagctccccgcggcgccggccagggcggtcctcttcgtcgcccacgggtgccactgccgcccggagaacttctggccgccgtccccgcgctgccccgggtgcgtcggcctgccggaggacgtcgccatcacggaacgcgcgctacggaggcggttcgcggtgctggccctggcgagcgcgagggagtgctggtcgatggggaaggaggtgagcgccgcgaaacgtgggatccggtcctgggccaccgagaacggcctcgcggaccttccggtggccgccctcggcgcgtcctccggcgggtacttcgtctccaggctcgcggccgagatgaagctcgccgccgtcgtgcttatgatcgccgagggctccttcgggccgggcggcgcgccggccggataccctcccgccatgttcctccacatgccaaaggaccagcggagggcggcattggtggagaggaattccaagatgctgcggagcaatggcgttgaggtgaatgagctccggagcctggagctccctctaaccccgacgatgctgtccgacaggatcccggggctgaaccggggattgtccgagaggatctggagggtgttcacggaggatggattcgtcgatgagagagggttcatgaggaaggatggccgcgcaacgccatggaaggatgcagtggtgaagaggggattctgggaggaggtggctgggtgggctgatcacatccaggaagagcttaatcttgcatatggataccatgagatgacgagcttgcacactgatgaaatgttcgattggattgaggagcacctgagctgaggtttatggttgattactcctaaccctttcgtgattctctaactaaatatgaaaactgtactaattggaggatccgagaagatgctgcaatcttcagcttgaggaatttctgtaaaatgaattaggagagaaaaggtgggacgatattgtttgtgaaaaatagacttgatgttaactgctgtatatttctttcggttggctcttctgcaaatggactataagaagcataaacacagacacggaggtactgtagtttagtaaggttttgctctgatctgtaatggagtagtatagtatcagttctatgtgtatctagataaatcttttgatgaatattgttgcattcttgtctctgaacagtcgcactttggtgctgaagccacggtttaattgctagatagcagatgaaatagaaagagaattgttattttcaacattgcattgtccccttgttctgttgttcgtataattgcagataaaacaggcgttcattttgcctgtatagaacttttcattcccttgtccgtaatgtaaacatttggcgcctcccaccgtgcaaacatcaaatgtctaatgcattatcttttggttagcttcatccccttcatgtatcagacatgaaattttcgtttgtctggtcagctgttcacctagccaaaaaattctggattggccttccagatttgcagttagagactcaagagtgcaacatgttgttcactaatgttttgttatccagtattgacaatggttggggtaggcatatgaaattctgaatgtgaccaatctggtgagcatcagtcatcagatggcaaactgtatacggctagacaatgccaggcatatctggcgcatctcaaattgtccatatgagttcgatttctggacttgtgattctatttctgcaatctgcactcgtgtttcaggctttcagctcgacgacttcactctatcctcaaggccttcgactgaaaatgaacctgctagctcttgatgcgtatttgtcccttcagtgaatcagtgccgctggcacaattgcacgccgctggcacaattgcacgcttgcacctctcagttcgtttcctgcttagttcttcagttcttcaccctccagccaaattaacgacaaactttaacaagcgagcatgttaatgtctaccttgtccaaattttcatctatacaaactgataacgaagaaaaatatacaactcaataaatatcgtctggttttctactttgtacgattcaccacgttgcccaacctgatgtgtgcacgtcagaattggtagcagccaatacagataggggagagaggaattcccttcctcggattcttggcgcgcatgacgtcgtagacccggagaagattgagctctgcagcaacaacccaaacacacaaagcggtgcgcttccacttccacagcgggctcatgcggagtcatagcagagccattctcgggagcctccacctgtgccctcccgcggtcagcaaccgtatcgctacctccccgcgctatatatgctacctccccgccatacgcatactcccatctcggtgcaccttaattgctctctcttccgtagcgtatctgatcgatcgatcgaccaaggtggtgaccatggaggcttccaggaggtggccatatgcagcttggtttatggccgttctgggtttggtcgccgtgttttcatcgtcggaggcgtacgtcttctacgccggcggccgcgacggctgggtcgtcgaccccgccgagagcttcaactactgggccgagcgcaaccggttccaggtgaacgacaccattggtacgtgtatcatctcgatcatcccctcatcgatgtataactacgtgtttttttttttggtttaatcgttcaagtgtacgtgcggcgcgtttcttggctcgcagtgttcttgcacgacgacgaggttggcggctccgtgctgcaggtgacggagggggatttcgacacgtgcagcacgggcaacccggtccagcggctcgaggacgtcgccgccggccgctcggtgttccggttcgacaggtccggccctttcttcttcatcagcggtgacgaggaccggtgccagaaggggcagaagctgtacatcatcgtgatggcggtgcgcccgacgaagccgtccgaggcgccggagccggccggggcggccgggcctgtctcttccaagtcgtggtcctggcaggcgttcccgccagccggtgctaccaccccgccgccgctgccgccgtcctggggctcggcgcctgagcacgcgcaggctccgggcaagagctcgctgggtggttctggcggcggggaaatgtcgcgcagcagctcgcttggcgcgccaccgccgacgtccggcgcggcagggttggccggcgtggttgccagtgttgtggttggggttttaggggctttgttgatgttctgaaatgttgtacactgccacactaggactgggcaggacgccaggacgttctacctccatggcgatcatacaggtcacagtggtcagcgagttagtcatagttagtttggtagttaaattagtataagacttaaaactgatgcacaaaataaagagaacgctgttacacgtacatgtatggataatgaaggcacatgctcgactataagtaccattggccttcatggttcaacgagatgcataattttgtacaatattttcttcggatattgccctgtttggatccaggtaacatcagatatttagacactaattagaagtattaaacgtagactaataacaaaaccaattcaataagcctggactaattcgcgagacgaatctattgaacctaattagaccatgattagcgtatgtgatgctacagtaaacatgtattaattataggttaattaagcttaaaaaaattgtctcatgaattaactcttatttatataattagttttattattagtctatgtttaatacttttaattagtgtataaacatcctatcattcatcccaaagtgctcagtacatctggagtgacttcaattgggccattctaatagtggcccaagctgggcctatagaagttctgggccggactgctcggtgtggcgtcgcgtcctggcagtcgagacgggagcgcgtctggaatctgcggaatcgccgggagggcgcgcggtgccgctgccgccgaagccgcggtgaggtcagtgccccgctctccccctcctcctatagtcctattccagcgtcccgtgctccgtgcccccgtcgccgtcatctccacacggctccggctcggggcgcgcggttgcgcccgacgaggcgtcgaccgttgctgccgtccgccatgcggcccccgatcgaggagggggtaacaggtaactatttcccctggctcgttgcccattgatttcgtcgacggccgctgtctcgttgcccactgatctcctccggcgtgccgccgttctcctgccgcacgcgccgccactcgcaagtgctccacctgccggccaagccaagctgtagctccgctctttgcccagctttgttttccttccatctcccactcgcggagaccctattggggatcttcatatcagcgatacaaaataactcatcgtctattcgtctctaccaatcctgccgctcgtgctctattgttttccatgatttaaaaggcctgttttgcaatggtggactggtggtactagcctgctagtttctagttccgaagatctagggtttcatgtgcacaatgctgcattgtagttgctccctcctcctttttttttccctgtggtgcgaatttacagcatggagtacaatgttggcgtgatgaatcaaactcggaccagtcagatgaatccattttggatcagtcagatgaatcagacttcacctctgactctgatgatttttgtgcacttatggtcaggataaaatatcaagacattcattatcacaaatcagaacgatcgatcatactgatgatcatactgatggaagtgcttttgatagtgagcctaacacagaaaatttgaatcttgtatttatggcgatagagctagagcaagacatggtgctagcaatggcaaatgacaagttgagcgtttggattacaaaaaactgtatgatgtatgtatccttatcctgattcttctatatagtgaattggttttcttttatcaatggttggttagttggttagtttatgtaggaaataaatgtaatcgataaggaaagacatatcaagtaacaattagagggacaaatatatggctcataatactacatgtacaactcacatagcttagttaaataaacttagctgataagccatgcagcatcttgtagtatggttgctgccttgttgtgcacaatgcattgcaaccaagtggttagtatttcagattttcagttatgttaacctgctgataatatacttcgctgtattaatggtgttaaacaagagattatgtgcacgtgtggatgtgtatttacccatgcatatcattggaattatataaaacactcactttgctctctttttaaaatagcatatcccttgctattgattaagcacccaacatgtcgtgcctttgatgcactctcctagtttcctttggattcactgcagtgagcagccgagctccaccttagtcgcatgttcatactgttagagcttcactgcaggccagttggaaccagtaccagcattctcggtggcccgtcataccctaactgagaataaggacaggcctaaatttcacaataagcattgatgaaccaaatcctaatttatttcttctcattttgtttttctctcctgtgtttcttttctagttgtagccagagcataagacaacacttccaatgaaagagtatttcttgattccaggctggtgatgctgttttgtactaatgtttgccaatctttatggaggctttaaacctgtagctctttaacgagatttgcaattagtaatgttcaaactgatgcattcttgaataagaaaatcgttggaatccattgcatatatgattggatattactaacttccattccatttatttcatattttcatgtgggaatctacaggaggcttatggaaaagcatcatctgattcaagtgatgatgaagagtggtagtacacatcaaaagggaaatttagaagacaatgtgctgaatcacctcagcatggaaaatgattctctagaagagcaccagttaggcaccagaataatgaacataccccactgaatgtaaggctttgtgattcagtaagtgagcaacaaactgaagtgctttgctccaatagcaatggtagcatagccagaaataaacactttggtcctgcaattaatcaagtataaaaaattaagtgtctacttatgttagtcaatctgaacttccccacaaccaccacattttaacaattaaaccaactatcctctccagctaacaaataagctcttctttgggaaatgcacgatccaactttatgattctaacttttgatatctctttggatattaggttggacatgcataatctaaagtgtagatttgtctcgaaagtacttttggatatttttatcatgctttataaacacattgtacaaagaaactagctgaattccttgtgcgttacgtgggactaaattaaagttccatctttacttcgaattattggtatgcagataattgacttcataatttgcatgggaatcaaatcgcttatttattttattttttgttctgaattttcagttatcttgtattatatttagtgtgaactcttctaatatattttagtccgaatttaagatatttatgagttgtattttacatgaattagttgttttaatctagagtattataatctggacccataccattctcaacattaaagattttgtttttctttttctccaatgaccttgtaatatctaggccttgattctcaaattgttttaataaaatatataatagattgaaagtcaaagttgagttttggacagtgttaatgcccaaaccatcccttattcgtcactggagagtatattgcttacattactaaattatttcatggacaaccaatttttcttgtaggactgaaggtatatttcaaggaagatccgtaccctagttgtgcaacaaataaaaatcttgcacaaagagctaggcctcacattcaatcaggttctaaactgtgatctttgttcttcctcccatgagcacttttgcggggctgtcactgtatttctcctcctgaatagagtttctgttgacaggttagtaaatggttttctagtactttgtcattaatcaagagtagcagccaccaaaaaaagagaacaacattgaaaaccatacagctgagaataataataccaatactgttgatagcatagaggatcgaatgaaatggtgatggaaaaagtaagtgtagatagaaatgaaatgatctctgaggaaaggatggaacacaaacacacaataatctcattgaaggtattccagtaagacaagataccaactgtgggcagaatgtggttgtgaattctaatgtggtcaaccaagattgctctattgtctccaaagaaatcgacttgctaaaatgcggtactagagaaaaccagggcaagtaatgctggaacaccagaagttgagtccacagagagaatgatccctagactagaacatgcagatgaggctacgcgaaaggcagtacagtgggagctgagaaagatgaagacgacgggtgaaactccctagtgttcggattatttgaggactctcttattcaggtcaagttttggatgctgcctgtatcgcttaatgtcatagtaacatgctcatacgtcataatgggttaggcccatataattaggaatggactagatgggtattgagtaacattggatctggtggttacgtaaatagagtggatgcgctgcacgcggttggggatgggtgaaaggagacatgtgaggtggcgtccagtctggaaggacgagggtgggccaattagttgcgtcgaagcaaagattttttttttgttcgtatttatagtcacagaagcctggttactgttgctgttatgtttgttccatttggagccttggctgttcatccagagtttctgattggataactcttggaaattcatgctgccatactccggttacaggaatggttaatcgactgtaaaagtgttgacatagtctgtagcagacagtagatgtgttgtttgccgtgccctgtaacataggagtattgaattaagagtgccaagtgaactgatgagaagtatttgtgactgaaatctatacctctgttttttcacctccaactgtagtaagccatttcatttcgcccatcgccagaatgtttggatgatgttatctagcaactgcagtttgcaactgacgaatctgcttaatgctgcatcgttaactggtgagtgctgtgtgtgaactttaaccctaaagtaagctttctaaagaaatccctaagctatgttagttatgaactacttgtggtgttgtttttagtatcttatttatagatgaactgctaaatatagttccaaagagagatcaaaacaaaaggctgtccttgtaaaaaaataaaaaggcttttatagatggctgggccggaaatctcaatggtaggccagtttctctcttcccatgtgtgtgtacagaactatagataggaccatctggaaacggctcccagccagccgcggagccgcttctactcccacgcctctccgcgtttcaaattcaaaatccaaaggggacagcgccactcgcaccacccatcccccatggcggccaacgcgttctcgtcgccggcgacggggaggacaccgaaccctaaggtggcgccgtccccttccaccagacgggccgcagactccgccgcggcggcggccgccgccgccgccgcggcgtcggactcaaaggcgcggttcgaggcgtacaaccggctgcaagcggcggcggtggcgttcggcgagaagctcccgatcccggagattgtggccatcggcggccagtcggacgggaagagctccctcctggaggccctcctcggcttccgcttcaacgtccgggaggtcgagatgggaacccgccgccccctcgtcctccagatggtccacgaccccaccgccctcgatccacggtgccgcttccaggtgcgcgtcccgcttcttcccctagggttcgcaaccctcctcgcctctctctctctctctctctctctctctctctctcggatcaagcctagccgagccaacggctcatcagccctgtgtttgtgcggcgcgtttcaggaggaggactcggaggagtacgggagtcccatggttctagccacggccatcgccgacctcatcaagcagcggactgaagcgcacctcaggaagatccaggccgcagtctcgcccaagcccatcgtcatgagggccgagtacgcctactgccccaacctcaccatcattgacactccaggtttcgtgcttaaggtaagtacaggtgaaattaggacttctcacaccttagtgaatatggttgcttgttaaattgagacttggcgtacctctatggagaagattgcttgttagattgtgacttctcatacctgaatgaagaagattgcgttggttgctctgtcagttatgttcttagttgatagaattgttgtgttatttttgtaggctaagaaaggtgagccagagagtactccagaagagatcctgtcaatggtgaagtcgctggcgagcccacctcatcgcctccttctgttcctccagcaaagcagcgttgagtggtgctcatcactctggttggatgccatcagagatattgatcccactttcaggcgcacgatgatcgtcatctccaagtttgataaccgcctcaaggtattccttcagaacaatcaacatgtgtacatagggtttgattacgtcttctctgtgagctatgatttgtactggtgttgtggcttatgaaaatgcctctgtcttgaccaattgaaggaatttaccgaaagttgggaagtcgatagctacttaagcgcaagtggctaccttggggataatatacacccgttcttcgtggctcttccaaaggatcgtggaacaatctccaatgaagagttccggaggcaaatttgccaggttgatatcgatgtgttgcgtcacttgagagacaatgttaagggtggcttcaatgaagagaaatatggaccatacattgggttcagttgtctcaagaagtacctggaatctgaacttcagaagaggtacaaagaagcagctccagccaccctggcattgttagagcagagatgtagtgaagtctcaatggacctatccagattggactccaaactgcaagctacatctgatgtctctcagctgagaagatcagcgatgcttcatgctgctaatatctgcacgcatttggtatgcaaagaagacacatcctatacttaccgtttccattctaaaggttgttgctaatttttgtgctggaactaattgaaattttactttcttaccatagcgctcactacttgatggagcagctgatccagcaccagagctatgggggaaaactactgaagaggaacagatgcatagtggtataggcagctggcctggcattaacatgcctgtaaaaccacccaactccagtcttaaattatatggtggtgcagcttttgagagagtaatgcatgaattccgctgtgcaacatactcaatggagtgtccacaggtttcaagagagaaggtatgttttagattcaagcacatgtctacaaaattttatgtgaaagtttgcttaatttgtggtactgatatcatcaggttgcaaacatactacttgcacatgctggacgaggtgggagtagtgggttgactgaggcagcagctgagatagcacgtgcagctgcacgatcatggcttgctccccttatcgatacagcatgtgatcggcttgcatttgttctccaaagtctatttgaccttgcaatggagcgatgccgctatcaagactcaaaatgtacgatctggatgcctgtggggttcatctcacttcctacaattacatggttactattaatcttgaaactgattttgaccatcttttatgattaatagaaataatttgttcagtgtgatacgagcagacaaaagacttgactattagtagtttctgttggccaacacacactactggcaaaatatatattccaattcttttcacaccaatggtctgcaattaatttaactgcattcctcaactctgtgatgtgttttttgctattacttgtgatcacgttgtccatgcaaaatttatatggtcaatcattttcatgggtgtttactggggggttagtattttgttgatattaatatggatcacttgtgtatatgtttatctattcaagcttttgatatttagctaatatatcatcttttcatttttatgttgtaagaactctaagagtatctcattaatttcatcgtttgcatggagttatagctgagccttagcatattttagaagtcaattggagtccaccaatttgttcaatggttctcatacttattatattttcctggcagatcatcaaaatgttgaagatatggatggatatgttggcttccttgctgctcttcgctgttcatattataagtttgtcaaggaattgtccaagcaatgcaagcagatagtgagacatcatcttgattctgttacaagtccctactctcatatttgttacgagaatgacttccttagtggtgtcgggtctgtggcaaactccatgcataggtttaaccacttcccgggagtcacatcttttgacctatcagacagcggttctgcccttgaagaagctcaggagaatgtgccaccaaaggatcgtcaacatatgacaccacctgctaaaggaaatgagtcaaaggaagttcttagagaaagccagctgacggttcctgagacaccttctccagatctgccagttgatatgaatggtggcaagaagaaagacaacggaaacttgaatgatggtggtgcaagaaaaagacatgcaaggatggcagcatatgcaaacaggaatcatcataacaatgtgattggtggtgatgacctgggctcaaaatctggatcatcatactccagcatatgctcaatatctgctcagtatttcgccaaaatgcgggaagtcctgattgaaaggaatgtaccctctgcactgaactctggattcttgaccccatggtatgcctgatctttcaattatgttatacacacattttgttgtctttcttctgttcagtttggtagttattcgaagtactacaattgatctattcgaccaccttatcacatccttaacccactgactgatgagtgtttgctgtcattgatgtttttatcttgctgagaacatatgaccacattaaggactttcctttgtgaggtgtgcttcaaacactttcataacccagaaattccatgttcaccatggttcctgtgacacagtatataggcagtgaatgagtaaaatatttggattttcaagaataaccatctgaatcactatgttgttaaaatgtactccctccgttcagattttaagactttctagcattgctcatattcatttagaagttaatgaatctagacacatatatatgcctagattcattaacatatatatgaatgtaggcaatgctagaaagtcttacattgtgaaacggaggaagtagaatactatatgtcataagtacagtagatagtcaatattagttatggaccgtatatatttctggcatagctgctagcctgctactgcacgtagaattgatagcgtggttagtagatgctagccttttaaatttgtgtgcttgtccagtacacgtgagttttgtccttccctgatatgtgtactccaacttatgcaatgcagtcgtgagcggttgtttttggcacttggcttcgagctgtttgctgttaatgacgatagattcatggacatgttcgtggcacctggtgctgttgatgctatccagaacgagcgccagtctctgctgaaacgtcaaaagattttgttgtcctgtttgaatgaattcaagaacatatcgcggaccctgtaacaaagatttttctggtgcctagtctacaggcatgtatgatgtatccaggagcttcagtatatccgtaaagatgatacatcggagttcctggtgagtttctactgctgtttggcattttttagctcaatgcttctgttcttaatgcaagtagtctttctgttgtcaaattccttattgacatgtcgtaccacttttcatctgttcaacattgataacctccttgttaaaaaaattggctatgattgagaattagattaaaaagagaacgtgtagatgatttgatgatctcaaatcgtaccagtgtgtgcacaactcctaaagaacacttatacaaatcatcttaagatacaacaccatcagtattgccctttttgctctgttgttttgtcattgtatatgcaacgggtggtctggttgggctgtttcttagtattaatttggagttgaggtgtgtatgggtgcaccatcgaaccgattcaacagattcggtcacgactcacgaggtgaagtgtgcaggtgtgtacttaataaattatacgccgttgttagttggagttgatgactccctgtatccgtccatttcaacgtatttcaactgtcctcctgtcatctgcatgaaaaatcgccgaggtcaggcaacatcttctgctttcgttcccatttctctttcatgctctcccactttctcccctttacccacaactgtattttcttgtaacttaagccattgtcctctgtcatacttcaagtagctcgttttgggagtaactggtgtaaaggtctagttctatttggtaagaaggacctgcctacttggctcacttgccgcggcaagagtgtttggcaggggctgtggaccacggtgagccagaccagatctgcttatcatgttcgtgctctacactagcgttgcatagcttgttgtaaatctcaagcgctcaactaccccgttgataacttgatatacctttgcttgtcgctttacggatgtggccctcgcctgccattttaatttcccttcaaatcaaatcttgcacaagtttagcagctatgcaaaaggtagatgttagtccactggaagctcgtgtacctgtccgaaaggaatgtctttctgggaatcgatgccattctggagtaagtggccaacaattccctcttccctcctcccctggtctattcgtctggtcaatggttggtggtgtcgcctgtttcaccattttcgcaaatcatggaggaagaaagccagttggctagagatgtgcccgtctactgtacgcctcagctgcccaccatgctattcgattctgtcacggtggtgccgttaggtctcagccagagtacggaatcccggcattcccggaattacccctcccccacccacccacacacacaaaaaaaaatcaataaaataaaaaataaattctcgactattacccgggcaaaaagttcgatctaaatattatttcatatacttcggacagacaacgaccacaaccttagctcatgtcatgtgactatgttattaggggtttatttggaacgtatgatttaaaataacgcaggaacaagtaaaacacatgagacattgtacttcctccgtttcataatgtaaagactttctagcattgtatatattcatatagatgttaatgaatctaaatatatatgtgtatagattcattaacatctatatgaatgtgggcaatggtagaaagtcttacaatatgaaacggagggagtatttggattgttcataggaatataagcatagtagtttgatagaattgagagagaggagagataaaagagagaaaatgcattggacttctcagaggaaaataaaaataaggtttcagctcatagtaaattttcctatggaattggtgcattggatagcaatccatagtaagctcaaatttgttgttccaaagaacatatctctactattataaaaattaaagatgtttctaccagaattttggtatgtcatctgtgtttgaatcagttttaaatttatgattctgtcaaattctttcccttttttttcttactccagagtctctctcttatccgagacgcacgcaaattaattggacccgcaccttttcatgcgcaccttgccacatacagcaatcgggcccacgcctgaattcgttttccacacgagcctttgcctgccgccgcgattggacccacgacgctctcgtgcgcacgattttctacatgcccgattgggcctatgatgctcacgcgcgggtgatttgccctcgccgcatgtctgattgggattgcgtcacctcgcacgtgattcaaaaattgaagttgtttttgtcaaaactacggtacgttgtccctcgtccgtattcgattctcgtcacgtataacattcattgtgaagtcacgaactgcgaaagtgagtccgtgtgatgttgataccaagcgaatgaaacttgctaagtccgtgtagatatcacatacgtcgttgcctagatcatccgattttattcatattacacggtacaattcctgagacatgttagcatgatttcaagtcggtctctacatatgcttgtacgtattaccaaggataccgttacaataatccataagaattagttttactttcgaaaagagcatgccaaccgaaataaagaatgatcaaagttgttaattccgtccgtcgtcaattcctgcctgacttgagataaaggtggacgacaaatcgagcttgtgtttgaaggcctcattgtttgtcttatgcttattcctataagctaaatttcaaattttagaacttaattttgaatttgactttttggtttttttatcgtactttattttataacatttgcttttgaatcgttaagaaagtgtatatataataaaagatttgcacataaatagtcttctatttagtaataagtgattcggataagcacatgaataaaccaaacaatgggttatgattatttatccaccgacgcatatatacaaattaaattggctctacccgttgcaacgcacatgcatcttttctagtataggaaatattcgcaaggtttaggatcctttgaattttctttgaattttcttctatacaaaggagccctagatgcgcgaagatctgacttaatatccttgtctttgaagctcacatctcattttcggaagcatagactccttgctatctaaagccattctgaacaaaaccttacttcagaaatactcctgctacatccatctatttctcatctttcaacaaagaaaaacgggcacctgctacgttggattctacccgttccatgcctcacgggggacagtgaggtgatggtgtcaggtgagtccaactgtgcgggggaggggagtgagtgagtgacacagagtgagcataactaaaagacagaagaattggtgctggatttttgcagtcaccagatgggcatctcgtcttccacttgggtggtcctgtggatcggcagcgtgcagcatgatggagccaaagaacctgcagtagagccaacagaccaactgctggattctttacccggttgagttcttgccacagttcctgaagaacaatgacctgtattattactatactgcagattctgcacagatatggtggctgctgagacttaaaagagggaatgaatccaccacactaggtagatatctcctccccatctctaaaatggaaagtgtgtaggagctaaaagtgatagcaactgtggtccactgtgatgggcctttcatggccagtgttggatgtggaatcggtcgtctacacacttaatagttggtcaaagaaagcttaatagttccaaacacagagaggccggagctatcgaccggaaacaccatcccacaaagcccatccacttgccaagttgccatggagtagtactactgaacctgttagagttcaggacaggagaggtgagatcaaaatgaaaacaaggactcaacaaccagaaactcatgcaatcatgctccagtggtctcagaaacaatcggatagagactgaaatacattacttcaatagagagttggtctgaattaactagctgtagtcctcacttatccacatagatccttcagctattgcattgggcaagccacaaggccggccatggcacttgcgcggttgcgccttcgcactcctcgtctcctccaaccgagattccaagttagtactctctactccctccataaaaaaaaaacgcagcctaattagatatggtttttttttaacgaagagagtagggagtatgttctaaaatatttaggaaaatatagcaaacctactctatctatagtattaggcttttgttggttcctgtataggaactgagcttcttagtggcacataaatcagagtaagcaattaatacatgattaattaattattaattattataaactttaaaaataggttcatttagatttttaagaaacttttatataacttttttattaaaaaaatgcatcatctaccagtttagaaaacgtgctaacggaaaatgagaatattgaagtttagagttggagtttaaagcggagcctaaatttgttcaagtttataaaaatatcaataacttttttaaaaaaacaaaatattgtcaaaatatattgaatattagttttagcgaaactaatttagtattatagattttgtttaaaaaaacttgattagatttaaagaaatttgattagagaaaaatcaaaacgatttacagtacgattggtggaagtacatattttaggaatagtaaattgacaaagaacaaagaaactggaggtcgagtgatcaaaatgcatgattgcaaagggggttgtgcttttgtaggctacacgggggtttgacgctggagtgcactacgagaccaaaagctgtggcaaacaatagtgcggcctacgtacatacgtgatgcttggaacggatggatgcgttgagtgtttgaccagggtttcagctggcacgtctcgcttcgctggcggcaatgattggctcgagctctcggagttgtgtggtggcgacgccgcgagcccgcgacgcaccccgcccgcgcgcggtgccgaaccgagcctggctgatatcaccgtcgcctctgccaatcggccactgggatgaccggtcaatttttggccatgtctgatggttgatggacaccgcgtgcttggccgaattgtacgaggggggagagagaggatgcacactggcgatagtggtgaattgaaaatgcccagcgaaagtgatcggaatcgcggagctaagctaggcaccagagggtggtaggagtatctttgtgccaacttgaatcttacgcactcgcgtgttaagaaaagtttggactattcaaacaacatgaatgaataaccagaaaatcagaaatcttgaagctacatggccaacagaaacaccgaatcctgttggaacgggacaagaagatgtcaccgagtggctcaaaacgtaggagtacgcgtgcttgatccattttcaactacggccgaagtggatcgacactatccttaccaatttttcacataaaccttgttccaaaacaaaacataaaccttgaccacggtagtcccactcctggtagcgaaatgtggccagcagcatcatttcccatgaccaagcaggcactgaccgccactcgcctcatgatgaggagccgatgcggctcggaagaaatactacttctagtcaacagcgccggcctcccgtggccgttaaaacggggaaccggattcttccccaagctttttctctccatcgtggagctcaattctcggatgcgatattcctcgcccacgttccccggccgtgacgacacatgtaaaacctcgaacggaaacggatggctcggcgcagagcaagcgcgcctgacttggctgtagtagtactccagtttcactctcaccggtcgaaaagctggtacgtacgcgtggccttccactgctttgccggctgtgctgctacctggagtggtgaagtgacactgagctgactcttcctcggaccatggcaggaggaggagggggtgggcagagagagaaatgtggcgagtgcggagcccgagaaacgtacggtgcgaggctggcaggcgaggaatcgtcgtcaccggggtggtccacatccgtcatttgtccgtcatttgggggggtggcctgggcaagtcaatgcggctggccctttttttatggagagcatctatcttcttccttggacgccttccgaccggtcgagctcgcgaccgaatcaccgaaatgaacgacagcgagtaccagaacgggtaaagcgctcctcgtgtttcacccggaaaaaaacaccccctatagccgggtttaaacacttgcaactgctctccgcgctgctgtgctgcgtactcctagttctgtttgtaagattagcctaggctaattttgagagctaatgtttagtcataaattagtaggctaaacattagtctaagatggtatgtttggatccgtgggttaattcaagactaaaaggtggagagagaatagaaagaggagagagaaggagagagagagagagctgtttttttatggtccccacacaaaattagccccattagcaccccttggaggggctaatgttttgaaggggctaattcacattagctcaaaattagtccacctgtttggatccttgagagctaatttgaggctaaaaggtgagggctaaacattagcccatggaaccaaacagagccctactcatttgcgttttccacattttttttctgttttccttgtcttcgctttatttagtcattgtactgttatccttttcatagctacgcacctttacgacaagaggcgccagtgtgcagtcgtagaaatgtcttactactttttttaatctattctctgattttctaataccaaattattcatttataaccttaaactaccatctaaaataaactgagtttcagttgcttgtgaatggcgaagcataataatgttacttatgcttcggcttcacaaagcagataccggatttctcatattttgcaaaaacagttggaaaatttggggggggggtttgaataaactttatttaaaaatgcactttatatttttttgaatttaactaatttcaaagaacaagttttcatctattttctctcatccactttaacatttaaacctacgaggcatctagaagcttgttcttctatgtttacagcacttgctcttgcggtttatcaactcaatcagacataaaacatctaaattttacgaaagccgagaaattatgatcgtcctaggtaatacgtacaaaagtagtagcaaaaggtgaattatcctatgcatttgagatttcataattttacaggccatactctaatcctcttccacgactaactgtaagttcgattgggcaatactccctccattccaaaatataaggcataaccacccctaacccaaacaccaagaaaataattattatcatcttatagtttggatcatcctaataaatacaatgcatgtatccaatagaattagagaatataagagtggaggatttaaaaaaaataataatttaatggagaaggggtcatagttaattgtctacatgcatacatgtcttatattatggaatatcttaaaaaaagtggttgtgccttgtattatggaatggagggagtagcatctttgattgagtaatagattttaccacattgatagtattgaccaactaagaccagtgtttgcttcatgctatgatttttgaagtatcctactttttcaactaacaaatctatctaactacgaacttgccatttccctacagtacatataactagatagtatctcttcgtatcaattttctattcgtagttagatgtacttaacatggcaaatttctatacgaaatgaaaccgtcgtaaattccgtttcttataaatttgaataccaaatccagttttcttgtggaagtttttttcctaaggcatacataattttagctctttttcttggcaaaggcaatgtattttctcgaaggtttctaaaaaaccaaaacccatgaacaaactgcaaacagtgaccatgaattcctgtttaccagtagacccacttccctactaccagtctaccacactatgacactacccaacacagccgagtaaaagaaaatggaaaaagacaaggaaaataaaatgagaaaaacccaacaagaaaaggaaatcaaagctgggaaagaaatagaccctggagagagaaagcatccatccaaggtctcagtcacacctacaacaatgcatctctaactcccccccttctccctcttttcctctccatctcccttcttaacctccccaccctcttcttcctcacctcaagtcgtctcctcttcttcttctcttcttccttcctctcccaacaccaaaacccaagaaccccacaagtgcgggcgaggaggggagggaggcattaatggagccctctaccaagcagctcctccccatgcctcagcaagaccccaactcgccgtcgtcttccacctcgtcgtcgtcgtcgtcctccacctcgccgtctcacccgcaccaccgtgcaccacttccaccgtcgcctaggcccgtcccccgcaccatcgagaccacccccttccccaccaccttcgtgcaggccgacaccgcctccttcaagcaggtcgtgcagatgctcaccggcgccgagcaaccctccaagaacgccgccacagcagcgacagcggccgcggggaacagcagcgccgccgggattggtggcgggcagggggcaaacgggccgtgccgtcccaagaagccggctttcaagctgtacgagcggcggagcagcctcaagaacctcaagatgatcgcgccgctggcgatgggggcgctgccgtcgccgaccggcaggaaggtcggcacgccggagatcctgtcgccgagcgtgctggacttcccgtcgctcaagctcagcccggtcacgccgctcaccggcgagcccttcaaccgctcgccggcctcgtcctccgaggacgccgagcgcgccgccatatccgagagggggttcttcctccacccctcgccgcgtggcgccgagccgccgcgcctcctcccgctcttcccggtcacctcgccaaggatggccgcgccttccgagtgagtgacccaaaagctcccgcctttgcgcgcgcctcaactatatcaagtaatcgacgacgagtacaactactgctactaccgctctcgctgtaccgtttctcttcgcagttctagttttgtggttgttgttcttgatctgctgctgctgctgctgtaatttttgcccccttctcgaaatgaagaagggagtttcttttttttcttctttggagtagtgaccagtgagcgattgtataatccgagctctagatttcggcttcggtttcttgatcgctcgctggggactccgaaaggatggatcaatcgattaattaagcttaattttgagcttggtgttctaactcccttcctaattctgaccggtttactgtttctcctctgatgtcattcggtttggccttctcatcggcagctattcgggggttgattccttctgatccctggctactgttcttgcgtcagcgctcataaataccagccttgtgattttgtatagtactcctacaagcaaagatctgaattctgaagtcataattgtggtcaaagttcttttgcaagtcgcgccaattcaaatagaagtatttatactgctaccactactatctctctgccaagtagaattcgatcattttaacagggtgaaagcatttacaaaaagctcaaactaccctggcaaaattttggcgtcttttttatcattcctactacacttgaatactccatttcccagtaggcagtagcagtccaaagacctgtaaaaaatcgctgtagagccagaggcaccagcaggaagacttgcgtttgtgggtggccacttgcatgggtggacagtagagaccagttgtcagcggcaagccgaagcagctgcatccatccaggcccggcgccccggcgaatccgcccgccccacgcacccacgcgcgcatctctcccgcttccgacttccagcggccaccgagccgtcacacgcgtgcgcgcgcatgtggcgggggccatcgtcgatcgggggaaatgcattgcatttgcgtgtttgcatggtcggttaacatgtcctcgtctcgttcctcgtcgccgcgcgcgcgcggttaaaactggctgtcaccccccgttgatcgaggtgattgtacatgtgtcccatgatagggtttgccagaaaactggtacagtacttcgtatgattgatcgagttttagttattataaacttaaaaatgtattttaaatagtttttatgtagagagtgtgtttgtgataatcaacatagaatttgtatgttaatcagaaaagaaaagaacgaacataaaacttacacattttggcctgcacgtatgcacacggcatttgttttggccgacggaacacggaaatttgtgatgctatggttcgccagaaattgcatatgcactatgcagtatgcaccccgagcacagtatacgccatatgcattatggaacgggagctatcagagacgcgacacatgccatcctttatttcatcagtaaaaaaaaaaaaaacagaggagggacacagtatttcaaagggggaaaggagaaggggactggaaagtcaaacccgaccgagagcaaccgaattaagttttcgcagttaagctgcatatgccggcctggtgcatgcaccggtagctagattagctcgaccttgtttgacttgtctgcaccggtggatcgtcgcgcagcgtgcagtagctgtacgtagttgggggatccagtgcttgtttaattagtggccgatcggatggatgcgagggccatgcatcttttctcctcacatgttactgttcataaactaatcaggatcattagttactctcatgtgatgatgcatgatgcatgggggcgacaattaaattcagggctcaggactagttaaggtggggcgccatgtggtgtcatcaagtccgtaaagcatactgagagagaggctaataatataaccgatctgttggctataagattatttgtagttgttttattccattatctaaaagaaatccacaaaagttacacatattacacattttagtttttccaaataagttgtttctccttgtagtctttatgcattcaagacttaaatgaagagataaattaaatgttttattagaacctaaggagtcatctaaatgtttattggttgcatgcttgtattcactccttgattttgtaacatttaaggtgatttaatttttttctgatcttggtgtcaaaagtaatatgtgcaacttttatggatagagagagtaatagttagctctttacaattaatatatgacacactcgtctctcttacagagtttcttagttcttgtgtctaaggcggctgtaagtttacagcccgcttcttctctctctcctctcttttctcctccacctcagcatttagccggcttatagcctactattatacttgctctgatctgcttgtttagttcttccggcgggtcagccagttcacactggccatgcgattaatcaaccgcaaattaagctagttgttcacaggaagtaaaggaaagagcggcttaatacactagcaaatgggtttgcctttgaacagagaggggaggcgtgggtcacacgatggatggagaaggggtcgcggagtcttttctttcccttttagacgagaggtggccatagacccccccc

SEQ ID NO: 22892 - DNA, 13619 bp, Oryza sativa
  unsure (1)..(13619): unsure at all n locations
cgaaaattagaccgcgagagaaaaaattgtcctcccggaattaattttgagtggttaagtcaactcaacaggtgcaacgtaacgtacttacgtcttagatggagtttatttctccgggttaagcatgtcataaaggagagcgtgtagcagaaaatgtgaagtagaagaaaatgcatgtgagggtcccctttttatctgttcgaaatagaccgtccccgtgcaaaatatcagatcagacttgcatgggtgcatgcgtgagtaacatgtactccctccattccctaataacacaaccacttttttctcagatgtttcataatataagacatgcatataagtatacaattaactatgacatcttctctattaaatcctccactctcatgttatctagttctattggatgcatgaattatatttactatgatgatcgaaacttcaagatgataataattatttcttggtctttgggttaaggatggttgtgtcttatattttgtaatggaggaagtataatttacatcaacggttaaatatagaagtagtactagcaaacgacatggagtatttaaaaaaaatactccatccgtcccataatataagggattttgagtttttgcttacactgtttgaccactcgtcttatttaaaaaatttatgtaaatataaaaaacgaaaaattatgattaaagtattttggataataaagtaagtcaaaaaaataaataataattctaattttttttaataagatgattggtcaaacagtgcaataaaaactcaaagttcttatattataggacggagagagtatacagagagtgagagagaaaaggtgaaaggggaaagggaagaaaattacaagaacacttcgttggctcgtacttccgtgtgtagaaacacactcctaggcgccgtttcagatgtgagcaaaggccaaactatgcattccgagacaaagcgcttctgcacccaaccctaacgaaagagttgtgaccgcgcgcgacatctcgctgccttccgatcgatcgacagcaagcagccaatgcgaccgaccgaaaacccgggtcgcacggcgctcgctggtgtggattgtggattttgctagcgcgcgcgggatggaggcacacggcacggcctggcacgcttagactaacacgctcgcttggtcagatcgatcgcacgccagcgcgtggattccgggatgcgtggctccaaacgtcctggttaagcccgcgctgcgctggaacggatcggatgatttgtgttgtgccggtgtgtcggcattgtctgcgttatattttctagcaaaaccatatatatccggggaatacatccggaatacagggaatgttatctaaaaaggttgtagggaatataatattctactccctccgtttcaggtcataacatgttgactttggtcaaagtcaaactacttcaaatttaactaagtttatacacaaatataataatatttataataccaaattagtttcattaaatcaataattgaatatattttcataataaatttgtgttgagttgaaaatattattattattattttctataaacttggagcagtttgactttgaccaaagtccaaatgtcttataatctgaaacgaagggagtcttttattaggtttcgactgaacttgtaggtgaaacctacccaatttaaatcttaaggttgacacggatgctaacatttacaccaatagtcgacaatgagacatcaatggtaactttatcaatctcaaaaatacgtgtatttatggctacacctatgcttgtggtgactttaccaatcttaagataagccggcccattctcttgaagtaggatgctcgtgagtatgaacgtctatgtctatacttatttttctttttaaaaaaggtattatatatagatcttcctgatcttaaaatttttagccgcagcaacgagccccagcttgctctcttgttggcatgcatatgctattgattctaatcgtgtccgtgtccgcgtccgcgagtatctatggcggtagtgataggttcgaacttaagtaacgtagggcaaatgggaggctgaaacgtgtgagggagagctctcttgctagctgcaccttgaggtcatcgagtggtgttaagttgactcttattttggcctggaaattttcggttcaaacgcaaacgtcacaaacagaacatcaccaccacaataccacaaaaatgtacacaaacatgtggtgtaacttctcggttagatcagatgacaaagcatgaaaaaaacctacaatgaccacgttatttttagcagtattatttacttttaacattatgccatccaaaggatggcacgtcctttcatggctacgtaaaatagtctcgaatcctccgagcaggtcaagtcttcgttggcgaacaaggaggcaatgcgagtttgctattggcttaggacaggctaaaggcaaccattgggtttgtgtgtgttttaagtatggtgagcgtagaatccaaggaagctttacccatattttagagccggagtcaattttgtcgcaactaatcctgtcgtgcaaatggcacatccggaatgaacatctttctgaaggagctgctatttttcaacgagatggattggtaaagaaacaagaacttgattaaaaaaaaaccacagcctggagctagcaaactgagacttggcattgcatagactagagactaatcaaggttatcttcatgccagaaagcacagcaccacgccggctcagagcaaacttgcggtgaaagggtccaaattaggatgattctgctttggaaagggtagctcacacttacacctgttccacgtactcattcaacccactaacaacatttcaccgcaaaactcactaacagttcgcttttaagtcaccgtaccaaatgttcctctatctcttgaacagtcccagacctctaaacaaccaaaccatcatgataaaccccatttggtcaataacagcaaatgcctagacacgtatcatccaaaagcgaagggattgcaaaatggactaccattcagataggggaactagatgactatcaatagcttcgtagtttcaaccttctttttgatgaattcacgaggttagcaaacgttgttgggcatctctagtccgctataaaacagaaatgtatcaatatttgaaaaagaatctccaagccacgggaacatgtgactgagttagtaagcttttggcatctccttcagaaaacggcaaggtagctgtagctatagttcctggtcaattaattggtgtgcctaaaacaaattcttgtctctttctctctcttctagctctaaaagaactcagtgttaaaaaaaaaaactctaaaagagctcctcgtcacaagctgtcaagttacatttaaggtccaaaaggttagatacagttacaccacactcaaagaacaggcatgtgatgtcctgcttttaatatggtactagcagtatcttaatagatcagacttgatatctcagtgagaaaatacataaatagaagaaatatagtgttcttaaggacatgctgaagactgaagagtcagaacagagacaacacattcaaagactcaaatggcatccttagcccccatatccagcatgattgcatcagatgtaataattcggatcgtaataaaatgaaactatagcccttggattttggtgtgataccatttcaattgtataagtattctgtaagatgctattgttataactttttggcagttaagccttcatgaccattgtcaccatcgatctttttcttactcctattccaaaagtccagtgatgtccaaatcatatgcaactacaatctataagagaacaagactcctgcaccaatttgcaacttgaaaaactgaatcttgtgaattgtgatagttttgtgatacaaagaatagccgttgtcatttgtcaagctttttagcattaaaagggcgctgaatatatgactagtcgtcatcagttttcccaataaacagcttgcctccatcttgtcataatcgaagtcacatgtttcatggttggccatggtagcacttgatcatatgaatatagaataggctacgttatgcagtaggcaaagttaggtaatgaatttgcgaaactccttttggttttaaaacacaaaccttgttttttggtctcagagcagaacaagccctcacggaagttgcagttaaaaaaggatttgagtcctgcataataatagacccatatgaaaaaaactccctcatcaaaatatatgagaaattatagacgagtgcaaatctgtagtacaaatttaagcatacacaacaacaacaacaacaaaaatactatttcaataatatagagtaagctcttttctacttctcaatgatgaatgggtgataatatgaccacattaaatactagaagcaacctgtgagcttcttatgtgaaagtctggatctataccaatgagctatataagtggacctccgagaaaaaaaaaatcctattcaaagctgaagtagtaacttagtgaatatgaaaaatatagtaattgtgacatttttgctatttaataatccataccgttcatttgagtcagtaatcttgagagatccatttatcccttgcaaacctacaaatatcgaatcagctcaactgcgtactttcctttcctcgtagtcacaatttccccaatctagagataaataataaataatttaaacaagtcaagcatagaactggttgatatagattcaagtgaatagggaattcataactttttaaaaagaaatatacatctagtagcattcaaacatcttccatagcatgttatattccctcatattatgtatttgcaaattaacacataatccttgattcataaaatcctattttcagcaaagcaaagcatttactttatcgatgtacatctggaggtctgatccacatagttcttgcaacattagtctaaagtaatatgcagcctataggacagtctacaacaatgaagccgttatgacaattgctcagaatgaacaaaaaagaagacgacgccatgaacatcacaacatcagtacacagtaaaggctgtggctttattatttgaaacttttgagctcatagtttcacaacaatacaaaatcttatagttttggatgtattctcaggttgaaacaatacaaagcaaaagcagaatggtatccaacttaattgatgtagtgatttagatccaagcaccaatatatttttgtaaggaagtaataaatatatataacactccaaaagttccatttcagaaaaaaggacatgccctgtgtcacaggcatgtggcccaagacctacatgccaatggcgcatggaatgggaattcttgaacgtcattctttggagtggcaaacacctgaatgccccttttcccttaaccccattcgtggaataccttacgcgccaattgcaacatcaaaatttatcctagaagtcgtctattaatgtggtgattgcatataattttttacctttaatctccccatcccactgacagaaacaacatccccagccttgagagtcactccatttttcgaaactggtgaccaattcacacggacatccccagcactggacaaacaaaagagagatttggatacatatatcaattgctttatgagcggtaattaaacaaaataatgcgtggatggcaccatccaaggtagaagggaagataacccacagtaaaccactgatgttaagataaagagatgttttaatgaacctaagaagatggatagctcacaaatcttacctgatcaagctagcaagctttgtacgtgagattttaaatcctgcactacccagggcatcaaccctgagtgatgattctacagttttaaatgacttggtcctgtggttcaaaggtacttttaagtgttgagtatctttgtccaggcatttatccaaaaataaataaaaatgagccaactttgagatgagatcagatgtcaagcaaaccttggtggttcatattctagagcaagcaaaggattctgtgtgcatgaaactccaactttctccacctgttgaatcaaacacaattcagagtaagctgcatttgcaagggtttgaaataacaacaaaaatacagcagtcaaagttcatgggcagagttagatcaatacaagactaacatgtaactaatctagagagttattctacgatgcaaataacctcaaaaatattggaacatgtgctgctattttaaatgtgctatgagtaaaaaaaaataataaaaaacacagtagcttcagagcttctgttgtctgcatagcatgtaatcaacataagtgaaaacatgtggggtaagataatgttataacttctgtagttctgtgtcatatataggtaagaaattatataacatatataaactcaccttttcaagtgtggaagtcagatagtcaacaagttcaggatcaacaaggacctgagcacctctctctccctgacaaaaaaaaaaaagatcacaaagaggcacctcagacggacaaaagtcaaagttcacaacacaatccagaaattaagcgattgggaaggcatgtgcacctgcaaaagtatatctccaactttatcccttgttattcctgtcccaagaatagcaccaagaaagtcaccatgagaacagggttccaatctgaaattccctgagatgctgagaaggcctcaaagttagcttatataaaagatggaactgcttatagtgcaaatttgagagaacctcaaagcagcaactacatctgggttgcttgtcatacagtccggatgtccaactgaaactcggcatcgctcagcctagataaatgaacaggtgagagtgggacagattaggtaatggaagctaataaaacaatttcctttgatgttactcaaattcacctgtgggtagcccccctgtgctaccgctttgatgtctgctaacttctcaattgccagcatgcactccttcactataggtggagtaagaaaattggtgtggaaaacatctctccgttgggaagccctttgtgcctgcataagttggataccatcataaattcatgaagttcaaggcaccatatcaacatgaaatactgcacttacaacttgaaacattcttattttgtggttagttacaaaagcaaactagttcaatgttgttgaaaggttatgtttgcaatcagcaaaacaatagtgagtgaatctgtctgatgtggcaaactactaatcatatcttgtttaaatgtcccttagctgtttttggctggtgtgttattagggatgctttgaatctggtttctttacctaataatctatgggagtgtatgagtctgctcaaagataggaaaaagtttaaaccttggatctctttaattgggggggtttgttgggctatttggatcattagaaacgactgggtgtttgaaaatattcttgtcaagtctcccctttatgtggtttataaatcgctctctttcatacagaagtggcacattttgctaaaggaggaagaccaggagctgctgggaggatggtgtgaagcaatcaggataaaactgaatcaagtcaggcctcatgtgctacctgcatcgctatagaatagctttagcctgagtttcagttttttctgtaagggtgtggttaggttgggagtacgttccttttgtctctggaaaactggtttccccagctatctttttgtgtttcttttattttccagttcttgtataagactctgttattgttcttgggcttttttctaaagccgggtcaatatattgatctgccataaaaaaaaagaaaaaatgtgtctgatgtgccgagagcaaaacaactaaaacacaaagcattttctttatttccttgagaccaatgtgctcatagtggcaaaattcactcgatggagtacataaactgaagctcataattgtttgtgaaatcgtttatcagggtggggggggggaatgatttaaccatgaaggcatttcatcagacacaacgtccataagcaacaaattgcactcctataaaccacctaatctagtaatctcaacaagttgatcttaataattgaggtttaatggtggaaaacaaactaccatatccaggatgctcctgagttcctcggctgcattcctatccaagctcgccttaaccgccgaatctcctgctgctgccgcggcgaaggagagagccgcgtgacaccgtcctgcaccacaacgagccatgggtagccaagcgtcagaatcgtcggacctaaccggaatcgaaccgagcggtgggtacggggcttaccgctagggaagaagtggtacgatgtggggatagcgcggcgtgcgaaagggacgtgaaggactcgccggaaagggctcgccaacgagacggcggcggccatccttaccaggaaccgatggggctgggcgccgtcgtcgcctgctcgttctcccctttgcctctgcccggcgggcgtcggctttgagcttaaccgggttcggttcgttggtggcaatagactcaggaggcacgaaccgtcagatttgcttcaagattcgcgcgcggatttccatcagattttgagaaggcgaagggcaccggcgccgaaatgcgcccgccgccgccgccgcgatgaccacgctcctgcgccgcctcctcttgggcgccaccccggccgacgcgttgctcaccggccgcctccccttctccacctcctcccgccgcacgccgcaccgcttccgccgcagccgccgctccccgaaccctgcgccgccctcccctgaagccgtctccgcggccatcgccaccctcccgtcccgtctcaccccgcctctcctctcctactccctctcctccgtctccgacgcccgcctactccttccggtcctcacccactcccttcgtctcgccaccttccgccctgacccgggccccttcctcgtcgcgatcaagcgcctcgccgccgccgatctctacgccgatttcgaccgcacctgcgccctcgccttctccctcctcccctctctcccgtcccccgggcccttcctccgcaccgcgctctacttctactgccagttccgcaagatcggcaaggcgttccacgtctacaccctcatgcgcgcctccgccgaccccgccgcgcgcccctccgccgacacctaccacgcgctcttcaccgcgctcttgtcccgcggcggcggcgacaccatggtgcactacatgtacatggacaccgtctccgctctgttccggcagatgctggaggagggtgtcccgccggacacgcgcgcgctcaacgtgctcgtcaagggctacgcgcagtcgctgcacctcaacgacgcgctgcgcgtgttccaccagatgcggcccgtctacggttgcgaaccggacgccctcacgtacagctacctggtgcacgggctgagcgagcagggccggacgaggaacgcccgtgaggtgttcgatgaaatgctggccaaggggctggcccctacggagccggcgtgcaacacgttcgtcagtgcgctggccatggcaggggaggctggggaggcggagcgtgtgatgtgggacatggctcgggcgggaagggtggtcgacgacgtcacgaggagggcggtggtggaggagctgtggagatcggggaggagggacgacgccgaaagggtggtgagggagatggaggagcgaggcatcgtgggtggcgctgagcggagagccttgctacgttcgctgcacgatgagttcggtgacgacgatttggatgttgatgatagatggcggaacacaaggtgattgtctgacagatggagagttgagaagcactcataatccatccggccatccatgtcccaaaaacatggcaatcaacattgaacactactaaatgccatgagatgtaacagaaaattttgtgataaagtatcagtaaaattcatttgcaatgatataagggttaactgcaagattgatatttattcatcattatcggttctgtgatgtctgaatcaccaatataagtttacactgtgcccttctagcactcgatcaaatgtatacaacagcatgacaagcagtttcttcattgcttacttgctttcaataagttcttctcagcaatattgcttcgagaattccaaaaggggaggctgatgagtgatgactggaaaagtttgaaattgattcttacagagttggggacaggggaaggcatgataatataactccaggaatgttctcccccgaccccaagcataaatttattctgtttactcttcaagttgatcggatggaagccattcgagggtgttgccagtaaacataggcacgatctctcctgaactatatgagtatgtatcaggtactttccaggcgctctttctaaggacaatctttgaagtgttccttggaaggccataaaaatctgggccattgaagcttgtaaatgcttctagcttatcaagagcaccggcctgaaatgcaagatatttcaaacaaacgtattagccacaatgttttctcagcattttggctattataatcatttgcaagttacactacaaattcgtggttttgtgatgcacttaacacactttgtctttacagctaactgacttgcaagctaaccccgatctacagcagaacgtctcttaacttaaaatataatctttcctatttatcagcgtgagagagaaagagagatacctgttcgaatactttcgcataaagagaaagagccacaggagcgctatatattcctgcacaaccacaggagcattcttttctccgtttatcatgaggagcactgtcagtaccaagaaagtattgtttactcccacttgttaccgcagacacaattgcttgtcctgagataggcaattcaaaattgtttagcataccaagttctccctaaagcagaaaagtggaatacaaacatatttttggcatgacatatatatacacaatgcaagtacagtgttgtcatagatctactttttcattaccatttaaggaacatctgggtcaaaggtcattttgttgaaccaaagaaatcttaatgtgcatgtacagccaagtttcctctatgttttgcctatacgattgcgtgtaattatagatatgtgaatactagatcatgcaggagttaggggagtaggacaattggaacatactatgagtttctcttttcagtactggtaagcaatagttgtgtggctgcaagccaccctgaaataacgcattcctgttgagaagaagatgttggggagtcaccgttgcagcaacatgacctgatgaaaatgaaattttagaaccatagatatgcacagaagtataatgctattgtagtggtgcacaccttctttgcatgattctacgaagttaaccgcatccatagtggtgatatgttccataacaattttcagctgtggcagtctttgtacaagtggtgccaatattttctcaatgaaaaccttctcacgatcaaaggtatcaacatgctgatctgtgacttctccatgaaccttaaggaaaaaaacaagggcataaggtcaattttactatctatacagctgacaatgcaagaaagtcactaattagaggcaacatcatttcagtgaattaggcattgtcaaggaacaaaggcaagtaaaagtagcattccgaagtaaaagtaggagaaaggatcgagacatgaataagaacttcaaaacaaatgggaaaaatatatgctgaaagaagagcatcagaactatacttacaagcaaaggcatctcctgcctagccatttcctcaagcacaggcaagcacttcccaaatatatcagtgacaccatcttgggagttggtagttgctccagaagggtacaacttcacagcaaaaaccacgccactcttttctaatgtcaatatgaaacaatatgcaacataaacatcacatacaaaactctgcaaccgatagactgggagaggaaataagaaggcaacatttataatacggcacttttaaatcatgatggctagtattttaagaacgtcaagtttgttctagcttctaagagatacaaatgcgactgccaaatcactgcacaagtgtacataagcactgagcgcgacaaatagacacttcaacttacagtagcaatgtagctaatgaaagaacggtgttagtgagagttcgtacttgcgagcttgatctcctctgggctagtattgtccgtgaggtagagcgtcatgagcggcacaaagttgctcccaggcggcagcgccctgaggatctcctccctgtactccaaagctcgtgctgtcgtggtcaccggtggcttcaggttgggcatcacgatggccctcccaaaatgcatcgcgctgccaaacagcacgcgaaacgatcacgcaagcagtcaccagacaggccacctctctgagacattacatcgaacactaggcgtgcgtcaccaggaaaacaagccacaagcccacaacaccaatcagaccaacctgtgggggagcacggccgcgaggacannnnnnnnnnnnnnnnnnnnnnnnnnnnnnnnnnnnnnnntgatggtgagctcctgcagcggcggcggcgacggcgacgcggccatggcgatcgagatcggtgtcttgttccggaaggagggaaggtggactagggccccgtaatgaggcgacggccggaggaaaggtccgggcaaatgcttcacatgcgggttcgcgaagaaggtggaggtcgcggcggtctgcattgatgattgggatgatgattgacctcgctttatgccgattccctcccgtagaagcgcgcgggtgtgtgcccgtattgtgggagacggtcccgtgggaaactgggaggtggagttcggtttctgagccgcaactgctcaggtgacaaccggacgcggctctctcggcggctccagtttctttttttctttttttttttagcgcagcccccacgggccggcttctcttgaccctcagatgtgactgaaatctaattcatggccctaaaccacaaaaccggatatctcgaccctcaaactcctaaaatcagtgcaatttgactccctcggtggttttagagggcggttttgctgacgtggcgcctatgtggcgatattgaccgagtcttcgttacacgtggcgttgacgtggcacttacgtagcattaaaattaaaaatatatatgggacccattagtcattcacacaaaaaggaatgtggggcccactcctccttccttcttcctcctccctatctccctcctctctctttctctccccttcttcccttcgaccggtggcgcgcggcggaagcgagcggcggcctagcttcggtcagcggcgggtggcgagagcgagcggtggccggaggacttcggcggcggcggggccttcccgaagaaccacgtcgcacagtacccgctcggcatgggccagcgcgacgagaagggcggctcgaagatcctcgcgctcaccgtcgacgccaagggcagtgtcaccttcaacgccgtcgtcggggtccgggaggcggacgccgccggggatgagatcctccatcgtgagggagtcgagtggcccgtatgccc

SEQ ID NO: 22893 - DNA, 12386 bp, Oryza sativa
cctccccgccgactacgtcgtgagacacctccgatgccccctccctctccagcgacgacggcggtgcccctctgtgccaaccatctccagatcgatgctgacggcgcgacggcgccccttcccgcccactagcgccaacggggtcgccgcacgccgccggagccgccgctcgacccactcgatgcctccgccgtcgacgtcccgcgccctcccgcccgccggccgaaggggaagaaggggagagaaagagagagaagggtgagagggaggaggaagaaaggaggactgacatgtgggccccacatgttagtgggcccacatttctttttgtgtgaatgactaatgggtcccactcatatttttttaattctactgtcacgtcaacgccacgtggaacgaagactcggtcaatatcgtcggtcaatatcgccacgtaggcgccacatcagtaaaaccgccctccaaaactgacgagggagttaaattgcaccggttttaagagttcgggggtcgagatattcggttttgtggtttagggtcatgtattagatttcgattactctcaagggtcacaaagtgaacttattcctttgggatttcccaaatgagcctagctataggtccagtgtgacgtgagaggaattccgacgtgagatgatctccacgctgtgtgggctcggccgaatgatttcgatgccttgattccttctttttactttaagaaataagttcattaaagatgcctcatcctgatgtcagagtttgaattctgtccttcacacacaataccggacataacacatctctcaacttgtaaaactagtgttactgagatcctagagcagtataatgctcaggttcagctaacatgatgactgagtcagcgtgggacccacatatcaggcatttcagtcggagtcaggaccctttttcttcctcctctctccccctttccactctcttcaccatctctaactagggtggtaggccagccgtgagcaacgtggacaaggatggcaaccgatggaaaggagggcaaccacggataggagacgggcgatagggagaaggttggcccgacacgacaagggagctctgcgttggattcgcccggtcaacatcgtccgtgagttctgccgacctcgcgcagccgacggggagaagggcagccgctagcggaaggtaggcgacagggagattagcagctcgacatgatgagggagctctgtgttggcctcgcccagtggaacacgagttccaccaactccacgcgaccaagatggaggagctgctccgtcaggtggccacggcagtggcgtcctcgctgcaagggataggcgggaagaaggtaggcatcatccaccactccactccacgctctccattctcaaatcctagtttgtcaggctctaaactcaacgagatgatgcgactaatagaggggcaaatggcaatgagagagaggagataaggtggcggcggtggtggtcggtatggaccagccaccagatgagaagtacagagggcactaggcggtaggccaccttggctccttactatggcagttggccagccgccatatctaagcaacgagcggcggcggccaagcaaagagggtggcctaaggaggtagaagaggcaccccgaccgtgcgcgaggctacaaccttgtgccacgctgcaccatacttgacccgtaccatgatctccagcggccatggcctcagcgagatccccatccctcctccgctaccgacactgacaccctcctcccgcgtttgcacgaccatctcgctcggacacacttcctacccaaccatatcttccttggccaccgatatcgtgtgaaaaaatgcatagaaaagggtagagagggataaaagaggatgggatattgggatgtgtcactgacgtgtgtgatctaccaatttttaatttttgtttcagactgaaatgccctgatatgtgggtttcacattgacttagtcgccacgtaagccgaaaaaaggcattatactatcgcagaacctcgggtacatcagttttacaagttgagagacgtgttatatctggttttgcagttcaaactgtgtggttcaaggccatgattcaaactcaacggtaggatgagggacctaaattgaacttattgcttttacttatcccctgtcatttatcaggcccgttgggccattggaatccttatactatttggtcgacagagcaaatggtaatgtctttttcataaaacgaactgtttcgtccaattcaatggtcattatccgaccagtcgacggtcagtgcctaccccatgtgcacgatcgagagcgattgggttaacgtgagaagctgcacggcacggcgcagcgggtgtggccaaagtgagttattaagccaataaaacacggtctaattttttttgagaggaaacacggtctaatcttagttggtagtactattagagtattattatagttttgtctattactccgtataagtcattacttaatgtccatgcattttttttcctccatccctctcttctaatatggcattaaaaaaggggcagttggttacttcgtctactatcctgatccacgtgtacaaatttgagatgaccgtttgttttgtaaacggtttttatatatctcctcatagattctgctgacgtggacaacctaagcaagccaatatcttgtcccacggataaaacctcctcactcgtcaggctcctaccgaactcgtgccgaaataacctacaccaagaaaaactcgacgcgacgtggcaggacgactcacgatgagccgaaccccaaagtgccaaacacatgtaacctgtacaccttagctcagagatctccaaaatctgcctcccagaagcgatcctataggccgggtcggggacaaagcttcagaatagcgtggggaaacagaccacggcggaccatgccacgctacgccgacaccgtagtccgtaaataccccctccctttacacgagatccacatggtcgtgggacacaaactatgcgaacgaatcgatcaagcacccttctttaatcaaaagtttttttttaaacacccgtctcgatctcaagtctacccctctttcgtctttcccgatccaaacaactagtagttttgtactaatccaaagtcgtctccaataattatccattataaaaggaacgcaacacacgcactccaggtaaaccctacgactccagctaataaacgcaaaggaggaaataaagcgaacgggagcgacaaggacggggaagattcgtgccccgattttttcgtgttcgagacgcgcagggaggggggaagagattgaggtggtgggaggatcggaataggatctggtgcccccctctcgtcgtggttgcgctctcatcaactcgactcgaccggtaatcgatcgcgactgccgccaccgcaacattctcatttctctctctcgtccccgccccacccccacccaccacaccacacccccgtctccgcgcgaaaattcccacgccacgcgcgccggaagagagggaaggcttttcctccgttctccgcccacgcgccgtcatcgctgcccgcctttcttcctccgctttgtttgggccggagcggggggcgcaccggcgccggcgacgtctctcttccgaatcgggtaagcgtcatctcgttccgatcttggatacaggttgcgtgagggagcttcgcggggcggggcggggtggggtggggtggggtgtggaatggggatttgaattctttggtttgatcttctcagttgcgccacctgcttcgggttcacgcctctctctctgccttgctctccgctttcccgcatgtgatgcttcctgcacgccttcgttttgttcttctcttttgctctttgctcttgcctgcacggttcgtcgtctgatccatccatacttttctgttggaaaaagaacgtgttgtttgaccaatcgaagcgttcgttctcgttttgttcttcgacttttagtttttatagacagctgctcctgcctggtggtttcctgtttttgatttcgtgctttttgttcctgatgatttgactcaggaggcgggagccagttcatggaatctggtggaattgatgctcaagtcagagcaatcgagcagcgcacaagattggagattcctatacgtgattgagattgcaaatgtggcgcctgttcaatgagttgtgggatgttctaggatctgggtttttctcatcgaggtttctttaatccagctcaaatctatttacacctcatccgtttgcaccgagatcatctctgtgtgtgtggtcaccgtgagattaggaggagatggacgaggaggattactcgtgggttcggcggacaaggttctcccactccgtcgtccgctccaagtccggcagggagcagttcggtgcattcgtcgagcagttcaaccgcggcgcggcacggaggcagagagggcccggttcagggttcatgctccatggcctcaacttggaaccgagggcgaggctcccagccaccacctcggcgaattcctccgttccgaggacgacaggatcgtcgaatgctcagccatcgtcggagacgaagccagcttcgtcgtcctcggacgccaaactggagcagcacgagaagagcctcaacttggaaccaaggacgaggctctcggccaccacctcggcgaattcctctgttccgtggacgacaggatcgtcgaatgcccagccgttgtcagagacaaagacagcttcgtcctcctcggacgccaaaccggagcagcaagagaagcctcgtgatcatcagccgtcgcaagaagtgtccaccaagcaggatgataaggctgaaaatgacacgaaggcaacagccacatctgggcctctcgagttctccttccatcctgatgagcaaaccttgaggctgcagagggcgtgttccagccctgttcctttcccaagcaacaagaacatgctggtggctgatgctgcagcacgtagctcatctctcaaggttgccggcgaggggccgaagccgaagccgaagcagagagcaaggtcccctcccctgcgtcgtgacgttcctgagctgttcaaggaggccaaatcgtcaagcaagaggttttccacaccgccaccgcgccggaagccttcgtctccaccggcgccgagcaggagccctcctcatgtctttgccacggcgagagcgcatggcaagccgaagcataagaaggattcctctgccaatggaagggcgaaggtcgccgcacttgaggtgctcgagaaatggaccgtcgatcgctcgcagctgctcatcgggcacaggttcgcctccggggcgcacagtcgcttgttccatggaatctacaaggagcagcctgtcgccgtgaagttcatcaggcaacctgaggatgaggaagatgcagagctggccgcgcagcttgaaaagcagttcaacacggaggtcaccacactgtcccgcctgaaccatcctaatgtcattaaggtaacctcatgaatttcgattacgcctgtttcaattctggagtggttgtggattagcatgaacttccgaggaattgcttgtagttagcactgttctattgacttatactgtactttttcgagctattttatttgggagtatttgcgcttagattctatttggatcaactatcaagcatgctagacaagatatgcaagatataaattatatacgaagagaaattatttaattgacctgtaaggctgtaattcgtggcttatgtatttcctagacagcgtagctagcttctgcagttcctccagctgagttggagtactttcctttttaccccgaagggcaagtattagtagctcacctaggagagttggtcatgcactcatgcatactgaatgtagtatatggcatttaatagttgtccctaatagagtaatagtaaatattgtgtgatttatgtgtgcactaaaagataaacgttactgtattcattatcgctgttttgtccatgtagctgattggagcatgcagtagcccacctgtcttttgtgtcatcaccgagtttctttctgggggttctttaagaacatttctgcacaagcaggagcacaaatctctacctttagagaagatcatttcaattggtttggatattgcaaatggcattggatatattcactcacaaggagttgttcatcgtgatgtgaaaccagagaacatcatatttgattcagaattttgtgcgaagattgttgattttggaatatcttgtgaagaagcagagtgtgaccctctggcgaatgacactgggactttcagatggatggctccagagatgatgaagcacaaaccttatggtcgaaaggttgatgtttacagctttggccttatcttatgggaaatgtttaccgggtcggtaccttatgaagacttgaatccattccaggcagcttttgctgtttttgataaggtatgaatttgttttcctgttcttatctgcatactgcatgaggaccttttgctgtttttgataaggtaatacatgttcagttgcttgattatcgtctcttcaaaacgaagaatcattgcataagataaaacatgttgagtcgtttctagctagtcggcctggtttagttcccaacttttccatcacatcaaaactttcctacacataaactttcaacttttgcgtcaaatcgttccaatttcaattaaactttcaattttagcgtgaactaaacacaccctaactgtcactgttgactacgaccatctcactttgatcacaaattacttttaaatgataatactatgatgtatgaaagttttatggttatatttatgatatttcaagcttcgataaacatgacatatttgcacgtatctataatttgtttgcaaaaaaaagagaagcggtcaaagtttaaacataaatagtaacaatgccaattatttgaaaacagatgaagtaacaaccaaatatatcttcagttccatgatcctatggctatttgattttcttttggaaaatgacgaaaactccatttttcagaacgagaggccggtcatccccagtagctgccctgcgccactacggcttctaattgagcaatgttgggcctcgcaaccagataaaaggcctgaattctggcaaatagtacagatattggacaagtttaaggcggttctagataaagatggaacactggacaatatgccatgcttaaacttgcaaggaactcatgatcacaagaattggctagctcactgggtccagaagctcaaacatacccatcatgatctctctggacctccgccaccaaaattgatgtagttaatcctctcccttccaaactatgctaatcggataggcctcagaatgtaactgtcaattttttgctttgttatataggaaaaatatatgtgtttgtcttcgcgattttatagcacagtaaacatttgcttagctttgctagtgacattttcttctttttgtttcgtctgttacactgtttgatacaagtgacagaaatgtctctatgcaattccttgaaaattgtttcttcggtttgttcggcctgtccgccacactggggtagattaggcctgctttcttgggcttttgaagcagcagtacatggaaattctagtagtctgtacgaaggcaggccattacagcctccagtaacatttcacatttttcttgtaacgtttcttgctttactcgttcaagcttctgagctactccctccgttcaaaaaaaaagacaaaccctggtttccgtatccaacatttgaccgtccgtcttatttaaaaaaattatgaaaaaaattaaaaagacaagtcacgcataaaatattaatcatgttttatcatctaacaacaacaaaaatacaaattataaaaaaatttcatataagacggacagtcaaagttagacacgaaaacccagggtttgacttttttttaggacgggggagtatgtgccttttctttttcttgtattagaagctataaaaaattaatttaacaccttcagtttgctgtgcaatctgccagtaccgcaatgtattttggttagtctttttggcttaccgcgcacctagcaagagggcacgatcctctgtaggtggatttaaattttccttccttgtactgtatttcaataccacatcttcctgatgtttttaaaccatgacctctgacaactgaataacttctgaattcatcgctggaagcgcgttcctcgatcttccatagtgaattcatcgcccttaacatgtgtgtgtccacccccgagcaccttattcatgaatcatgatattactcatgcagaattgcatatcttcggttttagtgcttcatatgattcatcttttgtctattgaagcccaattttatgaattgtccccttctttggagggccattcagcaaaaaaacaggctcatgaaattcgatttccatttgccatagtagtagtacatcccaattttgagcatcggtctctgaaatttgaacattgaccttcaattctaaaacctaaaatcgccggtacactcttctagctcatatagctcccgcagaacacaatacatacatatgcatacgtagacgcgaccgacatggcgatcttactcttgttgcgtgccataatcgacatgcgccgtcacgcaacctccacggcggcccgggcgaagtcaaagctgagcatggacgccctgaacttggtctgcttctccggcgaccagaccgccaccggcgccgccgccgcggccgcgacacgctctggcgtgccgagccacttggactgcatgtacttgtgcttcctccaggggcccatgtgcatgttgttctccttcatgcactgcttggccgcggcgcacatggccttgacgacggcgcgcagccggtcggcgcgtccgacgaacacctccggcagcgcggtcaccagcgcgcggtactccgcgctggcgcgggccacctcgaactcggcgcggaagttcagctccaccaccacccgcaccgccttgccgctcctcgtctgcaccaccacgtccacgtagctgtgctcgcctgcgcgtcacacgggaagaaaaaaaaaacacgtcagtttcgttggatccatcggccggcgcggcgcccggtttcggaatatctcgtgcaggttttggcagcgaatttaaacgtggtgtaattcctctggctcgtgcgagtttgacgctgacgtggcaagtcgtgtggcgactgttgcaagttcatctgtcacgagtttggatctactctttacgactttatgagcgtagctagaaataatagagacagtgacgggttcctgacattcccttggctgttgcctgttggttaatcatggaagtggaagcatctattgttttcttttaatcgtaggatgaccttgtccatgtgtgtcatgtggctctatggttaaacaagatagtatgcccgtttgttaagtagtaactgtttgcatttaaagcgcgagacaactattataagcatgcgaatatgctccccttattcaactctcataggaaaagatcctgatttgtggatcgaacaaactgttgaggcactgtacctcgcggaagcgcggaaagatcaaatctcttgactacaaggagcacccagatttgtgggacacggcaaacgtcctagaccacacagaggcacaggcagcaggctacacggcaaggcaagctgtgatgtgttttcttttgggactcagctgtttcgtgccgtctgaatttagcttcacaggtaaccgaaattacctgaagggatgtccggcgagcgcgtccacttggacttgcagatggcgctgttgtacccggcgtcgcgcagccgctcgtcgacatgccggagcgtgcagctccggcagtccccggccgccgcccgcctcgcgcaggagcagacggcgcccgcggcgcgcatcttcctgattgcctcctccgtgtcctcccgtatcctgctctctacctggctggtcttggccaaagcctcctgcacatccacgcacgcatagtctctctcagaaccagaagatatttagcccaaatcaaacaagttcaactgaaaatatcgtgatcacatccgtgttgcgtggatatgcatgtggctattggagtgtaagagatctctgaattaattctgttcctcacgaacgcaaatgtatagctgcgaaattcagctagcagaggggaagggacttacatgcagctgggagtgctggttctgccagaaggccttgctctcggcggcgccgctgccgctggagccctcgtcgtcgtcgtcgccgttctccggccatctctgctccctctcagcctcctcgaagaagccgagcaccaggttcgacaggctcatctcgccgtcctccataaccatgacgtgtttcagcagatcttttctactgctagcttgggctgtttgctcaacggcgctcagcgactcggtccactaggcaggcaaaggctgcctatatataaacctggagcgttaggggacgtggcgaatgggcagtggtggcggtggtgggtccggcgggtgggcccggctggggagcggatgaggcgattggggacgggcagtggggcccacctgttggttgggacacgggaacagcaaggatccacgtcaggcacccagccggattctttgcgcagccaattcgttcacgctgctcggccgttgttttcgatggttgggccttggggacttggggtagggacagtatacgacaaaattttgacaatttaaacttttataaaaacttattttaagaataaactgtgctaaaaacttatttcaaaaatgagccgtgacctcaacgccatcgggattggcgctgagatccaacatctcagcgctgactccatccgaggtggcatatattagccacgttataagaggtcagcgccatactctttagcgctaacctttacagtggctaaaactaagaaacggtgatttatatcttataggtatcgctggtgtagtggttacagaactgaagattgaagatcttggatttgaactctgcaacatgtacatttttttaatactttctcttgcaatctgctagcctaatttgctaccaagatcataagtttggcttatgaaaatcattttattctggacttgacaaatatgaaaaggatacatattataaaactttttagatatttccaattattatagagtaataattttataatatttttccaacattcaaaaattattttgaacttcagaaaatatgtaagaagaatgttgtgaatgttctcaaatttctatatacctttaattgtcatttatagttattcctagttgtaaatttcatgtatatcgtcatatgctttctaaatttatttttattttaataaaattgagaaaatatgttctcaaattcttcctactgataataataataatatacataacattaattcatattatttagttataagtttcgagcatggtagggaaaaaatgtaaaatagatgaaacaagaaaaatggtgctgtaccgtgggttcgaaccttggcccctctgtgtcggattagagcaattccacaactgagctatcataccatctagttataaatggagaggtttgattctttaacctgtacaaaagtcagcgccaaagaatatagcgctgacctctaattacgtggttaatacatgccacctcggatggaggtcagcaccaatatttgcggcgttgagatgttgtaactcagcgccaatactgatggcgctgaggttgcggcttatttttgaaataagtttttggcgcggtttattcttaaaataagtttttggcgcagtttattcttaaaataagtttttgtaaagggttaaattgtaaaaaatacaccagcatatggtcaacagagttatgctcttgccatgatcccatctgcccatgatcaattccaaataatggagtaatactctatcttatcaggaagatatctgatgtaaatcaaaattcaatggtaagcgcggagtgatgttaacagtgggaatcattgtccacacccttcaaccggttcacattctaattgggctcaccaggagttacagcacagtcatatctaacttgtactacctcgtaacacagtaggagaaaagttctacacgtgtcaaggacgtactacaacttcgtgctacaaaacgatggcccatcccatagtccatactgatcgttcatttactcccgaaaagggagaaacaggaagaaaacacacaaattttaacaatttgaccctttgcaaaaactaattttacaaataaaccgctgccaaaacttattttaaatctgacccttttgctcaacatcaaatcatgtggcgct

SEQ ID NO: 22894 - DNA, 48610 bp, Oryza sativa
atgtttgatacagcttcaactcctaaatttagctctaggagttgggtctggagtggagttgtggagctgcctaaacccagctctacaactctagtttattttgtgagagagctccacccagctccactcccagttttagtggagttaaaattgtttagctgagcaacagctctaggaagggtggagctggagctggagctggagctgtgccaaacatgccctgaagcttgagaagtcgagactcgagagacctgccggctttgcttctagtctgaaggctaacctgtagacttgtacagtacctcagttacccgggcccccgaacccccaaacccccgccgtctcccgcttccaaaaccctagctcatcgtcgtccggcggcggggatgccagggatgctgatggacggcggcggcgccatcgtgccgttctcgggagaaccaggccacgcggtggcggcggccccgcccgtgcggaacatccgccacggcgtggccccgcccatctcccgcgtctacgtttccttttctagcggcaacctcctgcaggtcgcctgcctccgcccaccgaatccggagggtggcggagaccgtggggcggagcaggtctccggggggagagtggtggaggtaaacctcggaggtggcggtagcgggcctggcggcgcggatgcggaggagatcgatgaggcggaaatgcggaggatcgagtacgggtcggtaccggcgtttgcgctgcttcagagcaggaagaacgcgctcgtagatggtcacggtacgttgcgcttgccctcagtctcgtagcgcgcagtatggtaagccattgaaatttggacggctttctgtgctgaatggtagtatttttagtctggactgatgattaatatggcattttggctgctgtataagactttagaggtctataaactgttaactaggtgataccctgcgcgctgctgtgggaaatgaagaatacaactttgaagcatgggtgaaagattgagatagaagtcaataagaccagacaacttttggttttgttcatgaatcatggggagtgtagataatagcattaattcaaattggtgatgactttgtttcagggcaatgcctatatattggagataaacttgtccaggtagaatataaatccaagaagtatggctattctcgttgtatgggtagaatcacccatcgcaccaatcacaggacagaccgtaaacttacgattcattgactggttgagaaaaaaaaaagaaaggaactgttcttatttaacagtcagctcttatagcaacaatgtctacattgtgcgagggaatagtccgaaaaagatgacaacaattgtagtttacgaataaatacacatcactacaaatataaacaactgctaggatacttatgaattccaattcgaaactatgaaaatttcacaagcaaaactgacgaacaactaagcagtatagctaattgtatgcttacactgggaactttattggaaggagggcatgcatagcttttccggaaagaaaactgtagaccattgacaacatatcattttaatcattgtatataagcatccttcgatgttctattatctgctacaaatttgtccttgaattagcacatacatcattgactcatccttcttggagcacagccataacatatttctatacctgcccaagaaccattaatatttaaatcagagtgaaataaaaaaaggacttaaaccaatcaaatcatcaaaaagctatcttgcggttgagagaacagcggaaggcaaaataatctgcaggttgtacaaaattgcttttaagatcagcatcgaatcaaaagtaagagtcaaatgaaccgatcaaatcatcaaatcaaatatgttatcacttattcacttatcacctggtggatagaaaaagcaatagcccttggggggaaaaagataatactgtaaattaatatgaagatctaatgagaaaaaaatgatagcaaatatatcactcaccatgcaagagctgatgatcaaatatccggttggtctacaaaagagatagcgctggtatgcgtggctgcaggactgcaagaggatttcaaagatgctttggaagagaataaatctgattaaccatgacatttggtctcgctgctataattatcagaggcagtttctgctgcacaattgcttccatcgtaatgggagaagtagatgcggcaggctaggtgtgaaggggattggatccactaattaagaatttgtaggattcagagataaggggactggtccgaggataatcgtttagcgtcttgattatatctaatggctgagataattgtgatgatgtggcttaacctggtggctgctttgtagtagtaattgcactaagtgggttccaactatatagaaagaaaggattactgcccaagctatgcttgtactgggataggcatgtcacatatcgctcagaattttaagttttagcaatgctttgttatattgtttgtgttcgatagctatccaactattcagataccctttttcatattgtagaagctgaatttgtagctcttaggcttccgcctaaatggataaatcgacatatctgaagtacacatatggttaaattttaaacatctgtgccaaagtggtattataatcactgtttatacagttaatctagatcaaacctctgcctagtataagctatccattttttccatgtgcttgcttctgattctactatgttttgtcaggtggcaatatgtgcttgaatacagtaaaaccatcggtagtctccttgggaacccagattctctttctgcttacatgattgatgacccaaagatgatccttaaggtgaccatatctatgtgtcacattgtttcctgttttcttgctttgcctttgtttgaagttaaatttacttttttgcctatagaaagtaattggtatattttatcttgcaggtcaaggagaagcctactagtttaaaggctgcgtgggagttgctagagatattctttgttgataaacagttgcaaacttggcttccagagcgtcttgttgattggttagccgtaatgctctttctttgatctattgctttgtttcaattgtgagcggactttgctgttacaatacctaggggcgtctcttatcaggcttcctgtggttttaggactatgacagcctcttgaccaagacagagaacacgatatatcgcacgctgatcaatttccagaaaaagctcatcaacctgcaggtttgactcattatatttgttgtagcatatagcattagacgtcaaatttgtacctctcaatcattttatttgttcttttctctataaaacttctacaactccatgctttgagttgattgttttgtagtctattttactaatgttcatttgtgctacttccaaccattgattcaatagcagtaatgagtataaatgaataatgagtgatgctctataggttgttgaagatgatcctgattattggagtggattatcagcagctctatcggttggatggcttgatattgtggtaagctattttcttgcacgctattttatagacatgtcagttttgattgaatcctacaatcagaagttgttttttttttcttttaggtgaatatgctacgttttcatggatcataccaattggatcagatggacagccgtgaggtagttaggttgctttgagaccattctttatttcttcatgacttgcatctatcattcacataaaaatcattttatttgcttcaagggcttaatttgttatgttttctagtagtatttacagtgttgcactaatcttttgaaataaagaaaatgtgctatatcttcctatagtgtacctgattgtatacaattatatttcgttgtagctttgacaaatatgctatttttatgtcaccagttgatttatatacacttgcttttttaacatcacccttttcccccattttggtccatcagacagaaaatgggttggttgaagctgttgctgttcttgtgtcaacaatgccacgcatgcgaccagatttgccatcgggtaaattaggccagtgttgtaaaacaagaccagattttataaaggtatgttttgtgatgcagagttttgatgcatagaacattttgaatgtgtctgtctgatgttttgactttctggctgcatatccagtagtgcaaatctatgtttctgaagaatctaactctcttgctatgaaatgctatcattatttgattatattgattttaccctttttgctgccttagcacgcaattacacactacgctgtttgcctttcatgaccactaattcactatgatcttctcacatgactatcagtacactgcttattctttattagcccactagttcttcatttcaatgtatgccacttgtgcaactatttcttcacagtaaagcataatatttctttgtgcttctgatatattgtgaaccttctgaattcactccactggattcaaatgagagctgctctactgtgctcttttgtcactgattgctgctgcatcctcgggctgctgctggctttgcacccaccaccattgttccactgctcatctatgctgagagttactgactatgttggctgaactttgaattttgcacaatatgttcttttgtgattaataattatatgtttatatcctctcaagctcagtagcataatggttacttcaaaaaaaaaaaggaaggaaagggcagtgaaaatttgtgtaaaaacttgtatagtttcctgcccaagtgtttggaggtacacagaaattgtattgcctccattgacgtcagctaaaagcatttgccaaattgtattttttacaggcattggaaaaatggcgaggtcaagtaagtaaactggagtgcagtgcattctggattcagtgcggtcaccaaaaaactcgtgatggtctgaagagtttgcttcatattatgttggggaacataaagaacctcactgcttctacttcacattggctggagctctttgcttctcatttactttatataaggccattcacagtggttagtcccatattattgtgtttgctaatatgttcttcattataatgctttcttgtcgattcatttatttgtcaccgcaattttgcattttgcagctgctattagagcaatcccctcgctagagagttcatttttagtttgttattctttaatctgtgacatgatgaaattacccattatatagaagagaatgctagatatttttaccatctcctatctcctgtaaaaggtatccagtaattatggttattcatcttgagttgtcttgtacaatagaacatgtttttatgttggcagatgtttgccttactgacccgtacccacttatttcttgtgtgatgtaaacagttagtcaatatatatatgtggcaacaatttttttgaaggggagtatatatttgaacaatcaaaacctcttgttatgttctgctaaaatctatatgtttgccagggttttgaagggatgcatcagttagcacaaaagtgcatacagcttaaaccgtctgctgacaatagcggattgacaggcctccttactggtatcctttcagaaaatagagaggttggaacacaatgtgatcatccattacataggcccccaaatttcttatcctttccacttttcttgtttgtgtgacatttttttttcttttctaacattaggttgtcttggctgaatgcacaaaaaattttggtccttggtaagatgtattgttggccatttgatttatgctgccaactttgaaacattgcatcttaatgtgttttgccatttgtaaatgcaggatggtcacacatgctatggagctgctgactgctgacaatgactatgcggatatgatgttgcatgaagagaggcctaacttcggtggtataagcatagaggagctgcacaggcttgtttatgctcaagttttgtgctctcatgctttaacatggcaggtatttttttgtagctttgtggattgtactaggcagatattttcttgagatgacacttggcctgtatgaattgcttgctacgcataactgtgacgttcttttgcgtatgactaccatgctgtttgttattatccattgtctagctttttgttgcagaacctctacttttgaacaggtgctgttatctgttaatgatagcaaatttttataatttgataattgttattaatggctggcttgcctatttgattctcagattgcaccaacttatctgtcctcatgtctaaaccaaggcctagggctgttggagattctgcttctgaagcaacccatacaagataatcgtgttgtattgaaggtactttgtattgatatgcccttgaattttttctgcacctttgctttttgttacctaatattgttgttgtgagcagactttggaaatttgccgcttgtatgagctggagaatgttagtacaaatatcatgaaggtaagatgttcttcccaatgcatgtacacctgtacttttccaagatttcaaaacgaagatttcttggagttttaacctggcttagttattatctatatattcaaacttaccagcatgcatattttattgtacccacctgtcgttttgactcacgagtcctatctattttttcttctagattgctggcatttatcattggaaacatggtaggaaaggaactggagtttactggttccagcaagctaatgataaagttcgtcttgacagaattgctcaacaattattcgaacatattggcaagtcggtcacagatgatagttttaaggtgccgatttctgctcctccttatgacctatcttttgtacacctgcagttagttctgagtgtactagtaaccaagaaatctgatcaaaagggagatctttttcatcaagcagatatatcgacaatgtttttgtttatgacatttgctaattataattttgtatggtcagcaatgggaggggctgcttgagttactaggttctgacatcggtagtgcaggtggtcttgagttccttcacaggtattagtcccctttccatcaatttctgtatctcttctcttcatgagtactaaatttcgtttcaacatatgcttgcacacaggtaccgagatttcaaaaggtcccttcagatggcacaagaaggaaggactggcgagtctgttcggcaaaccgtggagtttcttatacaggtgaaaatatttacaccttggctgggctgtcgtcctgcaattcaatttaacaccgcacagacagtgctgtcagcctgtcaatagcttatgcaccttgaatgactcttgataaatcaaacttaatatctatttctgtgcagctgatgagaaatccttctacacctcaacgtttctggctaccacttttacatgactcggtaagctagtcatatgtttacttggggtgttcagcaaagcagctagctaaatcttctttttgcccctgttcaataatttaatctgtatcaggcttttgattctgtttctatccccggttgtttctgcaggtgaggcttctcaattgcaaaccctgcccattgttaaatgttgctgaaacgactttgttgctcaacaagctacaagaactgtcattggccaaacttcggcctgacttttccaacattcacctaccaagccatgcattgaactccgtcagattagctctagcatcaaaccttgcgcgtgcaattcttgaagaaccttaagtaatagttctatttggggtatgagtgccacatccactttgctggaagtttgacggcgttaatcgtcagttgattaccagtaactgtatgttccttgggaagaggttgaacttgtgttcactctgaatgagcaaaggttgaacttgtgttccttcatgaatgagcaattgtgtcatgcatgtatatgtaccggacattgtatttttagctttagtgataccttagatgttacttatgtacaaagaaatgctagtaaatgtattttagaatgggcacaatattgtattccttgtttcttcctctatttcttttggggtgaataactctttatggtgactaatcctagacgttctggactaataagcaattgtagatcatagagaaactgaagagtgatcctgtaagttcagtagttgggaaccgtttctgggagctgcacaaaatgttgaacaagaatagaaagggcaagtccaaagctgttttctgttctattttgttattgagatgcggagtagagcaaaagggagccaggcgttggatcgtgaagcttaaaatattaacatgtcaatactgaaaatatatttgttgcatttgattgtgctaggtccaaactatatcggtatatagtttaagtgatatagttgtatataaaatatttgtgtcacgttaattgattctctttgcaaatcacgttctttgtagaattatggggaaaaaaacacactagttgagcttatatataaaacaattgtcgccctgttcttttcatctactctactaattgccgcagattatttactgtacacctaaaatgtagtttctcaaaaaactttcttctatttgtattgtatagaccacttgttttatgttgtttgctcagtttgtcttagaatatttatctctagaataaactagattatttgtggcaataatttggtgaataatatatttcaaaccaaggcctgtttgatttatattatttagaggattgttatctgtcgagggaagtccctcgatagcgggaggtcgtgagagcctccttttgtgagttcggccgggggaagaagctcgcctcttagaaatcacgtatccgcccctaaggctgctagctagcttgtacacaatcgaattatacaggttcgggccgctgtggagcgtaataccttactcctgtgtttgggattatggttgagtgttacaagggttccttaactccggagagcactctcgctcttcttctcctagagttcaggttttctgagagtcgtcccctttttcggtgggcaaggtcctccttttatatctcaagtggataccacatacaccgcctctacctactcttctttcgggtggggacccaccctatcttgaccgggactcgacccgtgccttcgtttggaagcaaagccacagcttgtccttgagtggggcccaacgccgtccctcgcttgacatgggggacaaccctgtcattcccccattaatggatgaagacttgtggtggccgccgtccgaatgaccctccgatgggacgggtcatacctacccccacttcgccgggagcagacgcgacgtgggagctcggttgtcggtctagtcagacgtgaccagaatcatgaccggtcacaaaccggtcattctttgattatggcgcgtcagattcgcacgccgcacgtctgccttactgcattaaatgcggcagggggcagttggggcattgtgtgcattaatggaggctcagcctgggccccctcctcgctagctccctctgccacatggcggctgggcgagggcctcggggcgaagcggtgcaaaggcccgaggggcatgacgtggcaccccgaggccccgacccctctccggtcgctccagcgatccgcgggttgcgggggcaagaccaggctgtagggacacgcgacaggacaggaaggtagattccccacgcttcacatacccccagacccatatctccgacagtagcccccggcaccatatcggacattggcctcctgaggtcggtctgatgtggtgcctcacgatttcccaagctagggttgcaggctcggcaggtaatctaagggaaaactgccgagtggccagactggcgtatcaaccacagcagcggtttggctgtcactgaccgcgctgtcgatgaggatgtctaaggcgcgaaaattggggggtcggttagactacgcctcaattccctcgctcgctactcatgcggcggtagtggcgacggttcgctcaggttgcgcccgtgaccgttgcgcgccctgctccgagtgtgccgctgataggcgcactaaatgcggggcgcggattcagtgggcgacgtgatgagtggacgcaggaaacgaagagacaaccgcgggcgcgagaatcgtgggggcaatcgtgagggcgtgaaacgaggaggtgagcgtgggtgaggcgaggataaaaggatacggaggcaggaactttgcccccttcctttcgccaactgcccactcgtcttctcgctccttaagtcctaacattctcgccacttcgcactattccgcgcaccaagcccttcgccgtttctccgccggccatcatggctcaagacgctggcgacacagtgctcccggcagcacgcattacggtggataggcaccttaacctcccccgcaagatcatgccggacggcgccgtcgtgagggcgagggagttgcggccgcggccgcggtatccggagcgatctgtgcacctcttgtccttcgctatggcggggttgattccaccgttctccggattcttccatgaggttttggatttctatgaaatccacaccttgcatctcgcacccaacgccgtgatgacgctggctatcttcgcacatctgtgcgagatgttcatcggggtgcggctgacgatgcggctgttccagtctttcttcatcccgcagctgctgcaaggtgcggtggtggggggatgttacttccagccccggccaggcacggcggggcaatacatcgagagtcatctccgcaagaaatgggaggactggttctacaccgcgctgccggaccacccgcgacttcggattcccgctagtcctctcgaaagatccgccgcatggctggcggtttcggagctgggcgaggagtacgacgcggtgtgggatcgccttaggggcctgcgaagcctgggcctcacaggggcaatggtctttggtgactatttccgccgccgcatcgcacctctccaggatcgatcccgtggcgcgtgggagtacacaggtcccaacgaccccatacgcacgcatgtgggtgagcgctgggactgggggaaggaggacgcgaagatggtgattcggcgggtgctgggcctagactccgccgagcaaacactgattccagacgggatccttcccctctgttgcgaccgcgatcgggagagcatcctggccgtgatgtcggtcgtcggcgccggcaggagccggtccagccggggcggcacaaatggtagcgctgccggcgtgggtggcagtggcgcgaccacaggcgggagtcggacgagcggacccggcgggggtggcagctccagggcacccggcccgagccgcggacccggggacgactcgaccagcgacccgaaagggaaacggaagatgcccgaatctcgactgccctctcccccacgtggagggggcgccgagcgcgtggcagaccgtccgccagcgggccacaagcgccctgccgggcctgaggccggacggaaaaagaagcggctccggaagaaggacaaatggagccgtgtcgggggagcttcattgagcccccgaagtggactttcaatcgccctccccgcaggtacgattgccggcacccacttcggtgcttttacccagctcggtctgttgttccctccttttctttttcttcgttaacgcgatctgggttctcttgtagcgagattccttcctagggggtctcagggtccgacccttcgcaggggaccaaatccgaatgatcggagcggcccgggcttggccgatccaaggccgcggggccttcacagcctctcggcggggcccacagaccacataccgggtccgaccccgagttaaccccagccaggactcgactcgcagcgggcgatagcggtggtgatgcccctcccgggggcagctccgagaccagggtccatgcggagcgccacccgggaccggggggcgagggaggtcgtggctcggaagccgcggccagaggcggccctgagctcgaggtcgagaccgaaactgggggcgggcccgagcccgaggccgaggctgaatctacctgaggacccgagacggggggcgagagggacggccgctcccccttgcacttggggcgccctcggggctggttgcgcagaagaggggccgagagcagcccccagtctcgcgggggatccagcagcactccgtcgtcccaggggcagaccacgaccttttcttctccaactccggcaaatatggaaccgctcctgcaggtgctcgccgccgccgattccaccgtccgggaggggctcaacgcccaagttcaagccctggcggaagagcgagcagccctggaggcagagtgggcacagcttgctgcggaccgcgcgcgggttgacgaggggcgccgcgccgtggacgacatggtgaaggtgggacgcaaaatgcgccaagcccaattggctgaaattcaggcgcgcgaggagacgctggactccgtcatgcgggagacggaggaagagcggcaggcggcactgatcgcctcaagcgtcctggacgaagcgttgggcgacatccgcctacagtacgagtcccatgccgaggacctggtgaagagggtcaaggatgcccgcagtatcctcgacgcagctgctgcccaagaacggcgggtatcggaggccgacacgtcgctgcgggcccggacggcggcgctcgaggctgaacacagggccttggatgagcgttcccgctccgcgcaggagttcgagaccacgattcatcggcgaatcgaggtcctcgaccggagccagcgcgagcagaacgcgcgcagccaggagcaggcgtagcgagcccaggagctggagaggcgggctcaggcgctggaggagcgagcgcgtctgctggatcagcgggagtccaccttggccgcccacgagagaatggcggcggaggtggaggcctcccttcgccttcgtgaagaggccgcagccaagcgtgaccgggtcaccctcgtcgcgaaagcttcagcggaccgcctcgcagaggagctacggcttcgggaagaggcgtgccgggaacgggacgtcgcactcgccgagcgtgaagccgatgtgaaccgcgatgaggtggcctcacaccggctgggcgagcaactcgcgaaacgcgaggaggccgttgccggacgcgcggcgatagcggcgagggcttctgagctggaggcccgggaaaaggacctagcggcgggcgggcagcccggcagcgcggagttggtgagccagcctaccacggctcagagcactctcgccgacctagagcgcttggtgcaagatcaggctggggagattgcggccctccgcctcaccaacgagatcggacctgggcagctctccgatgccgtcgatcagctggagcgcgcggggcgccgagtacacagccagcactcgcgctccggctggacgggctggcagtggatctggagaggctggaggaggagattggcgagaccgtgaaatcgtcgtcagcttccttggcatgggccgcggtggaactggtcctcgcgagccaccaagcgcgcaaccccgacttcgtcccgtggcgcgcactcgaggatttccccccggggaccgaggcaaaggctcgggagcaagtccgggagacggccgacgcgattgtctctaacttcgaggggtcggccccccggttcaccttcgggcttgcctcgaatgaggagagcaggagcggagacgatgatgacgacgtcggcggcgaggactgggacgacgtcgttagcggcgccggcctcgggggcccgggcactccgtgatcattcgcgctttttatttccttttgttgtgtgcctgcaacggacacttcttgtatttaggccatcgtgccgtcttatcttgtctgtaattaaagcttccttttcacactttgtacgcctttgctccccattgaatgcctgcggcacagaaagacgaagaaacaagagcaaaagcatataattaacctccctgtgaacgaaatgccgctcttaccccatcctccccccctcgggctcgttctagcgaaaaggcaaatccgtgctcggtccgtggtacctaagtggtgaggggcaagatcatcgccccgagggagccgcccagcgggactggccagaccgaggctacaacgaccaggggtcaaggacggccgtgtgtaggcccttccgagcccccggggttcggcgcaacccggggagcggcccgtgtttgggctctctttcgacggtttttaggtcgccccacggcacttagggtctggagtaaacccgaactgtcctttgaaccaggacaagctagaggaaagagtaagaagaaagggcgcgtaacagcctccacattaaatggaaaaatttattgcttggaaagggaaaaggatacacaatggtagcccctggccaagcccgcacaagccgaggggttgtgcgggggttggcccgagctcttggaaagcaaaaaatctcgacgctatggatagaagcgacagaggtgttcgatattccaggggttaggcaactccgtgccgtcctccgtggttagtcgaatggagcctggccagggaacgccgatcactttgtatggctcttcccacattggcgagagcttgctcagccccaggcgcgattgcacgcggcgtaggacgaggttgccaacttgtagtgaccgggcccggacgtggcgctgatggtagcgccgcaggctttgctggtagcacgcggtacgcagggccgcacgcctcctctgttcttgaagatagtcgaggtcatcgcggcgaagaccatcctggttggtctcattgtacagcgcgacgcgaggcgatcctagggaaagctccgaaggtaggaccgcctcggcgccatacaccaggaaaaagggcgtttcccccgtggcgcggcttggagtggtccgatttgcccacaacacggcgggtaattcctcgagccacaaatccccgtgttttttcaggacgttgtacgtcttggtcttgaggcctttgaggattttggcgttggctcgctcaacttggccgttgctcttggagtgggcgggcgaggcaaagcacaatttgatgcccatgtcgtcgcaataatcgccgaacagctcactggtgaactgggtgccgttatctgtaatggtgcggttgggcactccgaatagggacgtgatgcccctgatgaacttgagggcggaatgcttgtcgatcttgacgaccaggtaagcttccggccacttggtgaactagtcgatggcgacgtacatgtgctgatacccgcctcaagccgccttgaatggtccgaggatgtctagcccccagaccgcaaaaggcaagatagtgggatgacctgcaaggcttgggccagctagtgggtttgcttggcgtggaactggcatgccttgcaccgccggacccattcttgggcatcttgcaatacagtcggccagtaaaaaccttgtcggaaggctttaccgaccaaagttcgtgaggccgaatgggccccacactcaccctaatgggtttcagctatgagctcgatgccttgctctcgagaaacacacttcaagagtatcccattggtggcacgctggtagagggtcccttctgcgaggacgtaccgcttggatatgcgcgcgagcttctcagcttctgcgcgatcctcaggaagagtattgctgtcgagatacgccaggatgtcagtcatccaaccgacctgacgaggggggtcggggtcgaccccctcgggccgcgggtcgccaagggtcggggcggagggcgtgtcgtcggggtccctcgaggggttcggttgcgccgatggctgcgcgagtctttcctcgaaggtcctcggggggagtggggctcgtgccgacgcaacacgcgacaactcatcagcaaaagtgttgtcgcgtcggggcacgtgccggagctcgagtccgtcaaagtgacgttccatgcgccgcacttcgcggacatatgcgtccatttgtgggtcggtgcactagtactctttggatacttgattcatgactagctgggagtcgcctaggaccaggagacggcggatgcccattctggccgccgccctcaatcccgcaaggagtccttcgtattccgccatgttgttcgtggctcagaagtcgagccgaacgacgtacttgaggacgtccccgcttggcgaagtcagcgtgactccagcgcctgcaccttgaaggttgagggaaccatcgaaatgcgtaacccaatgcccgcaacgaatgtcggcgtttgggtcctccccatctccgagaagagatgggacgtttggtggaacaggttcgtccactggggtccactccgcgatgaagtcagccaggacctggcttttgatcgcgtgtcgtggttcgaagtgcaaatcgaactcagccagctcgatggcccactttacaacctgaccagtgccctctcggttgtgcaagatttggccgagggggtaggatgtcactatagaaacccgatgcgcttggaaatagtggcgcaatttccttgaggccattaaaaccgcataaagcattttctgggcctgtgggtatcgggtcttcgcatctcggagtgcctcgctgacaaagtagacgggccgctatacctttcggcggggccggtccgtattgtcaggggcagatgatctggggctcccttactcaggggccccgagggggtctcgagccatgtcgggatcataggcctcgggaccactcgccaaaagcctcccctcctcccacgggggcctcggggtcctcctggtggctaggggcttcgggcaccggaccttcgggggacgaagggccatcgcgagttaaagggacctccggtccgctttcttcgcactcgaccactagggcggcactcaccacatggggggtcgcggccaagtagagcagcaactgttcctccggccccggggctaccaagatgggggggggaaggtgaggcaagcttggttgaaagcttgctcagcttcctccgtccacacgaacgggccagagcgcttgaggagcttgaataggggtagtgccctctctcccaacctcgatatgaatcgacttagggcggccatgcatccagtgacgcactgcacatccctaagcttgctgggggcgcatcctctctatcgcgcatattttctcgggattagcttctatgcctcgggaggagactagaaaaccgagaagtttgtccgccggcacaccgaacacacacttatcagggttcagtttcacgcgcgtggacctaatactgtcgaaagtctcggccaaatcctgcagcaacgtgtcctggtggcgcgtctttaccaccaggtcatcgacatacgcctctatattacaccctatctgattactcaaagtaatacgagtcatgcgctgaaaggtagggcctgcattctttaacccaaaaggcatagttgtataacaaaaagtgcccacaggagtaatgaaggcagttttttcctcatcttccctagccatgcagatctggtgatacccagagtaggcatctagaaaacacaaaaggtcgcaccccgtagtggagtcgactatctgatctatgcgtggtagagggaagggatctttagggcatgccttgttgaggtccgtgtagtcgatgcacatccggagcttgccgttggccttcgggacgaccaccgggttcgccagccactccggatggataatgtcacgcccagaaattcactagtaatttccgaactaatttgtgcatgaaatcctcgtccaggaatcagccgaggtacacaaactgacaatttaatatacatattcatcataataataacgttacatacttataaaagaaaagaaaacaacagcggaattacggtctagcgaagctccggctccactcccacaggcagctcaactggggtataagccaaacgtcttctccttcgcaacttgtcttccactgaggtttgattgattattgcaaggtgagcatatgacatactcaacaagccacacaacaaatatgcaagtgcacaaggataccaaagaatggcataatatagggcttatttgcaaaagcagcatttagcaaacatttgagatttgtaaaacagtagagtaattaatcatcaatattaatcaacactgaacagcacacccatgctgcacaggcccaaccatcctgaacaaccatacccggctgtatagatctatctccaaaccagaaatgtaccattccaaaccaggagctaatcaaattattaccagttatagcatcatttattatggtgaaaagtgtgaaactaatcacgaaagacattgttagacctgcccataactgcgggcacggctattcgaatagttttactctggccagaggtgtaccactgtacccacaagacacagctccacgacatgtcaccatgcgcctcaataccaccacggtacctcggaaaggagctgtgacagtacccctcgcataacacaatccaccacagcgcaccgttcctggatcataatcactcccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgagcacgaccatcaaaaccatgtgctcacaactcaccattaatcatattttaattatcaattaattatcataacacgattgaccatcgtgagctaccattaaatataaccataaataataatgtagtatgattcatcccattaatgaactaatgtttctaagcacggctaagcaattatatatatagcatttagctgaaccaatccaatatataaggtccaagctaataaatttattacccataggaaaataaagtcatcttcggccataattaattgggaaaggctcaccacccgatgacattcgaaaataatgcatgagttgaaataaaacattagctttaaataggttcaacatgctcaaagggttgtttgggatctgtgtgacttgccttgagcttccgcaaacgcttccgaaccttcctcaacaaaaacgctctcctccggaacgtcggaaactaaagcaaaagaacaaaatcaacaaaacagtacaaaaacaagcataaacagtacatgtggatatttttaacatgtagatctcgattttagatgaatttagcgacttgaaccactcgaatccgagttacgatgatttagttatgaatttccgaagtttaatcgattttcatctaatccagaaaattattacgaattaaataaaagatttatgacgtcacgatgacgtcatcgccggcctagcactggacgacgcggccaccggcgatagagagctcgaccgggctcaccgaggacaccaacgcgaagaggatgacgacgcgaactcaccggtacaaagaacaacgacggataacgacgaacgacgaccggcgacgaggttcgacggcggctcggctcggctcgggtccccgacggcgacggcgctccggtggtcttcggcggctgcgaaggggtggacagggtgctcctccgccgtgcgaacccggtggcggcgacagatggcgacggtggctatggtagtggaacggcagcgacttggcacgcacgagcagtagcagcatggctgtagcagggagtggcacagcgacggctaggcggctagcgcagcggcgacgctagggcagtagctaagcgtggcacggcggcggctactcgacgacaaaaacgagagattaaaaactaaaccgagggaacacggatagaagtctcaccgaaccaaagcgatcagagagagagatgacgacggtgacccgacgacaacacatggagacgacgacgatgctagacaaataacggattagattgaattaagaccctaaggataaagtacaccggtgaatgacataggagcggcggttgccggcgaaccacggcacaataatgcaaacggagggcaccgggagaaagaggaggcaacggcgatgcttaccaacacttacgcagcgatgaacggcgaaggagatggccggcgatgactttccggtgatcttcggcggatgacaaatggcggatgggcttctcctcgcagctgcaaatccaatggagacgacggcgaccgaaggcgatgacggacgacgcggttggaggcacggcggcgctccggttcacgatgacggccaatctccggttggatttggcgcaaaagaaccagcggccgggatagagctcgactttgcggagccgagggaggtggtggagctgatcggcgacggccgaggcgacggcgcacggcggctggaacggctaccggcggcggagagagaaggagctcgcggggagggcgattccgacgacggtggaagatgagacatgaggggataggtagaggacgactagggggtcctttatataggcacgggagctcgggtccgagcccaaatcgactataaaactcgggaaagtctagggttctcgccggagtaaggaaagattgaaccccgaaattggaaaggatttccatagaaacttttggggatttcttggggaaaaggaagaggagattgagaggattccattcccgcaactaatttggaaaaaggagcaacgaggtggccggattggtgggaggaggcggcacggctgcacaggcttgggacggctcggtcactgtttggaggttgaagatagagtactgttacaagggttccttaactccggagagcactctcgctcttcttctcctagagtttaggttttctgagagtcgtcccctttttcggtgggcaaggtcctccttttatatctcaaggggataccacatgcaccgcctctacctactcttctttcgggtgggaacccaccctatcttgaccgggactcgacccgtgtcttcgcttggaagcaaagccacagcttgtccttgagtggggcccagcgccgtccctcgcctgacatgggggatagccctgtcattcccccattaatggatgaagacttgtggtggccgccgtccgaatgaccctccgatgggacgggtcatacctacccccacttcattgggagcagacgtgacgtgggagctcggttgtcggtctagtcagacgtgaccagaatcatgaccggtcacaaaccggtcattctttgattatggcatgtcagattcgcacaccgcacgtctgccttactgcattaaatgcggcatggggcagttggggcgttgtgtgcattaatggaggctcagcctgggccccctcctcgctcgatccctccgccacatggcggctgggcgagggcctcggggcgaagcggtgcaaaggcccgaggggcatgacgtggcaccccgaggccccgacctccctccggtcgctccagcgatccgcgggttgcgtgggcaagaccaggctgtagggacacgcggcaggacaggaaggtagatttcccacgcttcacatacccccagacccatatctccgacattatcgtagattatcaacttcattatagtgataaataaaatattttaagaaataaactaagcaaatagcttatgtaagtaatctaaatattacaatagaagaaatatttttaataaaacatattatttgagatgtggagcaaataatcaatttcaaagttcagctgccactgcttctgtacaacagtgaacggacataatcaatctgaaattggcaaacatgtctgatgcaatggcccagtgaccccagtacatgcaaaaacgtactagtacgtgcacgagatatcttcgatttaaagagcacaagatatattcactgtactacaaattaaacagcaggagtacgaacaatcgcaacggagggtttatgtacacattttacacatcatgtgaattactacagcctaacacgtacagatcgctatagtttcatttccacgtatattacatcttccggtacctcatacatcacgtactaacagttcaccacgtgcagcgtatgtatgtctttctttccttctgagaccacctaccaaacggtgactgcattcatgctgccattttcgtagctacaaatccaagcctccacttgtactgtgattcgatgcgcagacccaagacgcaagcagcagagacgaatcagtactggcggtgacatgttgggatggaccggcgtgtgtgttacttgctgttccttttcctgggcacccagcagcagtgcaagccgtagggcagcccgtacgggaacttggcccgcgcgacctcctcgaacgtcttgccgtccagcaccagcgcatagcccgacccgtccttggcgctcaccatcgatatcgccacgcctgccatcaataacagagttggtcaagttattacaaacgaaacgaggcaaagccaagacgtacgtatacgcagccaacgaggagagatggtgacactaaccgtcgtcttcctcggtggcgccggggcgtggcacgaagaagggctcggacggcacggagccctcctcgtgccagttcttggccgtcctctccaccaggtcgaccttggtgagcgtgttggggaagttgcacggccggcgggcgccgcaggcgtaggcgtaccggtactccctgccgacgtgcgccgggttgatgctgcacatgtccatgccccgcccgtgctcctccgggtccagcgccgtctccagctcgccgaactggctcccgtccagggggatcctgaaccgccccaccctacacatggtgttccccgtcatccatcgtgcatacgtgcatgcgtagcgtagcaaattgacggcgggacgtcgtcgtgtggctcgtgtgtgtacgtacctggcgtcggggaggacgtcctggccgctggaggagcggaggttgtggaggcggagcttgtcgaggatggcggtgttggcgttgtgctcgcagcagtcggcgatgatcgccgtcacgcgcccctcctcgtccgtctcctcgtacgcgttgatgaagtggaacgtcacgaacggcggcacctccacgctcgccaccttcggttggccatcgtcccgacaaatatcatcattagatcacccaaccaattaaataggcaaaacgggaacgcactacgggcggcagcgattgatgatggcttacaatcttgccgctggccttgcacatgacgtgcatgtagctgccggactcgaggtgccactcgaacttgtacagcggcgtgggctcggcgcggaggaggttcttggcgcagtagcggagcggcatctccggcacgacgacgtagtgctcggtgacggggaacgagtgcacccaccctggcgccggcccgccgcggcagtccaccctgccgacgaactgcctctcgttgctaccggcgtccatcctcgccaccacgtagccgggccggatcaggtcggggatcagcgtccagaactcggtgtcggtcacgatcgggtgcgccgagtggatcagcccgcccagcttgtccgtgtactggaacttgccgaccgtgtcgagcgtgtccgggtcgacctggatggagcccttgatggtctccgtgaggcagagcacgcggccgtcgccgagcatgacgacgccggtgttggagttgtcggtgagcgacgagcccgagaagagggtcgccagctggccgacgtaggacaggaagttgtccggcttgggcacctccgagaactcgcggtagcacaccttgccgtgcgcgcgcgccgccttgtacgcctccgactcgatctgccggtgcgcgcccacggcgcggccgccgcggaacgagacgcgcaccagcgtcgcgtagccgtcgaacaggtgccggaagccgtagtcgccgaggttccatagtcccgggccgttcctcaggtacgtgccatcctgcagcaagtatgcatcgatccgatcaatcatttgcagcacgtcgacaaatccgtccacctctaattaacgaccgacaaattaatctatccacgagcttacctcagaagattgcatttttaattagctgaaacgattgtattatccatagcttagtgagtgtaactacaaagttacaacaatattatactacatgtacacctgtattaattcctcaaatcaagtcactatcaaaattggcaagaacagtgataagatcacttggagttaggggagaccaaggtttttgacttttgttttcagagagttgcggggtgcaacaaaactgcaaccacaagacagtgatgccattgttgtcgccgatcgaagctaggggtgagcagagaatctgggtatatatgttgtgttccccgcaagcatcgtgagtgccaagatgccatctccttttcgctaggccagcatagggtaagttagtgtcgccctcctctttgtcgatcaaattactgaagatttgggtgagtgcttcagcaactgctggcacagtggaaattaaaaatgacagtcggcaagtaatataccctggcgtgttagatactgctggtaaaaatatgctaggtacgtggccaaagctggtacctttttaggacccttctggggctatatgcatatatgtgctctaggtcagcggttagcctgcactaatcaaggagatgctacaagatgaaaatggttaggttaattataaaggatttgttgcacagtgatgtggtccagaaagtgcctttcgtatttctcaatgtgtgggaagatgttgtgcatgcttttttactaagatgttcaaaaggatctttagtttatagatgatctcaagaaagcgatatggagtactgggaaacctttgaatcaaaataacagaaaagattcgcattcttgaatgaaaaatgcacggctagccttagcttgaccaccggcagatcttataaaatgctgaggttatggtgtgttcatgaatacttaattagggtggagagaaggcaaaagccaaatcaagtcatatttagggagatttgcaatcagtaggaggcttaacccaccagccagagaggcagctctccgtccacctcgagcgcaccctcccacctctcctgccgtacactcttccacgccacgagctcgccgccgcctccgccgccgccacgtccgccacggcgccgcggggcgtcgacggggcgggccggcggcgcgacgaccggcgcgggcggcgctgcctccgtcacggcgctagccgcgagaggctgcgccacggcccgcttgccctggtgcccctggctggccaggcggcccggccggctcgcggcgcctgacagcgccgcggatacgcacagcgacgacgcctgcagcatagcgggagacatggccacacctacgcgagggaaatgcacaacggtgtatataaaatggcactcgatcaatcttagcctctgctttgcgtagtgcagagagctctacgcgcgagaagagacaacaacgagcgatcaggaggagagacgggcggagtggtcactgtggtggcaaggatgagagattttggtttgggacgagaacgtaatcgggtcaagggcgagtatatataggccacaagatagctaagcccagcccgggtgacagcggacgtacgtaatgtggttggaatctcgcccggtcgaaattccttggcgcaaaaggcctcgcgctcttgtccggattccgctgtcacgttgcgcccagccgctgaggcccccccggccctctctcctctcgctagcttgctggtatccggttggtggggcgcgacgcgcgcgcacaccacggcatcgactcctccacggctccacctctcgaccgagcgaaatcaggtgtacactgtacgctacgttacgtggggcgtgggccactacgcacgtcgttgtcgcgtcgcacgctgcagcctgcaggagtcgtcgccccgggtcaggcccgcgcgctacgtaacgtccgtacgtacatcatcagtagcatgtgtgagttgcgatcgcgacttggcgggtcagggcggtggaaaaccagtggcccgggacggggggatgcaggtgtgtacgggtgaagagggttttgcgtgcattcagaggttaatcgagccttgctgaatggatcatccgatctgatagtttctttagggtgcgctcttttcagtttataggattagattctcctcgttttctgttagcacgttttcaaaccgctaaacggtatatttcgtgcaaaaactttctataaagaagttgttaaaaaaattcaataaatttattcataaaaaaattatatattaatacttaattaataatatgttaatcgtatttctcattttgcgtgcgactaaactgtccaccgccactgcacaaacgatcgcaccccagtcagtcaggtactctcgatttgaaccattcgatgttgacataaataaactattgttgtctagtgtagattgcgtggaaaattaatgagaattctgggatgaatcgacagtaattcaaagcaaacgttccctgaaatagtattatattagacggtcttccaagttttactgtaaaatatatgattgaatacacgttaaatgttatataaatgatgagcagatttatgttaaaatattgtgaaaagagaaattttactgtttctcgaaagataagaagagataccaaaatttttagtgcaaatttggtaccttcaagtaccggtgaaatttggtacttcatctagttaaaattttatgttagagactgtaaatcactattgcgaaaaatgatgctcatatgttgaggtttaaaatgtaataacttatagatgtagttgctatgtttatatgatgagcttttgatattcagtgagtttttttttgcgaggaagaccagatatattactcatttaaagcttcctcattcacaaactgtgaaatgagattacaagagccatctggccagaactcagaaagaaaattagtgcggcctctattagctaaaaagtggcttatgttattctggcatcgctgaactttctgaatgctgaccactctatcgcctgccagcagctcttctatgtccctgacaaggtaagcaagctgggacatctccctccctggtgactggatcatattgatagcgaccaaacaatccgactccataatgagcggcagcagagcccattgtagagctagattgatgccttctttgcaagccaaaagttcagcttcaagagggctgctacatctctccatagaaccgcaggctgaaaaaaatgacaaaatgacagagcctaaactattcctgagaacagcacctagacctccagttcctgaggttgcatcaaaaacccgtcaacatttaacttcatccatcctctctttttaaagtgggttaaagtggcatgcttatatattagtctttataatgttgtacgaataattactactatttttatatgttaagctttagatgcttattaagtggtaaggagataaagatacgtttacgtataatcatggatgggttgattttgtcgaaactaagcctgcagtgaaacttctgctgttcacatcgtgcttaccagttagaacttagttaaacaactccactattgttagcaatatataatgccacatctcgagtgacaatcctattgctgtgatcgtgccaatcggtcaaatgatctctctcagttttgatatggagaaaactgggtgcggagggtgctgcgcggtactataccaaccatagatgtgatcaatgtacgatagtaggatggaaatgaaaacatcacccacatacatgtattcaggcgtgtagtaaaggcaaaaggtgctactgtacttattattaaatgatgtatggttatttagtgcagattaagatttgagaaaaaaaactataggatcctttattaaataatatatggtttgcattgagacggtgattaagagtaaatgaggagaaatttaaatgtggtttgatttacggaacatattctactctaccgtaataactatttcgtggaaatatttaaatcctaaaagaatagctattcttgaactgaggtagtaatactccctccatccaaaaaaaacagacaatgaatttggacaacctcgtgtccagattcgttgtcttaggtgatgacaccatctatattgtttttttttctaagacggatggagtccttagccagagagctttcatcatgattcacaaagtgcatgtatggtaacaacttttaaatctgctttgctagcttgtactaaaatatttgaaaagacgttcttgcatgtgtgcttggtagttcactactgctcgtttaagttgggctgccgaataatttggtgagacaggtggacggtgcacgagacaaattgattgcaataaaaccacctgaaaggtggtcatacagtacaccataagtgaatagacaaatcagatttagtgaacaagaaatatatataggaacaacatatatgatctgtacagaatataattggtgtgggtgcaaaggttatcttgcagctacaattatttgtttgaaagagaccactagtttaaaaaggagaccctgtgacgtgtcccaacaattccatgctctgctttgaagcattgcagaggtgccggatgcttcgaaataagcaagccaaacttctgactaataacatataagatgccagaaatataatgacaaagatctagtcagggaatatacctgattcctgtgtaggcatcgacatcacattgcatcgtgccaagttgcccaccaaaatgatagctttcttacactaattatcagtctagtggctatcatttttctaacacttttttttatttgatgctgtttgactacacattatggtctctaagacgtgatcagtatttcactcagcaaaatttgatgatacaaattccaaaactgccgatggaaaaggaggaaattcacttaaccacatgtatatgtgagttgttttacagaacatatagcgccaacatgtccgccaccacctggacaccttgattgcatcacagccaagagattgctaatttggttccagttattcagatgtgatcctctcgtagcgtggctaggccccttcccgctgcttagagtttgtttttagccgccgtagtttctctagcttcagtttttttattttactttttctcccttcccctagtataagctggtctggctaactgcgtggtgtaactaaaactcttttcgtttaatatattgacgtgcaattcttttacgcgtttgcgaaaaaaaagtgatcctctcgtctccttgatacccatcggttgcttaccgctgaacataatccgtaattacttattaactataaaaaataatttattagtaaaacttttgtaggcgccttgtatggtggagcattgaatgaattctacgtgaattaatggatatgcatatgagaaattagcaagctatcaaaaggctttgtttcatactccagcaatcgctggactgcagcttcgccgggcgacctaggttgctgaattgagctgaatgtcgagagactaaaacatctccaactttatctagcatctcgctaattacactagctgaggcactagagttcgtttgaaatgaatttcggagagactacgaaagcaaatactccctccgatcataaatgttctggacaagattcaaacaaaaatttaaaacattggcccttttatgtgttatgcatgttctaatcataatgcacctttcatgtcgtcattgattcctttatagccagttcatttcgtgtgtgagatcaaggttactcccactactacgtagaagatttttcttccatgaagtgtgaatgttgttgtccagatatgattggcagatattgctttgaaatttcgcaaagtgataccaaacagtgaaaggaatctaaatttacttattaatattattaatatgttggaccctccactgctactagatagtataacgtataagtagggtcatacttaaaactaggtagagcctataaaagcaacatgctttaatttacaaaataacacgacgtacatcattaccaacggttcatgcaattttgttagagtgtattgaacacctttgttgaataaatgaatggtctaaaatcaattaaaagtggcaattgtggacttatgtagcaaatcaagtgccaaagttatcgaagacaataattacattacagtatgggacatattttcttgaagaaaactagacattaggttactgtgtgacacaagacggagtatgctcaatatatatgctggcaccaatcggacatggatttttattaaaaaagatcacacatttttagtttttaaccccatcgatttttgtttataaaaagtaattattacgctttgaagagtcgcgcgcatgactggtcaaaagcgtcaaatataagttttgagaaggtatgtttttaaagttatcggaaaagctttaaaaataaaaaatatcatacatgctcatgctcctaattaatgtatggcaatagtttcagctatttttttaatataattttgcttggctagttcgcacaaaattatgtacatgcctaatttgtacaattggtgattatgcagatatgcagaaatatagacatggagcatcagagcatgagctttttcacgtacggctcttaaaaaggtattacaaggtacattagttccagaattgatctggatgcggtgttatgcttccacctagggactaccctcgagatgcccgaagagcttcatgcttcttgacccgatgcgatccacgtgccacggctcaaagcgactctagccaaagatgacaagttgcgcgagggggcatgtggttgcccggggcggaacatttactatggggacctggttcttatgtcaccgacaatcttattttctagtgtcaagtgatacattacgctagaaaaacaaggtatcttcctagcccattgactgtaaatgttgcccagagcatctattgtgcttgtatgaaatcaatgtattctatgacttgaaccaggtatggcctataagccaatggcagtatggcacacatttttgaacaatggtgttagatgataagaatagttagctagatagattggttcttatcttcagtttgttgtaactaacagagagataggataagatctctcatcctttgtatgtaccacgctaggggttattcctagcctatataacacgcaggcatacctgtaggaagggtatcgcttccatcacatggtatcagagccttccaccctccaccaatcaatctttcaatctaatctcccaactcccgacgcaaatggcgtcttcttcctccaacccatctgctctcaatgggcagacagtttctgagaagctcaccaagagcaacttcgtgctgtggaaggcgcaagttcttgccgcgctgcgcggcgcacagatggccggcttcctcgacgggagcaatcaggcaccggctgcaacgatcatcgtcaccaaggacgatggcaagaccaccgagaaggtggcaaatccggcgctggtgcaatggaaggcgcaggaacagcaggttctcagctacctgctgtcgtctctgtcgcgtgaggtgctcactcaggtggcaacactcacaacggcggcagatgtttgggaggcaattgagagcctcttcgcatctcaatctcgcgcccgcatcctcaacactcgcatggcgctctccaccaccgtgaaaggaaaccggagcatggcggagtatgtcggtaagatgaaatctcttgcggatgacatggcttctgcaggaaaactagttgatgatgaggagctcatctcctacattcttgccgagctggatttcgactacaactcggtggtctcgtcagtcacgggacgcaccggtccaatctctgtgagcgatgtctatgcgctcctggttggctttgagtcgcggctggaacttctccagaacgcggccaatccttctgccaacaccgcgtcgcgaggagggcgaggcggacgcggtcgtgatggcagagggcgcggcggcggcaaccctggacgtggcggcggcttcgggcgcggtcgtaatgacggcaagcccaagccgacgtgccaactctgcgacaagatcggccacatcgtcgccaagtgctggaagaggtttgatccctctttcaccggtgaagagaagaacgccaacactgctgcagtgaactcctacggcatcgacacgaactggtacatcgacagcggcgccaccgaccacatcactggagagatggagaagctcatggtgaaggacaaatacaccggcaatgatcaagtccacaatgctagtggcgcaggtatgaatatcgatcatgttggtcatactgcaattcgtacccctactcgtgatctaacgttgaaaaacgtcctccatgttcctgacgcatgcaaaagccttgtttctgcccatcgctttactcgtgacaataaaacatttgttgaacttcatcctttcttctttttggttaaggatcaggtaacgaggatgccactccttcgaggcaggtgtagatccggcctctatcctctgccaacagacaagctccaaaccatctccaacaagcaggcttttggtgttgtcaagccctctcttttccggtggcacagtagattagggcacccttctttttctgttgtcaatcgcgtcattagccaaaataatcttccagttgttagggattctagtcaagagtttgtgtgtgatgcttgccagaaaggcaagagccatcagctaccctaccctaagtccagtagtgtttctattgaacctttgcaacttgtgttttctgatgtatggggtcctgctataaactctgttggcaataaagtttattatgttagtttcatcgatgactttagcaaattcacttggatctatctccttaaacacaaatctgaggtttttgccaagtttcaggatttccaaaaccttgttgaacgcttgacgaatagaaaaatcaaagctgtgcagacagattggggcggggaataccaacgtcttaattccttctttcagcgcattgggattgaacactacgttgcctgtccctatgcgcatcagcagaacggttctgccgagcgcaaacaccgtcacatcgttgaggtcgggctctcgttgttagctcatgcctccatgcctctcaaattctgggatgaggccttcaccaccgctgcttacctcataaacaggaccccaaccaaagtgataaactttgagacccctctacaacgtctgtttaacctgcccccagattattctctgcttcgcaccttcggctgtgcctgctggccgaatctgcgtccctacaacgcccgcaaattagctttccgttctaaacagtgtgcttttctgggttatagcacgcttcacaaaggttttaagtgcctagacatctctacagggcgtgtgtatatttcccgtgatgttgtctttgacgagcaaatctatccctttgaaaaacttcatcccaacgccggtgctcgcctccgggctgagatcaatctcctcccggtgcatcttcttccgctgcttgatcacgggggtgtacagatgcatgatcaaccgctgattgatgattctaatcctgctaatccaattattgagaatagtgcaggcagcagtgcaggcaatggagcaaaatcaggggcgcagcacgggcatgatttcatgcagagttccggcgggcaacctaccggcggccatcatgactctctgacgcacagtaccatccatggcacggataaccaggcggaccaggagaactcggcgtcatctcgatctgcagaaccggtcacgccgcgacacgcagcgagtccctcggccgcgccaaccgcgtcgccacacgcggcagccgcgccaatcgcgtcgtcacacgcggcagcctcgtctccgtcgggagacattgtgggaccgggttcacatgggccatcgcaggaggatcaagacacgtctgcatcagctcctgcttcttccacatctaatgatgatgatagtgctcagtttgccgctcagccgactcgaccagtgaccagagcacagcgtggtatccacaaaccaaagaagtacacagatggcacagtaaggtatgcaggactcacacatacaggagaactaggtaatctccaagaggctttaagtaatactaattggaagtcagctatggatagcgagtttgctgctttagtgagaaataaaacatggcacctagttccaccaaagcagggggtgaatgtaatagattgtaagtgggtctataagattaaaagaaaggcagatggaactatagatagatataaagctaggttagtagcaaagggctttaaacaacgttatggtattgattatgaggataccttcagtcctgtagttaaggctgctactattagacttgttctgtcactggctgtgtcacagggatggagtcttcgacagcttgatgtacagaatgccttcttgcatggctatcttgaagaagatgtgtacatgaggcagccaccaggatacgaggagaaaaagatgccatactatctctgtaagttggataaggctctgtatggcttaaaataggcacctagagcttggtactccaggttgagtaaaaggctacaagaacttggttttgtttcatctaaggctgatacatctttgttcttctataataagaagggacttgttatgtttctgcttgtatatgttgatgatattatagttgctagctcttctggtcaagcagttacagttttactcaaggaacttgagaaagattttgctctgaaagatcttggggatctgcactactttctgggaattgaagtaaagaaaactgagaaaggtctgctgttgacacaggaaaggtatgcaggtgatattattaagagaactggaatgagtaattgtaagcctgtgagtactcctctctgtgtgtctgaaaaactgtggtcaaatgatggtgaatttttgggtgcaaatgatgccagtcagtacaggagtatcgttggggctctacagtacttaactcttacaagaccagacatatctttctcagttaataaagtgtgtcagttcttacagaatcctactattgtacattgggcagcagtaaagagaatacttagatatctgcaaggtactcttggtctaggattaaagattgacaaatccctttcttatattgttagtgctttctctgatgcagactgggcaggatgtctagatgacaggagatctactggaggttttgcagtatttctgggatcaaatttgatatcctggagtgccaggaagcaagctactgtatcacgctctagtactgaagccgaatataaagccttggctaatgcaactgctgaagtaatgtgggttcgtaaattgctagaagagattggtttgttgcatccaggaccttctcaattatggtgtgataatattggagctacctatttgtcagcaaatcctatgtttcatgctagaacaaaacacatagaagtggattaccattttgtcagagaacaggtggcgcagaaaatgttggaaattcggtttgttccgtcacaagatcaaattgctgatggatttacaaagcctcttcctgtgagacaattacaattgttctgtaacaatctcaatcttggagaattgagattgagggggagtgttagatgataagaatagttagctagatagattggttcttatcttcagtttgttgtaactaacagagagataggataagatctctcatcctttgtatgtaccacgctaggggttattcctagcctatataacacgcaggcatacctggaggaagggtatcgcttccatcacaaatggaagttttgaaaagagaagagaataaggaaaatgaggttatcatgcactaacactaaccagtagccggcaattactcaacaaattgaccggtggagtctgcaatgcatgcatacatcgatacatagaacattaatactgcacaaacaacacaagtgacggcttggtagctaatagaattttggttgggaaagaatcttccaatgcatatggatcccttaccgcccaaagtgggaggagctaagctaataagcccccagataggtggggaaaagagatgccacttatgcatggtttcgtcgactacggcaatcatgctgtttaactctgcccgcccgtcggatcgtcagatcgaccttttctcatcactttctctggactccgaccacagatttgccgtgacgcgaagtatatatcattaatttttagtttttgttctacacacattggaatccaatgttgagaacccatataatattgatgtattattggtcactagatcttggcaaatcagctattcgcaaagtgactgggaaagtttcgcatgtagcgtaaattttgtctcctttcttccttttccgcatgactagagaagcgtttgatgcataggagatcattctccaattgacagaccaacacagtgggcaaacaactatatatacacacgattgattggagatcttcagtggaacagacgtaattattacttgaggacctcttcgatctaatagaccctcacgtaacatattataggaacccgttcataacgtgtgtaatggtgctacatactccctctgtactcgtaaagaagtcgttttggatagcgacacggtctccaaaacacaattttgatctcttatttctataaaaaaatatttattaaaaagtgatacatgtatacttttatgaaagtattttttaagacaaatatattcatataatttttacattttcaaactcaacaacttgagagttattcatgatttatatttttaagatttgacttaaacattgtcctaaacgacttgctttacgagtatggagggagtactagtacaggtaactctgcttttttttattttaatttagatggtgtagatcctacaaactctcgttatagaaggtatccacttttctttttgagttataaacctctcgttataacctcatattcttttatttctgtattacaacttattgtatttatataggtcgattatataaaacatttctattatatattattagaaaaaaatagcggattgtcatgtgtaactttacacgaggctagctaaaagtataattggatttggtttacaattcttcacttttgattacataaatataattgtaattcatatacaatagatttcaaaagccaaatatattttatatacaactcttagcatatatattttttatagatataattatactttcaaaacaatagattttttttaaagtatgattggattcacatacatctcttagattttgttttcataaatgcaaccacattttctataaaactatattaatcaatcgacaccgttataatttaggtcaataacaacttgacaactaatatctttcttttatcagattaatgtgataatgtttaggtctctaaagcgaacatgacgtctttcaagctatatttatagtaattaaaatagatagatagatttattgatatatatgaaacgatcataccttgcatcaacccctcagatttttcgaagcgtagtgtacttcctctgtttcatattataagacgctttgactttttcccatttaaatttctacaacgtcaaattagtttcattaaatctaacattagatatatttttatagtatatttttttgtgtaaaaaatgttgctatgttttaatataaattaagttagaagaattttttacttaaaaagaaattgaacaacgtcttaatatgaaatagatgtagtagatgttaacactggacggatagatagatcctacctatatgcattttatgtcgatacatttctcgccatcctctattttatactccctccgtcataaattatagggcgctattgtttataggaaaatcaaatttgatacattttgactaataattatactaataatatctatgcgaagtattatgcatgttatatcgctaaatttatattttaaaatattgccatgtagtgctaattttatatttattggtaacataacataaaataaattaatgattaaaatatatcactaaagaccgtgtaaaaattttataaaccttataataatttaggacagaggggtattacatatgtaatgatagaattaacgtatgcagtgtgatgcatggaaagtttatcgccatgcattcatgtcgatcactagcttgtaatgtaaccagtacttcagtcggagtcttcctattcaatctccaagcacaagcatcttccttattcttcatccctgtggccaggagcttgtttaacttgtgtgcgcgcgtgtagctcttcatttcctgcatatatttgactcgtgtagttgtatatatactactagtagtaatacactttgagtagtacttattgtgtatatctatcatgtctcgcgctgtcagcttcgtgggacatgcatggcttgtctttggttgcatgcgcacttggcgcacacacactgacatacccgtcagttaaaccgcgcgctattatctatcatccggaaattgacactgtttttgtctgatcacgctttcaggagactaaccacacttatgatgacgagagcaatgcgattttgacatgttgctcgtctggatttagcttgcgacccaggagctatagcagctagagctagctacacgactagcgctagctagtcagcactacatggaaggatcttgggcctgcatgcgctttcttccctttcacgatggccattgccgcccttttcaccagcagccatcaacaagggggcgtcatcgatccaggagtcggtcaaaaagacacacaccagcactgcagcatcgccggccggtgaagccagagagagattggacaccttcggaatggcaggcagctgcacgcagcagggagcatatctgcgtttgcatgctaacgctagctagctagggagcgcggaatataccatggctggcatgggtgcgcaagcctagcttgatagaggcatatttgtactccagtacacaggagaagaaaaatgtatgtgtgcgtatatacaaatggagcagctagcagaagcaatttggcaccacatatgtgcggctggcgattgcatgattgaccgatcgatggcgacagcgcagggcacgacatatgtgctcgttgtagcggcaccgggtatcagcgtgcgggagcgcctttgatccctgcacccgccattgtcgcttcgcacgtacactggcgtactgccaatctgccatgccggttcgccggtttcgggatgccagccagatgcctccagtatacgtgtgtgtgttgtgttctccgcgggaggatgacgacacggcgacgggatgaaacgatcaaacgagcagtttgtatctagtgaaacagatcggtgggctatagagctcccacaggcgctgcatggagtattggagtacgtggtggtgctcggcgcattcgatttgggtgcaatagcacggtggccgttctggccttcgaggcgtttgatcgatcgttcgcttggaaaatatctattgatggtatttcttctattttaaaatatagctatttcgtattggatttaacacactgattttaacttatgttaaattcaatactaaattttttttagataatggaataaatataccggcctctactcaaaagagctacagccaattattacatagaagcgtttgacgaacatagtgtaaatctaattgaatagaacacaccgcaagaaacaataaagaatccagtctaacataaggagattacaattattgaagtctatttgtaaatctccaaccataattggcaaaaagttgcataaccgtagtctcaaacttccgacatgcaactttcagaaactcttcatcatcttcacacatttgtagttgtgcccaaaaccgaagccaatgggttgctctgaaaatgacctgcatataggaaaatgatggtgatttgtcaaaatctatatcgttcctactcagccatattgcccaacaaatggtagaagctccaacaagtatcagtttactcattttattatcaactcccaaaagccacccatcaaaaatataagatacgctaactggaagattaaaaccaaaagagaactgaactgctctccacagaaacttcgcaaaatgacaatcgaaaaagagatgttgaatagactcattcttcaaacaaaacgaacacctcaagctgccattccaattacgccttgccaaattatccttagttaacacaacccctttaaacaagtacaacataaaaattttaatcttaagtggtatcttaagcttacaaatgcacttattcctgtcaatataaccattattaattaaagctaggtacatatatctcaccgagaacaacctattctgatggaaattccatctaaaagtatcagatgaatcattcaattgaatatgtactatagaggaacataactcatgccaacaatcaagattttgaccaactaaaactcttctgaaagaaacattaagcggaacagaacccattacagtagcaatagaagatattttcctacgagcaattgcgtacaaagatgttttcctcaattaaattcaatactaaataattggatgaagtataatttaataggtacacgtacacctagctggtaatcatttaattgaggttataaccaagatttctttcgctgagctgagagcgttcctctccagctatcctctaaaagacgtgaaagatcagcatatggtttttctcactagctcgcacgccattgcggcgctactggaagcagagtggcagagcacaagacaaataaaaagggaacccaagaggctgtagtgcaggtagacagaaagccggagaaccggagcccacccaccacgggggcgcagcttgattgggcgattggctgccatgcatgccatcgtccaagccggtgggccaatgcgcacgagattgggccccccatgatgcggaagtgggcagcaacagcgagctagctatggcccatctagcgcaatttggatgttagccctcctagtatctcaacattgcgttggactggaattctggaatcagcagtggctcacactcatttacaggccctttcttgcgttcaaaccaaaatccgagtgatgaacggcaaatctgaaataacgaactgtgaaaaaactagaatattagggaaggacctaatatcaaataattaggaggagtgaggctttaaatccaagtcgtctagcccaccaccttgtggagctagccggaaaacccctgggcatttctcagtaacgaactgtgatatggctggtagtactactagtacttcccatcctgccaagaaaaagttgtactagtactagtcctatgggagcaaaatgcaaggcaatgtttgacctaataatgcatgttcctaaagtttaactagtttaggaatagcgtgaaatgaaatgagcgctgttgaaactagtggcaccagatcaatttggcaaaggcagcagtaaaatgtcaattccatgaaactctattggcggatatgtaattgatgacttttgatcttgtagaaaccgattaacaagcagcaggtcagaatcgagctcagttcagtggtgtcacggtacaccgacgaattagtacgtggtggcttccagtgtgaattgcagttcgtacttcgtatactattcatatgtgaagatgacccatagtgaaacctagatccgcccctgattagcgttgtgggtaactcatataataaagatgttgaactaacacgctcacttgaatctagctagctagttgcagcaaccttcatccccaaaggttgtatgtgtttgcatgcatggatgattagcaacacactgtgccggacggtgccagtctctatcatttgctacgtacttaagttgacattagctagctaggcctgtaggccagatcaaaattcaaatgatgtcactgaatattgtggagtaggccggtacttacgatgataaagtagcatagtcataaaagatttacataaagccaggttcttttgtacaaaagcagagtaagttatgctcccaattattagattctttggtatagtaataaaggtatggtctttgacttggcatatctgtggagataccgacggtggaaaacaaaggacttggttgggtatagccgtataggtatatgctgatagcagaatctgcccaatttggaattgtaccatgaatgctacccgcactattaatctctgtgctattctctagaacgtattatcggtcctccgttctgcttgagaggaaatagaagcttatgagttctacggctgcttaagctgtcaggcaagcatctaccactaccagtaaaaagaaaagttgaaatccgcagtcaaatgatgagtggcagttcaatcattctgctacttggcgtctggcgccaagaataagctctagtagctagctagctagtcagtgcgttcggatgctactagctccgagtagtgagctcgtgacgaaggcgatcaacaaattggccaaatatggccgacatcgtgacgtttggaagccaagaggtccgtggatttccctctgacagcatgttgtcttggttggttagtccttgtaagagcttaagcagcagtttagcggtttatacagcatctatctatagcagcagcccgcaggcttctcttcaggtcgggcaacttgtgtggcttccttgatccatgggccgtttagccgtgccgccatctcggccgtcttccttccgaatagcacatctggcccatcctgcagacagatatgggccttcaagcggcgcacgtggctgggaagtggaaaccgtaggaaaagttcactctatatccctcatattgctgtccagtttcaaaaacttccatgaaccacaaaaccggatacaacacaccccctagcttacaaaaccagtgcacacgagatcctaaggtggtttgaatggtggttttagcttatgcggttccaacgtagcttgtttgactaggattatgtcccacgtgacgattgcgtggtattatgggtggattttttaaaaaaaataaacagcaagacccatatgttagtcacaaggggaaaaaatgaaaaacacgatggggccacatatcagcgggttatcggataaaaaatatggacccacatgtcatcaactctccatctccatcttatctcctctctattccttttctctgtccccccatcttatctctattccttttctctatccccccatcttatctccctctacaggttgtgaggccggaggcgggaggcagccccgtcgacctctgtcccggcctctagggagtcaacggcgccgggagctctaaaggtcgacaagccaacaatggaggagcttcggagcttgacgaggtggcgtcagggcacggagcttgagcggcggatctggtgaagggtgctggtcggccccttcctcttcccctcatcattgctaccgatcccttccccacggtcccgccaaacaccacctccgtgacctcgacgcagctggcgtcatctctttccaccaccaccacatctagatccacctttgcatgtgaacgcgctgatgaagactagaggggggtgaataggctgtccctgaaatcttaaaaacaaatcgcagcggtaaaattcaaacaaacccgaaactttctggtaaggaactccggaacttccggcctgccaggcccggaacttccggtgttctaagacaggaacttccgggtaacaaaacagagatgaaattcaaatttcgaaacaggagactaagccaatcttcacaagatggtgcacaagtattctaagcagaggatatatcacagaatcattcacagaaacatcacagaaagagacaagagcgattttttcccgaagttcggatcttgcgatcctactctccgttgagaagctccaaagatcttgtgcaaaaaccctagaggaaatccacagtcttcaaccccaaaaacccctaggcaaatttctagaattgagtgaccatcaagatccaacttgtcacgcccagaagtttccccctttttccttgctttaaatatttgttaaataaatcgtccgaagaaattatcttaattaacctagagctaattccataattaataaatgcaattaataatcagaaatagcgtggtggaattttcttgagttccccatgctccaatgcattaacaagattttagtggaattttcagagccttggaaataattttaaccaattaaaaatcaccaaagtgcaatatttaatcccaggaaaatccttctcctctttttcttttcttttccttcctttttctctagatgggccgtcggcccatctctctccccgtgctcggcacccctttcctgggccggcccgctcctcctttcccctccccgaagttctccctccctccctttctctttcgggcaccgacaggtggggcccacctgtcggtcgacccctacctccggtcgttggagccggagctacaaccgcccgcgccgccgccttatccgttccacgtcacgcctacactccgtgcccgcacctcacgcccacgtgacccgtcctctcccccgcatctcccgcgcgcgcgcgcccgcaagtggtgggggatttgaaatccccgaacaccctctctctctcctccacctctccacgtcgccggccaaataggggccatccccggccgtttccgcccctccctcgccataaaaaccctcactccagctctctctctcatttcccccattcaccgtcctctcccatgccctctaccgccgtcgcgccgcgctcgccgagctccgccgccgccgcccatctccggccgcgtgccgtcgccactagggccgccgccgcgccaagccgccgccgccgctagctccgccgccgtgtgggccatctcggccacctcctcgtgtcgccggaaccccaccggaaccccatctccctcgcgagccggtgagctatccattcccctccgtctccggccagccactttagttgtcgcggtcgccttctccatccctaactcctctcctcccctcctctaggtgtcgccgccgctcgtccgcccctcctctcgtcgggtcgtcgtcgccgccttcgtcttccgctccggccgccgtgtcgccggtgagtcctccctccccctcatttcctcaccttcccgcgagcgccagccacgccgctgctccggccatgcgccaccgcctttcggccgtcgccgccgcttcccgcaccgccggtcaccgccgtcggtggccgtgcctcgccgccgcctcgccttggtcggccggtcggccttgaggcagagccgagcccggccggcgcctccctcgcctcccctttgagccaccgcctggtggggcccacctgccaggcgccacctccctccctttggagccgctgacccgtggggcccacgtgccggcgcccccctttcgctgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccattaaaaatggttttgtttcctgtttctatagtcttatagcatgttttgcttgtgtgctttgtttgtcgcgtaggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttacattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttggattggtgccaccgcaagggtgtcagttaattaaaatattctgaatggcgggttgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtagaatcgtgtcttgtgggtacagttgtacacctctggccagagtaaaactattcgaatagctgtgcccgcggttatgggcgatcaaccagattcaccgtgattagtctcacccctagtttagcttaatgaactggtgtagttcaagtggttggttgggcctgttgcaacgtggtgtagcgttggacagtgattggttaatattgattaattactacagctgttttactgctttcaactactgctttgaaatgcctgctttatgcaaaagaacccctagcttcctttggtttatcctgcatcatacctcatcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacacaactcaacctacttctagaaatccaccacaagtgtgggttgctctacttggaaagcctctagaatctcagcacaagaacttcactaacttacctcattccctttcggaggagaggaaatccttcacaaacttacccgggacatccacaatatgcaacggattctcgcgagcgacacctaaccgtctaggagatcatctccaagagtaataagcaccgagatgacagcccatgagatattccaagtgctcacccaagatcctagtcttcacacatctccaaatcttcttctctccctctcaatctctctttctcacaagaattaggctctagattgagtggagaaggcaagaaacacttgggagaggctagcaatagctctaggtttgaaaagtgaaagtggaatggccaaggaacgagctggaaacgagctgtacatgtataatggctaggtaatgtcatctagccgttactcacaaatttgaactggaaacaagacaggaagttccggacctagaagaccggaattccggactacacttaggaaaatctttttcacaagaccggaacttccggacctggaagacaggaagttccagacttgcatttttggacagatggagtatttgcaaaaaaaaaaagaactcctagggaaacttgacacttggttcacactaagagcacttgatatatctcagagcatcacctggaacccctcttaatagtacggtttttcctaaaaactcgatttcagaagataaactatcctatgcacttcttgagttccggtccgctttgattttgtactttttggggggtctccaagcatccatcttccacaccttggactaatgcacctgaaagctactcaatgagctcattagtcccttaaccacatttgtcattaatcaccaaaacccactaggaggattaatgcactttcagcatggttgttactgccgacgcccaaatcttgcgactggccggccaccgccgttcgtcagcgacgaaggtgattgaggctgaccatctcccctccaggacatcctccacatgctccgctggaaagttgccacacatgccacaccctcggtggctgctgttgggtcatctcgccgacgatgacgttgaggtggaccgtgtacaccatcgtcctagcccggtggtcctgacggtcccgttgacctctgtccaatgaggaagaggtggaacggcaaggactacttcctccccatcctcccacgcgtccccatgccgtgccatgattttgacacaccacttgtgtcgttcctatgtgagcgatggtggcagcgagtgtcgaccttgccatcgggggtggagagaagctcgcctccaccatacatacacgtcaggagtgtggaggagcaagagagggggcgatggggaagagattggagagggggaaagaggaggaagaccaacaa

SEQ ID NO: 22895 - DNA, 10241 bp, Oryza sativa
  unsure (1)..(10241): unsure at all n locations
tgggtttcttcaatctctcttcagctttactggttcttggaagaatgatgaagcggcgacgaaatccctcgcgattgatggctactccgggcctctgtttaaagttaagataacgagtggtgaattgtttctgcatgagagcgttaagcgcgcaattccacatagttgggatccttcagcattggctaggtcagtaggtaatcatcttatttgactgatatcagggtccagttctgatcattcgcatcttacattgttctttgtatgctgctgccattgtcatataataacaagctcctcttgtttcatatctcttcagctttatcgagaactatggtacccatattattacttctgttacggttggtggtaaggatgaagtatacataaagcagcattcctcatcccaattatcagaattggagttcagaaattacgtcaaagaaattggaagcgagagattctcagatggggatagcaagttaaatgcaactcccataaattacagtgagaaggttagctccatactgatatttctatttaaattaaaataaaagagggagatggcccacctgtaattgctgataataatagaagatcgtcatgagtcatgaatatcctaattagttacctggaaggctgtatggtcccttctgcgtcgtggctattttgtctacatctttgagaaccacctgaagtcatctgcaatgagaaattagataatttgatatcctaattttagctttttatctggcaaaacatcctaattccagcttgcaaaattgatcaacattttttatcccttatgcaggatatgacagtaatcttcagaaggaggggtggttgtgatcttgttcagaattttaatgattggataaaaactgttcagtcagcaccagatgtcataggcatgacatttctccctatcgtctcacttgtcggtgatatgcctggaaagaagcacctcgctcgtgcaattgaactttatttgaaatgtaagacacgcttctgattcccttgttttgtcagtatgctcatagtgtgctttgcctacttttaacatatagtttaaccccctgagctgttttcctaaagcactatcatttctgtatcaaagtccctttgtagttggccttcgtgttttagtaatgatcatctttttttcttctgtgatcaagatcaacagtttttccctacaatgacaaagtttagtgtgactaagttcatacggtagtggtgcttcacaaagacagtactgttactgtggataactgttttcctgtgtcttttttttctttctgttggactgagatattttcctggataaatatattacatgttggctcttcaatcatgctgttcttttttcactacagacaagccccaaattgaagagttgcagtatttcttggatttccaagttcaactagtttgggctccagtaccaccaggtattgctggtcaacatagaaaggagcctgtatgtccatcacttcagtttagtttgatgggcccaaagctctttgttagcactgaacaggtaaaaggataccccacaggccctttcttttacgcaagtacattagtgtgataatttccttttctagttttgctgtaagttggttaatttaatgttctcaccagctcctaccctgttgactgagtctctgaggcaaagacaaccataattttactttattgccttataacctcaagattatacatttacattggatgaaatatacttttgcttggaagttatgaaaaagataaaataaagtgtttttaagacaataaattctgaaaccaatgtagcacatgctaacatccaatgaaatatatgcagatatctgttgggcgtagaccagtcactggtctgaagctatgcctggaaggagccaaacagaatcgtctggctattcatttgcagcaccttggctcattgccaaaaatatttgtacctcattgggattcccatatcacaattggaccgccaaagtggcaaggccctgaagagcaggatagccgctggtttgaaccaatcaagtggaggaattttgctcatgtcagcactgcgcccatagagtacactgaaacaagtattacagacctatctggtgtttatattgtaacaggagcacaactgggcgtgtgggattttggtgcgaagagtgtactccatcttaaactcttattctccagagttcctggatgcacaattaggagatcagtgtgggaccatagtccatcaagttctttggtccataggacagatgaagcttcatcatcctctagtgataatgctaaacttgtgaagattgttgacatgaccgagacattgaagggcccacaagatgcacctggccattggctggtaacaggagcaaagttgggggtcgagaagggcaagattgttgttcgtgcaaaatactcgttattaaactattgaccaaatgttgaaagcattcattcattcactctgctatgaagcatcctgtttaaagatagcatatgttcttttgttcatcatgtatggtttttaatgtaacatcatatggattcgtgcttcttgttgattctgtgagggattagcgcctagatgtttgtgtccgattacaaaatatttgacctggtctcagtgatctgttaaatcatctctgtgtggcagtagaagatgtatattagtataaatttttgaattggtattttgttatgcgaagtttaacccagtggagttgaactgggcaatgctttttttccccttgtgatatcatgatatgcaatcaacattttatggtgcttatcaaattctatgtgatctgtgcatcctgggtgagaaattccttgaagttaagccaattttatctactgcgtggcataaacactctgatggacatgatgacagttttgtgaattctgcagatgtttggcaaagttgaggcacagcagctgttatggagcatcgatctccagatttgttctgccatttatagcgtggaccgagaaatgcatcactatcttttgtacgtttgtgcttgtgtcagcaagcctagtagtagatcataaacaagctgttgatgttgtctcccgttcatttggaagcctgtacggctgtacctgtctgttgcgatgcattcgtcctggaagagaacaaagtaagaagtggtcgccatcgacgtaaatacgaggacgcatgctccttcctgaattctgatgcggcttctacttctgccattgcaataatctttttggtattatggtatatgattcggtggatatcagggcagcttccaagtggaacgaatggaagctattaaaatcgacttcttttccattttcctcccgtttggattttttttcctaagcaaccatttgcaaaatactttctccagcccttttttaaaaaaaaagatcgtgtagaaacccgaacagaatttcttttgagaataccaatatcagcatcttgactattcacggttgttaggaattaagaacatctgctgtgttcaagttggggcagttatcaagtgattccattcgctgatcccttgtgcgctctgacttggtatttccgcagggacattcttggcgcctccgtggaatgttgattagtttagtggtgatgtcgaaggagatggagatccaaacataacagcgacttagttggaagttggaactggtaagtagtgcactagtgctcaaatcatttgcccagatactgtatgtgaacaacttaaaaatgctttggtttgatcagccatagcaatacacgacattgccatagatagtgtcattttcaactctgtcgttcattctgaagttgatctgttacgtgtaacatagaaggaaacaatttcgtttactttttttttaaaaaaaaggatataagaaatgaaatcatcttatcttcttttttctttgcaaggagaaatatcttgtccctggaaacacatttgtatgaatgattctctggatggcctaatgtgtacatgcaaaaccaactggaaccagtggcaaactaccaaaggtaaatgcaagtgtgaacggatgaagctaatgaaatttttttatgtactgaatcatacacatcgaccaagttatgttaaagaaactgataatctaatacgtcatctgacagctgcaaatcatacacatcgaccaacttgtgttaaagaaagaagatttctctatcctatggcggcctctcttattagttttataaccagattagacaatcctcggaggacccgttcaccaagcaagatgctttatatggccaagcaaatgcgccttctatctgtcactcgatccacctagagttcttggccaaaatggtacgctcatttactgtccagcatttccatcttctcattgtgtcgatactctcactgatgtgtggtttttcatgacatcttaataggaaaacgaggagatgagcaaagtaactcaagctaatggaatagactccagggtatctttcttggtttagctattatcttttatttgaaattgccggtgcctatcatttagtgtagtaacagcatggaaatgctgtccttactatttacatgcatgtagtacataaactaatatctaaatagatttatgcttgaaaatagattgctacttccttcttgttgcattttgatccaatgtgtaagttgtatgaaagctgaacataaacgatacaaagttaactgtgtttttgcacggagctgtattagatattcagatttttttagataatgaaagtttttattgaacccaatcaattatatcaaggtgatacaattttcccgagaacacttctagcatccgcatagtttttttatttttttttagaattgtacagtatttttacctggtctttacatccaatcggatatatgcagctttttttaaattatgaatttagcctattaaagagggaacttagccctcaaataacccaatctgaaattcactcctatggagatttgaactcagaaccttgatatgctacttaggtcactgcaaccactagtatttgtatagttaaaatgcacacaaccggacacacacaaccacactcaaaaaagaaaaaaaaaagataacatggaatgttgagggtcatcgatcctaacactaagtcgtcaaccgtgaacacttccttgaacatcttctccaaatacacagagtattaagagccaacaattctaagactgatcgccagcctataacgctgggtaaaaaacttcttgaccaccttctccagatgtaaacatatcacaaccatcccatatcccatgaatcaggcttctttaggatatagctcatgtacgaagccaatggttgcttattagatattcagatgaggattgatgaatcatttctttctcagtggttgcttatttcttaaatctttatcatatcagtctttctcatttcttgttattcttgaaattttgacaggaacacaaagggcagagcatagcagttgaagccaacagcaaagtaaactcacctaacgcttactatttcgtatctactccctccgtcccaaaatataagaatttttagggttggatacggatattaagaaaataagtagaattaaatgggagaatgttatgattggttgagaagtggaggtagatgagaaaattgaatggtggagagttgtgattgttcgagaaaaaaatgttggtgaagaagttgttatattttaagacaaatcttgagggttagaagttgttatattttggaacggagggagtagtagtttggatttgacttgttttttttttaggaaaattggaattgacttgttactaaaataaataaatgatcaatagggagagactcgtgaagtcgttgaagggaaggttgactggaggggaagacctgcaataagagggagtcatggtggtgttgccaattctttcttcattcttggtaaatttttgccataaacgcttatcacttctcttataaagataaagaaaatgacatgttaagtctttgcagttcataaaatatatttgcattcaggttatttagtacttcagtcttcagcaatgtgcctcttaaaactaaatgagaatccatatagttcacttatcatcatatcatgtcttggtgtataaccaaccgaactagtggtatttataactatgatcaaataaatatcgatctgggttacaataatactctctcgtttttataatataagggattttaggtggaggacgtgacaggtaggacggagagtagttaattagcatatactatgggtcatccgtgagacagattctagcaatttttgtcgattatggtactgtagccgcatgatatggtgtaatgaagttttataactcactaattagcaagcaaaagaactgaaaccggcccggtgagtgatctttgttggttggttatattggccattgcagtgaactttgggctcgagaaccttgcctcgttgtctctagccgtgaaccttatcatctacttcatgacggtcatgcacattggtctgactgatggctccaacctgctgaccaactacatgggcacgagctacatggtcgcagtgctcatctccgtcttcgcggacactttcattggccggtacaagactgtcatcatatcgtcagtgatcgagctcgtggtgcgaatttttaccatcatctacatgatacagttctttgcaacaattctacagcttaattactgcagcaattggaataaactataatactgtagtaaacattcctgcagggcctgctgattcttacactgcaagctcactccaataagctgaagccaccgtattgcgtcttcccgttcgaccccaagtgcgagacggtgagcggcgacggcaggacgcacctctacgtggggctgtacctcgtggcgatcggctcggcgggcatcaaggcggcgctgccggcgcactgcgccgaccagttcgacgagaagcaccccacggagaagctgcagatgtccagcttcttcaactggctgctgctcagcctctgcaccggcggcgccatcagcgtcacggtgttcgtgtggatccagagctacaagggctgggacaaagggttcggcgccgccaccggcgtgatgggcctcgccctcctcgtcttcatcgccggcctccccgggtaccgcatctccgtcgtgcagggcagcaccgcgcttcttgaaatcttgcaggtcgatcggaacgttcacgttgagcatcgcaacgactgtccagtgacagtgcgacacggttactcacaagttctttctttcttttttttttctctgcgttgttttcaggtgtatgttgctgccatcaggaacaggaatatgaagctccctgagaacccagacgagctgtacgagatcagcaagagcaaagctccccctgacacggacttcatggctcacagggataaaccgttcaggttgttaattgatcatgcatgccattttttatgatgcttgattatgcattcgcatgacacttagcgcgttgtactgcgtgtgtgcaggttccttgacaaggcggcgatagtacaggcgccaacggatgaggcgccgagcccatggcggcagtgccgagtgacccaggtggagcacgccaagacggtgctcgccatggtgcccatcttctgcagcgccatcatcatgagcacctgcctcgcgcagctccagacattctccatccagcagggcgtcaccatggacaggaccatcggcacgttcaagatgccgccggcgtcgctgcccatcatcccgctcatcgtcctcgtgttcgcggtgcccatctacgagcggggcttcgtgcccttcgcccgccgcatcaccggccaccccaacggcatcccgcacctgcagcgggtcggcgtcggcctcgtgctctccatcgtctccatggccatcgccgccgtcgtggaggtgcgccgcaagagggtggcagcaaggcacgggatgctggacgcgaatcccattctcgggaagcagctgcccatctcctgcttctggctggcgccgcagttcaccgtgttcggcgtcgctgacatgttcaccttcatcgggctcctcgagttcttctactcgcaggcgccgccggcgctcaagtccatgtcatcctcgttcctgtggtgccccatgtcgctcgggtacttcctcagcaccatcatcgtcaaggctgtgaacgccgccaccaggggcgccacggcgagcggcggctggttggccggcaacaacatcaaccggaaccacctcgacctcttcttctggctgctcgccgtgctcagcttcctcaacttcctcaactacctcttctgggccagctggtacaagtacaagcctcagcagtcagcccacgtaccagcagagcacaaagtatgatgatcatccagcgtctcgagaaccttggtaataaaagatgtgcagttgttgctaccatttttgcctcacgggtgcacggagtaccaacgtggcaacgtgagtttcccataaggggaagaatatataggtatacggaacttaattctaatcagttccagtacaaagatcatggaattgcatcgtcggtgtgtataaatgtgatattttgaagcacaaattttcatggggttattatagttgggcagcgctgaccgtgagtccgtgaagcgtcagtgcccaatggctccaagcgcccgcgcgcgccaccagctgtcgctgcctctgcgtcgcacatctgccagtgccacctacggcgcatgccgtctgccacgtagagcccaccgtgcccctcgtgtcgtgcagcatgcgcgccaacttgacagcgtcgcgccctacaaaacccaccggatgcatgcgcgtagcgtatgtgacggcattacggaaaacccccaccagcagcagctacgcgaggtcggatcggatggcgtccagcaacgagaagccactgcccacaccgatctctgccgccgccggcggcagcggcggcaacgcgccgccggggaggccgacgacggtggattcgatgctgctggacaagggcgcggcgatgctgcaggcgctgcgcccggtgaagcatatcaagcagcacgtgtgcacgttcgcgctgtacgcgcacgacccgcgccggcaggtggagacccaccacttcgtctcccgcctcaaccaggacgtcctccagtgcgccgtctacgacgccgacgacaagcacgcccgcctcatcggtgcgacgccgcgcgcgcgcgacacgctacatccccgcatgattacagctagctgctaacgagttcgtgtgtatgtgtacatgtgtgtgcaggagtggagtatatcgtgtcgcggaagatcttcgactcgctgccggcggaggagcagcggttgtggcactcgcacgcgcacgagatcaaggcggggttgtgggtgagcccgcacgttcccgggatgctggagaaggcggagctggagaagatggccggcacgttcggcaagttctggtgcacctggcaggtggaccgcggcgaccgcctcccgctgggcgcgccggcgctgatggtgtcgccgcaggacgaccccgcggcggacgtgcgccccgacctcgtgcgcaaccgggacgacaagtaccgctactccacgacggagctgcgggcggcgagggccgacgtcgcggtgccggcggagccgcgaccggggcaggccgactactggctccgccaccgcaagggcttcgccgtggacgtcgtgccgcacgagatgaagtgccacgcgccgttcccgtaagctgtgaacagtacgctggcagagctgtggcacacgactcgtgtacgtgaacgtagtagtgtaggaacgaccgtgggtcgttgtatcgtgtgtacggctccgtcgtaaactcgtaacaccaactgctaccacgtcttctgggcaaaaaatggtgcgtgacttgacttgagcactttcatgtcttggatttcacacagtttttcttttagccagttcaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22896 - DNA, 1129 bp, Oryza sativa
cccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacacggcc

SEQ ID NO: 22897 - DNA, 724 bp, Oryza sativa
  unsure (1)..(724): unsure at all n locations
ttcctgcagccccgcctacacggctggcctattatgccaccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgtctacacggctggcctattatgccgccgctgttgggcgnttacgatttaccgccggcctgcctccgtcgccggcgagtggtgcctcc

SEQ ID NO: 22898 - DNA, 13543 bp, Oryza sativa
cagtcctgctcaattttttcccaagcccagaagaggagctccttgaagatgaaggctttggtgtctagctcgtgcctgccgtcaagcgcctgtggtcgtcgccctagtcttccgctgtttttcgtttgtctctgtgtgtgctgggccttcgctgcccatgtaataagttaactatttacgcttccgcttgttaaactctgatttgtatcaacttttggtgtaccttgcctcctgggacaaggattaatgcacgcacgtcaggaacgcccgttgggttatttctggtcgtgacaagttggtatcagagccatccttgaccctaggacgagccgtagatcccaagccttagcaatattttcaaaaataaaaatcctttgttatttgtgaaaactgtctagtctctctctgtcttgctgcttcacttatcatcaaaatctgacctttgaaatcttgcttttctttttgtttttgtttgtagatggccggcagcgtcacccgtcgtggtttggacatgactggcttcgtcttggagctgcggggcatgtgcgtggtcttagggtatccacacggagtggactaccaggccaggacgcttccggatcaggagggagacgacgcggagccccacgctggttgggaggtcaccgcagtgatcctctccggctctcccgagcggacttcgctggcagtcaccgcgggtggagactccttccccgccgcttgccagaacgccgctctcctcgccatcggcacccttcaccagcgctacccggatgagttgcagcactcgccctatcgctaccaccctcgtcgcggaggagcctgcgaccacgccaccttccgggatgctagctcggaggatgacgctaccatcgtgcacctggcgcgcatggtggaggcgtacgacgcggctcgtatcgacttccatcagatggtgcgccgcgggatggtcgagaacaacatgaagatcctggagctgcgtcaggagaacctgcagctcaagaaggacctcgacgcagtggaggcgcagctgcatcagctcaagatcgcccagggagagatctgccgccccaagcgtcgccgcgtctgccgcagtgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttagtggaattttcagagcacaaataataattgagaagaaataaacaaagttaaaaaggttttataaaaagaaaaaccctaaaagtcttcttttccccccttcccttcttgggccggctcggcccaattccctccctctctctcctctcccccgcggcccatcggcctcctccccgcgcgcgcgccgctgacaggcgggcccgcccgccgccctcgctgacgggtggggcccacctgtcattcctgtcctcccgccgcgcccgccgcccgcccgtgccctagcgccgccgccgccgccgaatccgccgcatcccgccatccccgcgcgccataaagagggggaaatcactccccgtgattccctctccgtttccccctgcttttccctctctctctccctcggattcgtccggattcaatcccgtaatcgtcgccggcgcatcaatggcggccgagatctccgcggccgtttccttctcctccggccgctctctcccactcccgacgctatataattgttccccgtgcctctctcctccgtttccgccgctcgccgctcgctctccccgtcggaatcaagcccgcaccgtcgcaccttctctccgccgtcgccgccgagctccggttcgccgccgccgtcgctccggacctcctcccgactcggcgccacctccgtcggcttcgccgcgtccccgtcgaccccgtccacccctccgcttcgctcgccgaccgccggaacgccgccgtcctcgtcaccccgagccgcgccgccgtcttcctccgctccggtcgtcgtttccgccatcctcgtcgacctggggtgagccgtggaccgctccgttcacttcccccttccctcctctctctcgggtgctgctccgccgcgccgttggtcgccggcggcgaccatcggtgcgcgggtgcgccgcctcccgtcggccgtgccggcgaggccgccttcgggcgcgccccgcggctgccaggtggggcccggccgtcagccgcccgcgcccgcgggtgcggctgacgcgcgggacccacggcgccggtcagcgccagccgcgtgcacccggtccaccgtggaccgagaggctgacgcgtgggccccactcccgtggacccggtccgcgcgccctctctcccggctgacgcaataaatccgtttttttaattaaaatttaaatgaagaaattcgtaaatatccatttaaagagcatataaacttcaaatggccatatcttggccatttgaactcggaattggaccgttcaagtctctaatttttccttaagaagccaagaacccatttttgtgctttgtttctgcttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattattttgacttaaattattgcattatcgctttatttaaattcccgcgttatcactgttttatttagccatgcctatttacctttgttatgacattattattgctattgttattattaccttgttcaccctaggataaacaaaaccctaaatagtggacactctactcatggtaccactagtatgattttaggtagatgcttcgcaatttaataggacaacattaggtggtttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcgtggcagagggttggtgccctgctgcttggggctcagtcctgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacctaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtccttataaaatggctttgggcaactaagtgacttttaaatgctgtttactgcaaaacttaacccctatattattaccccttgtacccccttgcattaatcatgcatctgccggtgtggcttgctgagtactgtggttgtactcattcttgctcaatctttcccctcttcagtaagagaagcgttggagaagatgtcttaggtggagtcctggcttataccccagttgagcgcctgtgaagatggagccgtaggcccgctagtccgttgctgtttatttttgattgtcaggccttaagtgcctttgtaataatgtaaatattatcgatataataaaaatgtgtcttttatatcatgtttgtgtggtgtaccccggcttttcctgggacggggattaatacactagcgttcgggaaaaggcaattttcccggtcgcgacaagcgtggtgtaacatcccggtctagggcttaataggattaatagaatattcatatcaacaagttgcaacttcttttccggaagccaatctccaaagaactccaaggttaagcatgcttggcctggagcaatttgggatgggtgaccgaccgggaaattcttcccggtgcacacgagtgaggacaaagtgtgcagaaaagacatgtgttggtctgtgagggcagtctatgacctgtgaaagctatcagatgtaagcgggcccggcctgggggaaggcgggacgttacaaaatggtatcagagccgactctcgcggtttcacgggcgcatgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggtgagggtgtaacatcccggtctagggcttaataggattaatagaatattcatatcaacaagttgcaacttcttttccggaagccaatctccaaagaactccaaggttaagcatgcttggcctggagcaatttgggatgggtgaccgaccgggaaattcttcccggtgcacacgagtgaggacaaagtgtgcagaaaagacatgtgttggtctgtgagggcagtctatgacctgtgaaagctatcagatgtaagcgggcccggcctgggggaaggcgggacgttacacgcagccagaagatcaccgcccgcaagagcacctccaggcccgagcttgttcgtcagtccctggcgtggacttgcttcgtcgagacccctcgtgccgagcctgcgcccgtggttccccaggagggggaagccttccggcgttggtagcacggagggtgcgctgttgctcaccttccgtcctggcccgtcgcagcagtagacgagcagttagtaggcttgcgcgtgtgtttttctcgtttgtcttcttgttgagtcgtgtgggacatggttatgccggtgtgtggcataactatgtcggagcctgtcttattttattcgcctaagcaacttgaacattaatgaaccaatttaatagcagtaataaatgtaagaataatggtagtcgtgggtggttagttttaattgttagctccttctctgtttgctggttctgtgtggggttttcagatggtgacgaccaggagaaacgctgctaccggtgatggcaatcaacctgaaggcagcaaccacaaccaccaaggcaatccacctccacctcctcctccgcctccaccaccaccaccagacaccaatgccattctcacccaaatcctcgcccagcaagccaacatgatgaccgctttcctccaccacctccaaaatccgccacaacagaatgctccaccaccacctccccaacactctaaactcgccgagttcctccgcatccgcccacctaccttctccagctccaacaaccccgtggatgctttggattggttgcatgccgtggggaagaagttagacacggtgcagtgcagcgatgaggagaaagtcgtcttcgccgcccaccagctgcggggacccgcatctctatggtgggaccatttccaggctacgcagccaggggagcaacctattacttgggctcgcttcaccgccgctttccggagaacccatgtgcccgctggagtcgtggctcttaagaaaagggaattccgagagttgaagcaaggcaaccgctccgtgatggagtatttgcacgagttcaacaacttggcccgttacgccccagaggatgtgcgggaagatgaggagaagcaagagaagttcctggcaggaatggaccccgagctgtccgtccgcctagtctctggggactatccggattttcaacgattggtggacaagagcatccgcttggaagccaagcacaaggagctggaatcgcacaagcgccgcttggcgaatttccgcaatcaacagggtgctaaccagagggttcgctacaccaatccctatccagggggatcctcctcgcagcagcaacaacagcagcagcaacctcgctccgcgcctcgacctcaattcgtggtgcgcgtcccacagccgcagcagcagcagaatcagcaagggactcgtgcgccccgtcctcttacgccaacggtgcagcctggtcaaggccgcagggacgcttcaggtccgcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaatcacgtgacggccgaggacgtgctgacaactccggacgtcatcgttggtacgttcctcgttcattccatccctgctacaattttgttcgactctggagcttcccactcgtttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagaacttggatgtgattcttgggatgaattggttggctcaattccaaggagtagtggattgcgcaagacgcactgtcactctgtaccgagggccagaacaaccggttgttttctttgcacccccaacctctgtcagaagttcagaacttcatcagatagaactgtcagaaatccccatcgtcagagagttcggagacgtgtttccggaagaactacctggtatgccgcccaagcgagagattgagttccgaatagatcttgctccaggaaccactcctctgcacaagcgaccctaccgtatggcagcaaatgaactagccgaagtaaagaaacagttggaagaattgaaagaaaaggggtatatacgtccgagtacttccccatggggtgctcctgtgatttttgtagagaagaaagacaagacgaagaggatgtgcgtcgactacagagctctcaatgaagtcaccatcaagaacaagtaccctcttccccggatcgatgatctgttcgaccaactcaaaggtgccactgtattctccaagattgatctccgttccggatatcaccaactacgtattcgtgaagaagatattccaaagaccgcattcaccacgcgatacaggctgtatgaattcacggtgatgtcgttcggtttgaccaatgcgcctgccttcttcatgaacttgatgaacaaagtgttcatggaatacttggataagtttgttgtggttttcattgatgacattctgatatactcacaatcagaggaagaccatcaacaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagttactcaagtccgcagtttcttaggtttggcaggatactatcggagattcatcgagaacttctccaaaatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgatgcttcgcgccaaggattggggtgcgtgctcatgcaggacggttatgtggtagcctatgcctcacgccagctacgtcctcatgaaggcaactaccctacacatgatttggagttagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggattatgatgtgggaattcactatcatcctggtaaggccaacgtggttgccgacgctctaagtcgaaagggccattgcaacactcttaacgtccgaggcattccacccgaacttaaccaacagatggaagccctgaatctaagcatagtgggtcgtggattcttagctgcattggaagccaagcccaccttgctcgatcaaatccgcgaggctcagaagaatgatccggacatgcatggactcctcaagaatatgaaacagggtaaggccgctggtttcacagaggatgaacacggaaccctatggaacggaaagcgggtatgcgttccagataacagagaacttaaacagctgatacttcaggaagctcacgaaagtccttattccattcacccgggcagtacaaagatgtacttagacttaagggagaaatactggtgggttagcatgaagcgggaaattgcagagtatgtggccctatgtgatgtgtgccagcgtgtcaaggcagaacaccaacgaccggccggacttctccaacctctccaagtacctgaatggaaatgggatgaaattgggatggatttcatcaccggacttccaaagacccaaggtggatatgattctatatgtgtcacgtcctgataaattcatcccgaaataaaaatcattttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgttaagaaataaacaaagttaaaaaggatttataaaaagaaaaatccctaaaagtcttctttccccccctttcccttcttgggccggctcggcccacttctctccctccctctctctcctctcccccgcggcccatcggcctcccccgcgcgcgcgccgctgacaggcgggcccgcccgccaccctcgctgacgggtggggcccacctgtcatccccgacctcgcgccgcgcccgccgcccgcccgtgccctagcgccgccgccgccgcgaatctcgccgtttcccgccgtccccgcgcgcaataaagagggggaaatcacccccgtgattccctctcccgtttccccctcttttccctctctctctccctcggattcgtccgatttgaatcccgcaatcgtcgccggcgtcttcaatggcggccgagatccccgcgcccgtttcctccctctccggccgcgctctccccctcccggcgctatataatcgtcccccgcgcttcgctcttccgtttccgccgctcgccgctcgctctcgccgtcggattcgtgctcgcgccgtcttcctctctctccgccgtcgccgccgagctccggttcgccgccgccgtcgctccggacttcctccccactcggcgtcacctccatcggcttcgccgcgtcgtcgtcgacctcgtccgctccttcgtttcgcccgccgaccgccggagcaccgtcgccctcgccgtcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcgggcgcgtccccctcccgtcggccgtgccggcgaggccgccttcgggcgcgccctcgcggctgccaagtgggcccagccgtcagccgcccgcgcccgcgggtgcggctgacgcgtgggacccacggcgccggccgccgccagccgcgtgctcccggtccaccgtggaccgaggggctggcgcgtgggccccactcccgtggacccggtccgcgcgccctctctctcggctgacgcaataaatgggtttttaattaaaatttaaatgaagaaattcgtaaatatccatttaaagagcatataaatttcaaatggccatatcttggccatttgaactcggaattggaccgttcaagtctctaatttttccttaagaagtcaagaacctatttttgtgctttgttcctgcttgttgtatggagtttattagagtaaaagccttttcttttccgttggtcgtgtagacgctgcagcttcggaagatccgctcttcgcggaagttgaagccggcgtttgggaaagcgagcaaggcaagtcacatcatccttgagcatattgaatcccagtttataaaattattttgatttaaattaatgcattaccgctttatttaaattcccgcgttatcactgttttatttagccctgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagctctaggatcgtctttataaaataactttgggcaacaaagtgacttttaaatgctgtttactgcaaaacctaacccctattattatccccttgtacccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtagacccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaatatgggtagttgtggatcgattaaccaaggtagctcgatttattcctgtgaagaccacctatggagggaacaagctagctgaactctacttcgccaggatcgtgagtctccatggcgttcccaagaaaatcgtatctgatcggggaagccaattcacctctcacttttggaagaagctccaagaagagttgggtacccgattaaatttcagcaccgcctatcacccgcagacagatggacagaccgagcgtctaaatcagatcctagaagatatgcttcgcgcatgtgtactagatttcgggaagacctgggataagagtctcccctatgccgagttctcctacaataacagctatcaagccagcatacaaatggcaccatatgaagcgttgtatgggcgcaaatgtcggacaccgctattgtgggaccaagttggagaaagtcaagtgttcgggactgatatcctgagagaagctgaagctaaagtcagaatcattcgggataatctaaaggtggcacagtcccggcagaaaagttatgcagataaccgtcgccgtgacctggaattcgcagtggatgattttgtgtatcttcgagtcacgccattgcgaggtgtacacaggtttcagacgaaagggaagcttgcacctcggtatgtgggtcctttccgtatcgttgctcgacgcggagaagtcgcttaccagttggagctacccgcctccttgggcaacgtgcatgatgtgttccatgtgtcgcaactcaagaaatgccttcgagtgccatccgagcaggccgactcagagcaaattgaagttcgtgaagatttgacctacgtggagaggccagtgaaaatcctggacatcatggagcgcaggaccaggaaccgggtaatccgtttttgcaaggtccagtggagtaatcacgccgaagaagaagctacttgggagcgtgaagacgagctgaaggcagcccatcccggtctcttcgccagttcttccgaatctcggggtcgagattccgtttaaggggggtaggtttgtcacgtcccaaatcgactctaaaatacatcctcgaaattgtgcaaagaataattaaaattcatgtgaaagcctccaacaattaaaatgtgcaaagataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaaccctaaaagaagtcctcttttcccccctttctttct

SEQ ID NO: 22899 - DNA, 1751 bp, Oryza sativa
tgggacggggattaatacactagcgttcgggaaaaggcaattttcccggtcgcgacaagctggtatcagagccatctcgactgtaggataagccaagtggataaaacccaaggacatattttataaataaaaaaattatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacctgtcgctgaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttataatctgtctctcccctttgttttccctctctccctctccaaacctttgcaacagatggctgacaatgagaaaggcaataaggtcagaagtcaggacattggtacctcaaactcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgccccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaaggtgcgaagcctccccaaggttttaaccagaataaaatagaacttaaggcatgctctcgttgtggagaaatcggtcatgttgccagctcgtgtgcctctatatgcgttcattgtgaggaagaccatccacccgacaggtgtccaacgagcaggatcacttgtttcttttgtgaaggaactgatcatgtaccaaaagattgtcgattcagttttctgctgacgaagaagatggccaaccaacccgccagttccaacggagagaagcatcaaggaaacacaaatcctcgccaagattccagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtccgatagcccgcgttgcaacagcttccaactccaatgagtgcactaccacaaggtgtcaatgct

SEQ ID NO: 22900 - DNA, 536 bp, Oryza sativa
cgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaattaggccccgggaaggcccccccccccctttccgggggaaattattgggggggccccccaaaaaaaaagggggcccccccccccgggggaaaggcccccccctgtaccaagtagtgttttaattcttaaaatttgctcaacaactaaaatatggaatgg

SEQ ID NO: 22901 - DNA, 543 bp, Oryza sativa
aaatcaactgtattgaagtctccacccgcggtgactgccagcgaagtccgctcgggagagccggagaggatcactgcggtgacctcccaaccagcgcggggctccgcgtcgtctccctcctgatccggaagcggcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaatgtcagattttgatgataagtgaagcagcaagacagagagagactagacagttttcacaaataacaaaggatttttatttttgaaaatattgctaaagggcttttgggggaaattttccccttttaaaaccggggccttttccggttccccttttaaaaagggggggggggggttttttccccaaaaaagggggggaaattttcgtttgatccaacttgtacgaccggaaataacccaacgggcgttcctgacgtgcgtgc

SEQ ID NO: 22902 - DNA, 597 bp, Oryza sativa
attcctgcagccctgaatagtagctacaaaatggattaagcataggaatgatccaatatatggctctctttttttaaaattatgtggtttaatgcatgttgagctattggctataggatatataaataagccagaaaaataaacatcaagttgcattcactacctgcccagatgaagaaagtatgcagctgagctgtgtgccaaagactattaaagtacagtgtgaatacatgcatggaaagtttgcgacaattgaccacttaattatatttagtggaagtaattaacatctactagaagcaacgtgacagtgcaggaccaagtctaaagtgtctttccaacctcgatctctcgtaatcgagcttagctatagctctcatgatttaactgctataaatacctcagcaagcaacaagtctcagcacaagacattaattaattagcttgagaaactcatctgctggatcgagcttctctgttaattaatggcgtcgaaagcctttgcactcgtgctgctggcggcggcgacgctggccatggcggccagcacggcggcggcgcagagctcgccgcaggacttcgtcgacgcccacaacg

SEQ ID NO: 22903 - DNA, 668 bp, Oryza sativa
aaagaatatatagaaatttagtttatttgctaaagaaggttttataaaaaagttgagaaggaaaatatagtgaaagttaatcttgaataatagaaaccaaagtaaaatgccaaattaaaataagtccaacacattaatattagtttaaaactttataaatagtaaatatataattattcggtgtaatatttcataatatttgtaggaataatgatatgtcattattgtgtgactgttgaaagagtttgtaattattttataattattgtatgactgtcattattgtacgaataattatgtgtgtacgattttttttcatgttatgtagatggatcggcaatggatgtacgctgaccggtggtccaaagagtttattgacggcgtgcattattttttgagagtggccgaagctaacatgcaaaagggttttatttgttgtccatgcaataagtgtaagaatcagaaggagtattctgcatgcaggactattcatttccacttgtttgagtcggggttcatgccaagctataattgttggacatcccacggagagcaaggtgttgaaatggaagaagatgaagtggaagacgacaatattccggactttgctcagtacgctggatttgaatgaaatcaaacgggcgaggaggaaagggatgctgatggta

SEQ ID NO: 22904 - DNA, 2647 bp, Oryza sativa
ggctaagcacaatttaatcctaataaattttatgtgcccacaattaatattaagagattaatatcatcttaaaaaccaacgtggagggatctcaacttaaataggccgctataagagagcacaagttgcgcagttaatatggtggtgggattgccacacgtgcgtgcgtggtgagcttgagccaagggcatggcgtggctggctgctactctagctaacattatgttttgatggaaaacataaccgacggaggcactcattattccattactccttgattcttctgttcctgcggttaacagacagaaaattctatcgggttgattcaccgacggatgcgctcgttactctttgattcttttgttcctgcgctgcgcttaactgatcgggagttcaattggattgattcttctattcctgtattatgcatgcctctgtatctcattgttttttccattgctacgcttaacggccggggaagaattcaatcggattgattcttctgttcatgcgttgcgcttctatatctctggtaaccgcggcgttgctcttctgtatctctggtaaccgacggaggcgctcataactccagcagcaacggatgcggaattgaatcggattgattctgttgtcactcctgtaacggatgaagaattcaatctcgatttgattccttccggaatgttactctctcgcgcactatataactcctacctccgagatagacagagtagatacaactcctctcttcatcctctcactctattttcttcttggcaaaacactttgtgtcttctgttcctgtgttgcgcttctgtatctcggttccaagcacccgcccgcataggttctcaggacgagcgcctcgggatatccggccgcttgagtacctcccacagtttggcatgcgatcaagttcttggagagttcattgacacacgactgctctctgcactgcatcggttactttctttgcatcgacatgtcaaccggcgtcggcaatggttgaaatggcggcaaccggcacaatgctggaggtgatggcaccggcactagtggggccagaacggcaacaccgatggatgcatcaacactaacactgcctcatccagtaccatagcgttctcggggtatgtcaattttattattgtagtagtaaacatgcatgttactagatgatgcttattttattatcagtatattcatgtttagtactatcactagattattctactacatacacgtcatacttagtatgatgtttttctggattaaaatataccgattcatgactatatttccaacaatctaaaaacttgataggtctttcccgtacttggctttgctgcatcactaaaatttcatgcatttgatggttcaaactataagagattgaaaccacgtgcactactgtggttgataaccatgcaatgcttctttatttttcatggggcaagacaaccgaacgacctttctcgcctgaggaggaggctaagttcgagtctgcagattgcttgttccgtggagcattgatcaatgtattagctgacaacataatggatgtgtacatgcacatgccttcagggaaggacttctgggatgcatttgaggtcaagttcgaagtcttcgatgttggcagtgagttgtatgtcatggagcagttctatgactactagatggtcgatgtctgttctgtagtagaacaagctcttgagattcaaatactggcaatggatcttgagaacaatagctgccgaacaagttcatggcaggtggcattattaccaaattgccaccttcttggtcagactttgccacttctctaaaacacaaagaggcaagagttcaatgttactgatatcattagttctttgggtgttgaggataaggcgagagcaaaggacaaccgcggcaaaaaggtcgagagaactcttatgcatctcaagataacaagaagatttcaaacttaatactacaaccaattttaagaagaaatgcaagagaaaggcatagcgccacagctttatgtgcggtgagtctggtcattggaccaagaatagtcccgatcgcaaggacaaaagtctgcaaacatggttaaatcagtgatcctactatatttgtaaaatccaaacaagagtaataatagccctatctcaacctacgtggtagttggtaagctgcacgtctattcggcaaacatgggctgtaataaaaaaaatattgaagcaggtttggagacgatattaaatattggggaataagagacatggggaaagaaaaaaacttctttaaagaaacccagtccagtaatttattcctgattgattgacatgaccggatctgcaagacaactgatcacaccaaacaccatttagaagaactcagcaaatttcatcaaaatttatgttgcgctcgaaagcataaactacgaggacgtttgattaattgtccttgaccttgcacaaatttctcgtctcatccactactaagtgatacctacttaggggtgaaaacggtcggaatcggtagcatctgtttgaaaacgacgctcgatcggccggtaattgaccatattgatcttttacactacgtaatatcgacattaatacaatgcaaaaataaattagaaaaagaacaagaatcataa

SEQ ID NO: 22905 - DNA, 3012 bp, Oryza sativa
ttatataggcatataagtttacatatctcataaaagtttttgaataagacgaacggtcaaacatatgctaaaaaatcaacggtgtcaaacatttcgaaacggagggagtaatatataagtgagggaatcccttatctcattgactagcttttggggtgggaaataccctttacgatcatataaaaacatacttagtactccaccagaagcatggccccataccacaaaatgtttgataataagcatcgtgatacatgaagcacatgaaaaacatggtgagcattactgctgatattcaaggcaaaacaaagaatataaaaatactccctggtttgatttgtgaaaaaggttaaaattcatggggggttgttctgcctgacatgtttagagattttggtttgcagtagctgggtcagtcttcgtcgtagtaattggtgtaggggtgttaaagattcaaggcccatatattcttccgtaatcatacctatccttgaaatattttagttaaaaagcatttaaaaattaaaaaaacccaccctattttggacccaaccctcaaattctatagtcctgccctatagtaaaggttgatgaggcacattaaattttatatagtcctcaaattttacgatattgcatgtactcatacacattaaatggaccggcgcttgagtatatttgcatagcctcgtcacgacctacgcagggcctgacaatctgtccgctcattggcaaataggcagcgataggtaaaacataatcatctcgcaaagacaaaaacaagaaaataaaaaaagaaaaacatatatattcagtgtccaagcgggttaattggagaagaataagaattaacggtgggcaatgcgagacatggggaaggaacatcgttacacatcagttgtaagcaataaagatggcattcctaccgcacatttgaacaatctcagcgacgtccaagagagctgcagttgcggaaagctgcaggcaggctcactgctgttcgtgggatttatgcggttaatgtctaggaacactcaaaataatttgcctgctgatgctacgtgctgaactggtgaacatgctgatcctactgattacaagcggtgaactcaattggttagtcgatttatacagtgtgttagtcgatatcatattggttagtcgagctcataagaaaaaaaagggaagatggtatagctgccgtttagcaccagaaagaatgtttggttaattagcttgtttcccccttctgcctctctgcttttcagcttctttactttatatactttatctatcccaatttaatcattccttaagcaaatgacaccaagagctatgagaccgaaatatctatcattttgaaattaattcttatcgatcaaggtgcaatattgttttgtgtccaacaaaaaattaatttacgttttaaatgttgtatgcacgcaggatatttcacgatgcaaatctactctttacataaattaaaaagagacattttggtaggtgatgatcatttgcagaaaaatctcaaaagtattagatgatgatcaaattggaatgaagagagtaccatataaaattatcatatctatctattatatactattatatactaaaagtccattaaactttctacaaacgctcataagccgtcacgtggcgctcctataaacgctcctagatcgccacatagcattgtttaatctacttaaatttgtggaatattttagaccattagattggatatattattttttaaaaaactaatacttttctcatgttaactgtgggctgggaaagcatgcaaacaaaaactccgtatatgttgttatgaaatatttgggtgatctcatccatctatatggatagagcagcaatccacgacggttggtcgtgccccacacctcttctcgcctcacggcgattctagcaacggacgcgatggttcccaaaccatcgcgtctccggttgccaccactttcccatctatatattgtaccgcattgatcaataaagattccgctcattcattctctatattcttgtgtgcaattctctctctcactcaatccctctcgctcaatcaatcttatacactttcaacacgttatcagaactttcgctctcgcgaaggagatctcgaagtgaaagaaagaaggaagaaacctcgcttttttgatctacaggaaaagcgaagaacagaaggtatgtctacctttatttccatcctcgatgccattctcggcatccctcgccatgatcacgcacgccgtctttgccatcttcatcgacgatcgacaaggaggacgcgccgggatctcatggtgggggttggtggccggcgccactaccctcgccgccgtatgtctgccactccgatcgtgcctgccccgctggtccctgacgcgcctactccttctccaccgatcgctgcaccttctcctccaataactgcctcgatgaacgccggacctcctaaccgcgtccaagtccagggggtacagtattgtaccacccatggatggacggcggtggcctctcccggtggcgagctttgcaccctcccactggagatggagtcgtcgccggctccgttcgtcgctgtctccgacatccccgacaccgcccccacgacgacgctgattcccaactcccacgccaccggtagccgctcagccacctccactgccaccacgccgaagtcgcttccccactcccgagccgccgggctacggccggaccgggacacttgccatgcgcaggggggaaccgccgctcttcactcctccttcgtcgcgcccatacgccggtgccgccgctgcgcgccgtcccgtcctccgcgccacgattgtcgttccccacggatctcctagccggaccctagcaaatggggtcatggggaactgcatccgggtccggccggcctccgactccaatgaggaggggggggtgacggcctaacccggccggcaaatcgccggcgaaccgagggatggctgcggcaggagacta

SEQ ID NO: 22906 - DNA, 5321 bp, Oryza sativa
  unsure (1)..(5321): unsure at all n locations
acccaatttatcatttttttatatattttctatttttagcagcaattttcatttaagtccctgtgttttattcaatttagtataagcagttcatcagttatacaaattactatgtaatgttcctttagaccactgatgttatatgttccttaacatatgtgcttattaaataccctgctttactaaatttatttgttgtcttaataacatgccttttgcatattatttcaagacacgctctacttcctcgctttattaatttacaaaattctataaattttgtactttgatttagcaaattctcttaattatgtacaacatgattaatggaggatttaatgcgtgttcgactgcacattttgactcagaaattactcacatgtagatggagtcctacaaattggccacactggtcataacttagggagcgagtatctcgcccatcatcaagtggtctacattttgagatgattacccgatggagtcctacaaattggccgcactggtcataacctaggcagcgaacatctcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctagagaccatgttctaggcagcaagtataacttgcccactattaagggatctactccactatttaattacttggagattatccatattgtgccacctaatttcgaattctaactcaaattgtcaggtctgtaacctacatcttcaaaacattacagaatatgaaatcttatatttcgcattgagattacaaccacaatatcatgtttttattaatttacatctgtaaattaataatgttaatcatgattatagggacatggcaactatagagttcgacgaactcgccctcgatgggagtaactacccaatttgggcttccgatatcaaaataaatttttcttctagtgggatttcacatacaaataaggaaccaaatgattgggatccatcagttgagaatagaaagctatatattgcccttttccttctgaggctttacatctataaatatctcaaacatgagtacatgttggagacaagccctgtcaacctatggaaatctctaaaagagcgttatgatcagaaaaaggaacttatttggcctgaggctaattatgagtgaattcatttatgcctacaggattttaaaaattgtggcagaatacaatcatgttgttcatagcatttgctccaagttgaagttttgcgaaaaagagccaacggaagcagagaagatagagaaaactctatcaacaatgtttctagaggacatgatactgaaccaacagtatcgcactcaaaggattcaagggaaattcctcgaataaccctaagaatctgactggaaaacgcaaatgcaacaaaggcgcaaatccaatggtcgacagaaaggtaaagggaagggtaaggcaccacaacctagtggcaatagcaacaagcattgcaacaggtgtggatctgactatcatgtcgctaaagattgccgtatcccaaaaaacatcttgttctcctgtatcagaaatccctaaaggagaaaaagtcttctgaggaactaagatttgaagctcacttcaatcttacaaaagaaagacctgaggttgaaagttctcactaggctccttgaaccagagaacaccctcgttcttctcccaaaggataccgctacactttctgcaatggatgacatgctcatcgaatactgctcaacggacccacttagagatttactgtaatctcagtgcatcccacttagagataaagctgctttactctcagtgtgtttgagacattatattgatatcctatagtttgtcaaaacaatattagttgtaataagtagataagtacaaactcccttatattataaggttgtaagacttgacagtccttagagtatgtactataaacctatgtaaacgtcatactatgtgtttgatgttttcattattgtatgtatgtatatattgtggataaagaattcttcactaagcaattcttctttcactatagatgtctaaggatatcgctccgattggagaggaattatgtcttgtggacagtggtactacaaactctatacttagggagatcaaatactttcaaactctcaaaaagagagaaggcaaagttttgactatcgctggacgcgatactgtgttagttggctcaggacgagcaattattacactcccaatgggtacacaaattacaatcgaagatgctttattgtatcctgattcaactcgtaccctactaagttatagagatatccgtcaaaatgggtttcacattgaaacccatatggataatcaagaagaatttcttctcttaaccaaacaaaacggatatggcaaacgcatttgtgagaaaattccatctctcacatcgggattgtactatacatacattaagcccattgcacatgttgtgtacaaagtaatttttcaaaatgttgatgcattccacacttggcatgatcgacttgggcaccccggtatcgagatgatgagaaaaattattggcaactctattggtcatcatttgatcactgacaaatttccaaaatcctctgatttcgtatgcactgcatgtgctactgggaaactgattttgagaccatcttatctcaaaattagagccgaaccacttaaattccttgaacgcattcaaggagatatctgtggccctattgtgccaagatctggaccgttcaggtactttatggttttgattgacgcatctactagatggtctcatgtgtgtcttctatcgacacaaaaccatgcctttgccaaattaatgtctcaaattataaggctgaaggcaaattaccctgaacataggattcaatcaatccgtatggacaatgctgccgaaattacatcccatgctttcgatgattattgtatggcattgggaattcaggttcagcactctgttccatatgtccacacacaaaatggtttggctgaatcgctgatcaaaagaattaaacttattgctcgaccattattgatgaatttcaaattaccttcgtcgtgttggggtcatgcagttctgcacgctgctgaccttgtccaactacgaccaactgcatatcatgaaacttccccaatgcagttagtacgtggaaatcctccaagtatttcccatttgcgtaagttcggatgtgctgtatgcataccgatctcaccaccacagcgtaccgctatgggcccacacaggaaagtggggatctatgtgggattcaaatctccgttgatcataaagtatttagaaccgttaacaggtgatctatttactgcccggttcgctgactctatttttgatgaggaacatttcccggcattaggggaagacttcaagtaccagaaagaatgccaggaaattgattgggatgcccaaggtattcccgcctcagacccacgtactactgaaactgaacttcaagtttagaaaattatacatttgcaaagacttgcaaatatcctgccagatgcatttaccaattataaaggtgtgattaaatctttcattcccgctcagaatgcgccagaaagagtggaggtaccaaataaaaccactcaacttccactgactaaaaagagaggaagaagtatggccactcagcaagaaacaattgctaataagcaaagaaagacggtaaatgcaaaccaacctttagttggtgcacaccaaattgatactatatatcaagcagatcgtgatagtctgcaacctagctcggtggtgcacaatactaagactaggaattcggaagaccatagacacattgtttcgagagatcacaatgaatctataagggttgatgaaattgccatcaactactctgaaactggagaatcttttgatagaagagctacaattgtcgacactaatttttctgaacaaattgctgattgcctccaagttgatccagaacctaggtctataaaagagtgccaaaagcgctctgactggaacaaatggaagtacgcaattgacgcagaattagcctcgctttacaaaagtgatgtattctcggctgtaatgcctactcctcgtggtatctttcctgtgggatacaaatgggttttcgtccggaaacggaatgaaaacaacgaggtggtgagatataaagcaaggcttgtagcacaaggttttacgcaaaaacatggcgttgatttcaacgaaacttactctccagttatgagtggtataactttctgatatttaatatcattggcggtacaaaattgtctatttatgcagttgatggacgtagtgacaacatatctttatgggtcacttgattctaatatttacatgaaggttcctgacggaatcgacatcccgaatcagaaggtaaatcgtaacatgtattgtgttaagttgcagaagtcactttatggcttaaaacaatcgggcaggatgtggtataaccgattaagtgaagaatacatcacttaatagcagaaacttgacatgagagtgaggtcactggttatgacaatctagcatacatcttgtcgtactcacgtccaacatatacgtatgatatctgccgcactagaaccctcccccgaacctaaacaagaaaataatacttgaaatctaatttcaaacaactacgatgctacatactaaaggaaacccactattacttccctgatagagaattcttaaaaacatgttgaaatcctattgtctctgtttttgccataaaattaaaattgctatatctaactttagcttcagacatgtccattgagactattttcaagacaggacatgatatgtcataattattgcaaaaaaaaggattaaatggaatgaaaaaaataataagttaatgccatacaatagaaatcaacacagtaagtaggtaaaagtaatttcatcatcatgccaagctttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22907 - DNA, 525 bp, Oryza sativa
gtgggaggattcatactatggttattaatattttattggctttgcttgtgggtttgtaatatgcaagcaagtcataatcatgcaaccaataagtaatactacctccgtccaaaaataagtttagttttgcacggttcatatttaacgtttgaccgtttgtcttatttgaaaaaaaaattatgattagtatttttattgttattagatgatagaacctgaatagtactttacgtgtgactttttttaataaaaaattcataaatttttcaaataagacggacggtcaaacgttggatacggatacctatggctgcacttactttgggatggaggtagtaagtaataacgaagtcctgcaatggatattgatggctatgcatcgctctagtaggtctaatttgaaacaggtataggatgtttcctgttcatttgatggcacatatccccaatagaagctaaaattatttttggaacaaaacctgatcactgattgtaatagcaaaggaaataaaccctatgctgctg

SEQ ID NO: 22908 - DNA, 292 bp, Oryza sativa
ccgcccagtcggtcgccgatgttcctcgccaacacggccatcatggtcgtcttctccggcgtcggggccatcggcgcattcgcctccatacggagctcgtgctcgacgctggacagtttaagctcttcagcaacaacgtcgtggactaaattgaattatatatgtccgtatataggaggtatatatatataggcagcatatatatatatatatcttctagctaggtccttaattacattgtatcttgagaggtatatagcttaatttgttacttcttttttcgggcgtacag

SEQ ID NO: 22909 - DNA, 745 bp, Oryza sativa
aaaattgcagaccacgcaatttcaagtcctacaacatgaccaacaattttgtagcctttgtatagcctaatcaaatcttcggattttgccaatgcaagatcgacatgaaccattaaaaattcatttcctagctcaacacctccaactctgcgtgttggatcacaacttacaatagtggcaagagccatgtttgtattccgatttttccaactttttaagaatactttagttccaacctgaagtgcataaatacatccatcaatattatcaatgtactttaagaaattcaagtatcataaataatttcacagtaaaatacctccattgaattgtcagtgataaagtccattttgctgcactgttgtttctataaaaaaaaatttggatcatggtttgcaatttaaccacaagatagaaagaaagaaagaccaaacagagccaattattgttctccaattcaatcataatactagtgaatcatgcatgttatagtttgaatggactgatatttgtaaacatggtgaataaaaaaacaaccttgtatgcaccaccaactttatgtgcatgtaccatatggctgtcctgattgtcaggtttcttgttctataggggagggcaacaaatcagtgctaaaattatatatattaagaaattttactttcaaacttttctatcaaataacttttgaactcaataagaagtgaaaactaaccttggcacaaataatctccatctgtttcccatg

SEQ ID NO: 22910 - DNA, 382 bp, Oryza sativa
gcctataagccaacaagcacaatttttcattagcacgcttggtttgggcgttttgatgttacaaattactagttttttaattagcacacgctttctaaactattaaatactactctctgtttcaggttataagatgttttgactttggtcaaagtcaaactaattcaagttagactaagtttacattaccaaattagttttattaaattaataattaaatatatttttataatcaatttatcttgagtcgaaaatattactatttttttctataaccttggtcaaacttgaagcagtttgactttgatcgaagtccaaacatcgtataacctgaaacggagggagtaatgtttttatactaaatatatagaagttttcttaa

SEQ ID NO: 22911 - DNA, 33524 bp, Oryza sativa
  unsure (1)..(33524): unsure at all n locations
ttcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaagcagtatatatgtgtctgtatgtgcaccatgcatgaatggtcaaatcggaaccgggaacttcatatatatatatactccatgttgtgcatatcaagatcccctagttggtacatcactagtttttttttctacatgttatttggtcttgctaacatttgttcatgttagaatatttgcatctgtagtttgtaacaaaatgcacctgaattctatttgaatcttcactatatacttctaagcacttgctctgaccctctgatatatacctctgatgctggtgggctccaaaaaagattgtcacgtaacttggagatatatatatgcttgtattgggtgtgacatgtaattggattggatgggataggtcagtaccaccactttgaacgatgagggtgatgagatgatgttccagttatatcttgcatgactataaggtctcagccttacaaatctggggtgtaactttagatcctacttcctagcttgggcccatatttagatcgtaagtttgcttattcaatgggctcgctctataattgtttttgtagctttgatggtgctgatctacagcaatcaaacagctaaatggaagataatcttctttgatgcaatatcataattttattgagctatgttgactttatatgccactgtgtgcgcctaaacaagatatatttgatatgaacatttttacatcttaaatgaaaatttaccatgggtgcaaaagcaatcgtacaaccaaatgatggggcattctaaacatccatcggatataattgcctgaagacaggaattttgactgtctgttctttgctaaaagatgatttttttacatggaatttcattggatggatcaggtccttgtgttatctccaaagtttagccccgagaaagcataaattcaatctattacttggacttgcttgtccttttcattatttctactgttctctaatcccttgttattctcaacatatgctagatgagcgtgtctcaagtgacctgaagaaaaacctcatgcaagcaaggctggacaagaagatgacccaggcacagcttgcacaggtgccctgtccaaccatacaattttagaatttcctagcgttacattaacttttaccacagccactcgcacatacactaaccttcaactaaaatatggtgtgttttgcaaacagatgatcaatgagaagccccaggtgatccaggagtacgagtcaggtaaagctattccgaaccagcagatcatcgggaagcttgaaagggctcttggaacaaagctgcgcggcaagaaataatgttctactattaggccctgaagcatagtgttggagcaaccaaagccaaaatgtttgcgtaacctatgctgggtcttttgataccatgcaggatgtttctgttggtgcatgagtgaatactgaataactattatgttgtcgcaaaccttgtaatgctgccgctctttgtgtgtcatagtccctagtgtgcaagagttgtgctggaccttaaaactgacttgataacctgcgtggtttatgcatgatgtttattaaaatatcaatgatctctttggctgtttacaactgatatattttcgtgcatgctgttcgagtgtggctatcttgtccagttgcgccaatggtgatcagcattcagcagttgaaattgtgttcttggttgtgttaaatgaacggatttgactgaaatttggaggttccagttcagttctggggtcttgtatggaatgcatgattgtgaaattgtatggtttaccacgttcgtggttgcaagcaagttctttaatttaattattttccaatttttagtaagagcattgaagaaaattaaatttattagcttataggactatgttaaacaggtctctgcatcctatacctctctatatggcattcgtctcgttgtgatttctcccttgtaacaaaccaggtcagacgttgagcatgaacatcaggctgtctttgtttgattgagttgggaacctttttctctcacataaaaaacgagttagctcattagtgtaatgattaattatttttttaaaaaaaacccttaaaatggattagtttaatttttttacaataacttttcagttgatttttttaaaaaagacacactgttcagtagtttaaaaagtatgcacgtggaaaactagagtgtagaaattgggaaaggtaaggaaaaatacatagccttagaaacacaaccaatctccgacacactatatgtagaggaaagggatcctctgacgtgaagttagagggatgtggtcagtgacatgtgtgggtccatggactcataaacccacatgttaatgaacatgtcagaggggagtccacactagaggatccctttctatcatagtgttaggatgcattggagataatgaattaactcttatactatcattgcttataaccttgaaagccggatgaatgtgactctcggtgattttcacctcactcatgctctctatgggcctgttcggctaccatttatcgcagctgcaagcagcacagctgcggtcgcacaaccaagcgctgcagccgcagtgctgccgcaagaatggcagccgaacaggccttatgtattgggtaggtgggtgtaggggtgaaaacggtacggaaacggatggaaaccatctttatcgttttcgttttcatatttttttcggaatcggaatcggaaacctcggatacgaaaacggaattgaatattatcgaaaccgaaaacggagcaaaaacgaaccggcgcgaatatggtaacgaaaatttatcggaataaaaaaacccctcaaactaataaatccaattgaataagttatctatgtttaaaagagtaatgttgttgataaatcccaatgtaggaaaaaaaatattcttatgtaattttagatttgcataacaaatatttttttaaaaaataacagccaaacaccatggtattcactatttagcgcttaaaaaaaagaatccagggtatttcagtcacaaaatttctggtaattccgagaaaatttccgaaaattccgagaaaatttccaagaagtttccgaccgattccgagttccgacgaaaactgcccttatcatttccgattccatttccgagaaaatatttccgatttcgtttccgtttccgaaaaattccaaaaaaattccgaccgaccgattccgttttcgaaaataagtctggaatccggaaagtttccgtaccgttttcacccctaggtgggtggggtccacaaacgtttgatctaatgcagggttggtagcgtccactgcatgactctcttcacctcgagtacttccgatttccgaattctcttatgtggacttctgcaaggaggaggagatggagagacgacgttggcggtggaggttggcaatcaacggcgtagggagaagctgaggaccttaggaggcgtctgcggcgcaacagaccattttgcatgtttcaccatggcgcatggtgccaatgctagcgcctcgtgcctctggttatgcttgttgtgacagagagagtgcgttacttagattaactaatagatggtatggatggattgccttatgtggaataggccaaatagagtggatgcatgggctggatagtctactaaaacatctattggataatccgcttgaaatggcgaataatccgcatcccacgtatattgtcaataccacatctatctccgaactacctgaatctgaatccatatccgtcggatatagataaacccttgcctattttatgtactaatattgtacttgcctattcattaaatgaagtcgtgtataaagtttgtataatatgtatatatacattttttagtctatgaccttttctaagtgaaatacaagggtggattcaataaagtccattctaatggttaagaggatcatgcatttgaaaatgtcaccatccttcttatcttctggtcctaagaatgagtgaagtgctattataatgaattttgactaatgtctattttaggctttattctaaaaattagtataagcgtgtaaccctaccattaatgctaaactaaatttccaaatgaccctcccatcttggtatacaaccaacattaaaccttagacatctataatcattattttcttttgcttttcttttcatgcattatgctcttgatataattttgtatttttttatctagtacgtcaaaaccatgcagcacagccccgtgatctcaaccgtaatactggcacctgttgactccgtttcatccgctctgccctaacccccgttctcatcgtcccccaaatctctctctctcctttccaacaaaacaaaatctcctcaccattagtttcaacaaaatctctcacttcctgttaccagaacattccttggaatcctcctgagtggatcagatcttcgattcctacaaggtatattccattagctgcgctgccttgctcactcctagagaagatatcatcatataataactcgaacgagaaagtgctaaaacatgctttttttcctttttacgctagagcgcttgaatcgccgatcaagaaacacggtcgtgtcgatatagttgagtactctctctgtcaagaaaaaaataatcaaaccctagagatgaatctggacatatgtgtgtctagattcaccttagggtttaattttttttgttttatttgtgtatttatactctgatgaaattagagttactctgatttcatggtaatcagattaatttgggcgttagatttaagaaagatagaagagagaagaaaaaaaaggaaggttaaagagggcatcccgagggcattgtggaggccgatcccttcccccatggtcggcgtgctcgccggttccacccaaaccctagcaacctcacgccgccacctccctcgccgccggccgtcgccctcgtcgccgtgtgtctccgccgtcagccgccggccgccctcaaccgcgggctgctgattctgctttcgcccgcatcggccacctgaccagggagagagaggaagagaaggggggaaaggaagaggagtaaaaaggagaaggaagaagaacacaggggggaaaaaagaagaagaagaagaagagaagaaacggggaaagggaagaattcggggatttctctgtgggtttcgtcagatcctccttcgatttgtggttcttgctgccagggtaagctcttgttagtccctagttgcactacctacacttaggaaccaaggttttttagacatcaaatagttgattggaatctgttcttgcgacctatgagctgatatatatcgtttcgaaatctgggatttattcatggggaatcggggctcttggtctaaatggaagttgtagatttctctctaagctttccgtagagtattagaacttaaacttttggtcaggtggtttgggagaaaagcccctgggagtgctgctgtttagaatttgatgaccacatgtagcagtttcagtctttcccttataaattatgatggctatgtgggctcataactagaaagtcttcacagaaccaaatgttgcaggagttggagaaagaatgaggcggttatgtgcttgcgaagcaactgtccagttttggacagaacagcaatcatcggttaaaactagagtctttttaagcaaactagggacaacggctaataacgaatagttagcgaacttttattagtctattacctgaaaagtattttactttggacggagtgttaagtgacgattttgagagcagagctctagcaggttgcacgtagcacgattgttgttctctttggttgtcatcctgtcctgttttgagttgtttttttaatgttatttgatgaatgttcaggtcgtggtgcgaatcaagaagtggaaacctccacccatcgctcatcttcacgcggttaaggcaagtatattgttaaacagtaaatgggcggtgattataaattataatgtcacaagatgccgcctcttgttctttctgtatcattaatgcttgttatgaagttatggaaatgttatggtggtataataacggttacaaggtgaaaatggagtaagtcggcatttaatgttaaatgcatttgcattatatgcatctatggtatgaagaaggcccaccttgtgtgggcatatgggcctacttttctatgttatgaaagagggtgaatgttgactggcattcacccaagcaataccaatataagtaatgacatgagcaaatgagcatgtagttagctattcattgcatttggagtatgataaatgtttaacatggcaatagaatagttcctatgtgatgtttactgtttaattcatatgctttgctgaatcctgtactcatgcttgttgttttgatgtttttccttgttaggtaatagttgaagccaacatatgcatggggaacgggtgtagctccatatgagaccactatatatcacttatgcaaccttatcactactttagatgcttagttaatatttaagcttattcaccggattattaaacatattatttgctccacacttttctgaaaaaacttctaccacattgtgtagaccacctgttttaagctacagtatatgttaagtttatttctcgaaatatttgatttacccctatattagagtagataatctgcaacaacaatctactcgataatctaaatcaagtagggctgaagtgctggtgtcttttgagctttggctgcaagcgaaacattaatgatcgtcagtcatggttatgtgtgtatggctgctgtacctgtgagcttgtttagtcttatgttgaaatgattatttggttagtctagtctctagtgtcctttttgcagaggtggtgctgccaaaatttgatttttttgtagtatatttatgtgtgtgctgttggtaggatttaggctcacaatctccccgaatctttctcctcaattccaattccattctttgatgcaggagcgagcgatcaaatcaggggataatggaggaggacagcgtcatcagcaacggcggcagggaggaggaggtggtggttgcgaacggcagtggcggaggggtaggggggacggcgaggagcagcggtgggggaggggggaaggtggtgcaggtgctgcagaggaactttggcgaggtgcaggggattttggagcagaaccgtgtgctgatccaggagatcagccagaaccatgaggcccgcgacgccgatggcctcacccgcaacgtcgccctcatccgggagctcaacaccaacatcgcccgtgtcgtcgatctctacgctaatctctccggctccttctcccgctctgtcactgccgctgccagcgccaataacaccaatgccaccaacagcacctccccttctgctgccgccgcagccaaggcaagcaagcggtcccgcgccaccgacaccgagtagagcgcctacaactccggctatccgatttcttctccttctcgcccccattttgttctcgcttttttctttctgtctagaattttagatttactgagcagcaggaggacaggaggtagattcggtatcctgctaaactctttttctcttttccctctttttttctcttgatgtaattcagagctgagatggacatgacaacagtaaacacctgccttgtcagagattaaagaaagatgcagatatgatagactgatgttttcactgtcatgccagcacccctctttgtagtgagaatgttagggaattttccaaccgtgccccattggaaatggttgatggtttttctgacgaagtataccgattttatttggaatttgcacacaattcgttatatcaacagtgtaatctgaacacaagcgaattaccattttatcatataattctcctgcagtaacatgagattctcatccagttaaataaaatgtttctccatgacgagttattgaaaaccaatccatggttcgctcgcctcaacaaaacgcttattcagcaacatggaagtttcatggaatataagttcactttaggtccataatcttgacattgaatttgaattgtgtaacgcgtcttttaacttgtaattccggtgtacctcaatttcagtgtactcaagatcatagagcagtatagtgcagacatggcgagttgcttacggtcaacctagccgagtcgggtgtgggacccacatgtcagcttctccaccctttcattctctcctcttgccatctctctctacttctcccctctctttctctatgccaaagtggtagacggagcggccaggggtgaagcttggctggagagggtaggtgacgccaccaacgccatcctcttcggcatcctacctcaatagacctcggcgacggtgcacggacggggccaccactgacaagatctaccgtcttgcatgttcttggcgtgggtaaacctgctccaccttcctctaggacgagccgtcgtagcagcagcagcaactccccactgctatggctgctatggccgagtacatcaccgtgtctgcttgtgcccttgcgccgccgacgcattcgacctaatcttcatcgatgatagcaacgactatctctctatcctcctggagctccgtcgtccctctcctccactggcagcatgcctttgccgccttcctccccaatagccgctcccacgttccatctcacggcgttggcaactgtggctccagtatcagtgtggtggactgctcacgggtggtctgtaagtgaggggtggaaggtatttttgtgtgtgtatgacatgtaggtcccactttgacccacgttgatggaaatcagggactattctgccctgaaacgtcaggtatatcggtattgcaagttatctgatattgcagtttaaggatgcaattcaaacatcaagacgtaaagatgagagaaaaataaatgaacttttcttttcttttctttccaaaacaggccaaagtgccaaacgctgtttgtggattgatcgcaaagaaaaaaaaataaaacagcaagtttcatccatgatgaagatacgatattctaaatttctaatgcaagcgtacgtgcaactcgccactccttttaactgaccctacaccacatcattgggcggagattgcatttgcaaattgcaattacctccgtttctccacaatcgcatatatcagaatttttggaacagaactatctgaacagacagagcagtacataaataaaaacatggcacatagcaacaagaaaaccagaatcatatgtttatttatgttataaattaacttcacatacaactattgtcaaagattcaaattaagctaggggtcactggttaaaatacattattacagtagcatagcgtcaacactaaccatgtaagaggttaaggttaagtttaaggcttgagggttatttggtttgctaccattttcagccacaacaaattttagcattttaaagtaaccaaccgaacatcaaacattgtcttatattcttccacacctaaattgtctacttctaaaaccattctcactcaacaccatacaaaaaagttcggtaaatgcatcaaaaccaagcacgccatttgtttcgttcttatgagttgccaatatattgtggtatttttcataaattccgtaggaaaacggcatatcttattattctcaagccggcaattttaccggattgtgattggaccacatggcatcataaaaactgagataaatcatgcaattactaataggaaaaaaaaggagaaaaactcatttgtgctgcatcaaaaacagagagaagaggttaaggaagggaagtctagaactttctcaaatctgaactagaatgagatagaaatctgctctcttattcttcatcggttgtttcaatacccaacctctagctcactaatctgattatgcactaaatgtattttccatcgtactactttacaggtccattaatttagtcactaatagaaaaataaatagatgaggaaaagtagcattaggaaaaaagaaaaaaaatgttttgttttcaaaatacaacacatttcactacaatattatacaatattatagatacttatcacattgaaagctaaaacacattaagaggttctttgaagctcctttagcaaattcatatttcactaaaatatatgtacgtgccattgactaatgggcatataagataaagacatgatggtcatatagtcagcgcgccaagctgattttctagtatatatatatctagctcaatgaaataaatctctattgatccgtttccacttctataccattatgacagcatgacaaaccttttataccattaagatatcagaataaacaattatggtatgactgaaagctccacagatgaatcggttcacagttctgatatacagtgttacctggactcctaaatttttaccgaatcggacaccctatatccaaatttatgttcaacattgagtctaacacccgtgtgagactccaagaaggattctcatctatagttcttttgtgccaaattggagacgcaagtcctgagtcggatgttcgtgtccatgtaacactgctgagtgctgatataacaaactatatataaattccgaataaaatcagtatacttggttgaaaaaaccatacaccatttgcattggcacggtcggaaaagtccctaccattctcactacaatgaggggtgctggcatggcattgttaccatgtctgcatctttctttgatctctgataagttgggtgtttacggttgtccatgtctatctcatcgctgaattacatcgagagaaagaaaacggaaatttaagagaaaaaagtttagcaggattccaaatctacctcctctcctcctgttgctcagtaaatctaaaattctagacataaaagaaaggagaagagatcgaattgctggagttgtaggtgctctacttagcgtcggtgtcggtggtgtggggttgcttgctcacctcagctgtggcggcggcggcggacggggaggaactattggtggcgttggtgttggtggcgctggcaacgtcggatgtggtgtgggagtgagaggagccggtgaggttggcgtagaggtcaacgacacgggcgatgtttgtgttgagatcccggatgagggcgacgttgcgggtgaggcgatcggcatcgcgggccttgtggttttggctgatctcttggatcagcgtgtggttatgctccaggatccctcgcacctcacctaagctaagtggcgggtcctgcaccacattcccccctcccccatcgccgccgtcgtcgctcctcgccatccccccgaccccttcgccgtcaccaccgttcgcaaccaccacctcctccccaacatcgttgttgatgaagctgtcctcctccatcatccccagatccagtcggattgattgttcacttctgcaaagaaagaagggattcgaattgaggagaaagattgtgggagattatagggctctagatctatatggccaaatcaagaatatctcccttgggaaatggggaagggcaacagaagaaacgaagtgtaccttggaggagtcgaagatctgatctgctgctgctgtataggaggattccaaggagggttcaggcacgggaagtgagagattttgttggagcagaaggtgagagagattttggggaagaggaggagatcaggggttagagtagggtggacaagacggagatggtaggtggccgcgttgcggttgcgggtgcggtacggcttggcttgataccttcttcggtgtggcgtgggctatcccgaggaaagggccgggctgggcagatatttttatctggatcgaaatatgtcgtgtggatggctttgcttttgtggtagcctatgtttttgcactgttgctgacttggacttgagcttaatattatgattcgcagatcaatcgatcgattaattcgaccagagatactagtgctgttggtacctgcaacttgcgttgcatcgatcgcgatctatctatccatctatgaacatatacaatcatccatatagtatatacagccgtactttcgaacgaattcagttgttcaattttagctgctgctttcatttttcctgcaaatgtcaactgaagcttaattgccaccaaacatgaaacttacctaattatttaccagctgcatgcgttgtgcacccatccatccatccatttttccattgacttgacaagtccatgatgcagcatttctcactctatcattgtcgactcgatcgtttgtggttgtgatgcatacatggccctgatatgtttgtttctttttttaatagtttatctttaattgaattacaaccctgctatgtcaaaattggcatgcataaaagtcattaatccaaattgagccatacgttattgtgaaaatgggtgtgagtgtcatagtaaatgcacttgttttggaggtacaaaggcatcattgtgccctaaaaaactaaaaaggcaaaatttgctgaaggacacataaacgtgttggacacctaaaaaacatgacacgactgtacaatgaaagaatacctgtaatttgcaatgggatactgtatccattattttgttatttccgagcaagtcaaatggagaaagaaatcccataaaaaaactattttgcctctcaggctagcaagttgtaacacggctgggtctggttcaaaccagacccaagccacattccgtgctctaatcccctcttgatcaaaacctaaaaattggaggcagcggcgacaatgtccacggcggagccgcggaggccattacaagttgctggccttggggcaaataagtcgtttctaaattttttcctctctatgtagcgtaaaaatgataaaataacaaatagttgtggtgttcccggcaaattacctgggttttgggtattctagattcatatcacgttttacagtgcctagcaacaaagaccataactcaaacttttgagtgtcctgtagcaaattttatcaaactaaaacaaacttatgtaaatgcatcaaatatcgagccctgaaccatcaaacttttctcggaagatcgcatcaagacgttcgctataaaagttagtcgatatagcggaacgacgactaaccttttctcgatcgcttcaatcattgaccaccaaatacatgctagatgatgacataggaacgcacgatatttgttaacaaggtttagctgaagcctacatcccatcctcggggctctgattataggcgctcctccctaaccaatatagcacctagctgctacgagtccatggcctcgccgccatcatctccctgcgtgtctacgctacattgtagtcaccatggttatatagtggtgcccccctctctatttaagagagatggcgagttacagagtttgactctaactccaccccctaccatttattacaactccaagtccaactgtagctaaataggactagtatattcgacatctattctaacaaaatgtgtcaaaaatagtaaaaatataattgaaatgtagtaatatatctcataaatccaagagtttgtggctcaaccaatggtggctcctcctcttcaatttgaacttcctcatcaataggatatgcctttttttcacctttgcttcatgtttccaaaaatgtgatgcaatgtctccattccttttcatgtctcactgcaatttacaccacaaaataaagacataaccaacaatttttcactaacactactactgtctactcactactgcatagggcaacattgcaaaaagccaacaataaatgtctactgacctttgaactttgtcgggcagcaggagagctggagagggaggggacctgacaccggccgccggcagaatggcgacgtcgcttcaacgcctccctttcttccctttccaaggggtgggggcgaccgccggactgggcacctgggcccaagcgcctaggcagccggcctataggcgcttgccgcctcccgctggcgtaccggcgctgcccgacaggggtgggggactggaggaggcatagaggcggcgccgaggcggaggcggagtcgggtggtgccgaggaggacttgaggagggaggcaggagatggggaggtggcatgccgacgcggaggcaaaggcgggaaccggggaggcgatgtgtcgggaccatcgtgccaagcctaaggtgaaggtggagtcggagtcggagtcgggacgcgaagacaaaggaggcagctgccagccagcaatgcgtgcgactatggctggcggttgtctgtgcctctccctaaccctagcacagatcagggggtgtcctcatgggcaaaattctagggtggtccagggatcacctgaaccgcccattggaactgccactgctagcgacggggcattgaccggaagaatctacttaaataagtagagaaatattttcctaccaactatgcttcaaataaatttttctcttaaattactcatctgatctacgatccgattacactgttgtgttcataacaattaaatctttataacaagatatcacatgattatatttttttaatgaaaacttacataatactttttacaatatatataaattacctttagatttcattaaattacttcttagacgtataaaagtaaattcaataaagctgaaaagtaatttgcatatatagaagtaacttaaaacaaaaggaaagtaacttgtcacgacaatagaagtaaatccgtttgtgggggtaaaaacatgagtctatataaatattaaatttaataagtacaaattatggaattgactaaaaccatttgtcagggttacagttaaggtatactctctacccttggatgtatgccgtatactgatatggtatacctacgcgtatacggatgtttcctgtacacgttaaggaaattcatcacgtaatagaaacggagtccacggatggaaggagtcctactcggacagaactgggtcgttactgtatcgtgtggggtccgatgtctctgagttctacttggagaccaactgacccgcggtataaaagggacccccgggaggacctaaggcatcgaatcttaccgccaacataaccaccacagcctacgaagtcagagcctataggagccaagtcaccgggtgatctagtcgaaccaactcgactagggtctcgtcggtatcatcgagttctgctattccctttgtaatctgtggtttccattatataatcccataccaactggattagagctattacctatcaaggggcctgaaccagtataatcccttgtcacgtcccaaatcgactctaaaatacatcctcgaaattgtgcaaagaataattaaaattcatgtgaaagcctccaacaattaaaatgtgcaaagataaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaaccctaaaagaagtcctcttcccccccttcctttcttgggccggctcggcccacttctcttccctccctctctctcctctcctccggcccatcggctcctccccgcgcgcgcgccgctgacaggcgggcccgcccgccgccctcgctgacgggtggggcctacctgtcatcgccttcctcgcgccgcgcccgccgcccgcccgtgccctagcgccgccgccgccgccgaatccgccgcatcccgccgtccccgcgcgcattaaagtggggggaattactccccgcgattccctctcccgattcccccactttcccctctctctctccctcggattcgtccgattttgtgctcgcaaagttcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccccctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgcttcggccgccgttcccgtcgtcgccgtcgaccggggtgagccgaagaccgctccattcgcttcccccttccctcctctctctcgggtgccgctccgccgcgccggtggtcgccggcggtgaccatcggggcgcgggcgcgtccccctcccgtcggccgtgccggcgaggctgccttcgggcgcgccctcgcggctgccaagtgggcccggccgtcagccgcccgcgcccgcgggtgcggctgacgcgtgggacccacggcgccggccgccgtcagccgcgtgcgcccggtccaccgtggaccgagaggctgacgcgtgggccccactcccgtggacccggtccgcgcgccctctccctcggctgacgcaataaacccggtttttaattaaaatttaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaaatttaggtagatgcttcgcaagttaattaggcaacattaggtggttttataactttagacttgggaaatattcatatcacctggacactgtggaattgttggtgaattgtgaaattgggttcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccgtaggcgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacttgcttaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaagatagtgtttacaaaatagccctgagcaactaaatgtctttaaatgctgtttactgcaacccgaaccctttatgttataattcccttgtactcccttgcatttattctgcatttgtgggtgtgtcttgttgagtacggtggttgtactcagtcttgctcaattttttcccaagcccagaagaggagctccttgaagatgaaggctttggtgtctagctcgtgcctgccgtcaagcgcctgtggtcgtcgccctagtcttccgctgtttttcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaagttggtatcagagccatccttgaccctaggacgagccgtagatcccaagccttagcaatattttcaaaaataaaaatcctttgttatttgtgaaaactgtctagtctctctctgtcttgctgcttcacttatcatcaaaatctgacatttgaaatcttgcttttctttttgtttttgtttgtagatggccggcagcgtcacccgtcgtggtttggacatgactggcttcgtcttggagctgcggggcatgtgcgtggtcttagggtatccacacggagtggactaccaggccaggccgcttccggatcaggagggagacgacgcggagccccgcgctggttgggaggtcaccgcagtgatcctctccggctctcccgagcggacttcgctggcagtcaccgcgggtggagacttcaataaagttgatttcaggtaaagactacgatcaaagtgttccttcccgacgatcccttaccacgacgacacctagcgttgaaacctatcctcatgtccctttatgctgtcttgacgaggcctctgaggaacctaagggaacttcggctggggacgcctagagcggataaggccttgtcggatcatgtagagacaaacgaccatgtaagatctggtcatgtaagagttctcgccgtgcgtattaaccaagccgtgtaatcggaaactgagttttccaacttcacggctgggggctaggatcagtgcttgttcaaccaaggcaggtcaagggtccaagagccttatcttccgagaacaattcttcgaagacaagtttgggggctagggagagtgtatgactcaagtgactgatcgaagtcgtgaagtgagaaaacactcatacacaacacatctagagtaagaaaacttagttagatagatttttttttctatttctcaagtacttcttacaattcataattgctccaaaatatattacacgtctccttgagataattttaacaggacataaagactaccaggacggccaacgctagtccatagactgaaagactttctccgcaagcggctccatcgacttcgccagattatctatctctgtgggagtcctccgagaatgtgaaaacccttcgtggaggaactcgagatgtcgctgcgggcggtgatctcggatacaggccagcacgtgccctctggcatatcggctcgatcgacgaaactcctgcttcagggcctcgtcgatacgcttgccgatgccttcaagctgagcgcaggccccattcaaccacgagatgtatccagccgctgactcctcgggattcccgcgaggtactcggagttccctgcagactccagccatggccatacaacagctcctgaggtacgagttgaaccacacctcgcaaccttggagcgcttccacggcttggtcttttttgacttccaccatagtcctcttgagtttggccacctcggacttcgtcctccaatattagatccgatgatctcggccggccaacacactctccaggtctgctcaacacagaaatgactaagtcaagtcattctcctctttcgagaacacgacaaattaattcgatccgaacaaaagagccaaggagatgaagactaaaagtaccaacctaagaaagtcatcgccatgtccgcctccccggacaggctttgatcgatatcgtcccgctgcacatacggctcaagcgcaagtgctggaacgactaccggcgactcaggctgcccgcgctgctggacatcctcgacatcgacatctctacaacgacaacaaagtactcggaatcaacatgctaaagaaaacgaaggaaacaacttcatacacaaaagcagtttgaacctacgaaagttttacaagcataattgagtaaggagtacaagggaaataaagtcctaatcttcaaaaatggggagaatagactcccccaaatcaccgacttcttccatcacgcccttgcgcgcgtcattggcggccccctgatccagaatcctcacgccaacctcacgtacgcgaggacgtggcaccccctggtgtagatcccattcgatgtctcctcgccgatcccggccgcatgcttggaggggatctcctccatcgccgcagctagctccgcgagcgaggacgtcagcgagaactcatcgggggttgtcgggatggtggtcgtgacgctacactccccggtgagttggtgtagaccggtgtaagacacccgcagcgagccgcggatctccgacaggttgttctcgagctccgacatcctgtgcttgagcccctgccgctgccgttcgttgccggccaccaactccctcatcttgaggaggtcctcgcgggtcttcgacagatctcgcgccagctgctcggcgcgttggattgccgacaccgccgccgccctggcctcctcgatctcgcggcccacgctgcgggcaccagcctggaggatgcgctccatctcagcttggagctccccccaggtgagggcatcaactggcgggccccgagcgggcgcaagaccgccagcgggtccactcagcgtcgcctcccggtccctaactgtgactacgatgtccgtcgaggccaccacgggagacacattggaggtcgcgccggacccatcttgcgccgccttcgaccatgccgccctgggaaggatttccgcaatttcatgaagacatgcaagcaagagtttgcgaataggatgacttctaaaacgtctacttacttctcgccaagcgtcaccagcctttgccttcgcttgggcggaggagacgcatccgaggcctgaacaagatagcacgatatgaggtcaaagtattccgactacacgattaagaaacatgagaggcttaccgacggagtaggcgctttccgacggtttccaagtacagaggagaacttcctccctttctttggaacattgttgccactcgtcgtggcagcagcaacagcaatgtcggacgcctccttggcaacgccctcctttaacgacgctgccgcctggtgatccgcgagcagctcgatgacgtccgttaaagggagagcctgcatacatgatgtcacaatgcgatcccaggaaagcaaaagtaaaggagtcatcaaaaacactcacgttgatcgcagcctcgcgatcggcctttcccttctcgcaaagggggacggggatgttgctcactgtcgtagggccgctgatcatcacttggccgatgcggcgctccacggtttcgttgttcaaacctgtaggatcgagaaccagaactcaataagtcaggaggaacatgcacataaagaatgaaatccgaaatacaagaaaaataccccgaggagaaacccgggtcgcgtcctccggcctagaatagtcaaaggctgggtgggcttgagcctggagcagctggatccgcctaccgatgaagtcggcagcaacttcataccccgacaaccctcgtactcggaggtcatcgatgatatcgatgaaagactggagggggggagttagggcgggtttggcggtccattccgaaatcttgtctggttgttcctcagggacaacaaagactggatccgaatgttctatctgaagatagaaccatctcgcccgccatttactacgagaagaggggcactggaaggggatgtatcgcgacttcaggccattccgaagtcggaaaccgacacatctggatacctttttaggttccatccagcgtaactcatagtagaagcggaagagatcaataaatggctttaccccaatgtaggcctcacaaagataagagaaaatactgaggaaggcgatggaattggggtttagatggagcaaggaaagaccgtacaaattcaagacaagaagaagaagctcggagggcggaggaagaaaaccgcaaagaatataatcctcaaccaaaaccatgcggcccaggataggttcgggttcaatacctcctggttctctctccatggtcccgcgaccagggagggcaccgtcatcctgcagcttcttcagggacgcgttggtggaggtggacttgtcgagatccatcgccgccggagatcgccggtgaatagaccgagatgagcaagctagggtttttctgcgggagtggagaagacgagggacgcttgggggctggaaagttttgcagcaaacggacttcaaaatggatccccaaaactcccttaaataagcgcactaccgatggtgtgaatttcaaggaaaggagagagatggccgccggaaatttctgggtccgttacgcgcagtagttttcggacttcaatttaaattcactcatgaccgttgaacttcatacaatgttatcgataactctttgtctctacggttctcataccgagatcgaccagttgagagcgataacgattccgacatcagaagtcatgatcggccacatgagttcatttaagcagaagtcgggggctactgttagggttacggataaggtatactctttacccttggatgtatgccgtatactgatatggtatacctgcgcgtgtacggatgtttcctgtacacgttaaggaaattcatgacgtaatagaaacggagttcacggatggaaggagtcctactcggacagaactgggtcgttactgtatcgtgtggggtccgatgtctctgagttctacttggagaccaactgacccgcggtataaaagggactccccgggaggacctaaggcatcgaatctcaccgccaacacaaccaccacagcctacgaagtcggagcctacagcaggcaagtcgccgggtgatctagtcgaaccaactcgactacggtctcgtcggtatcatctagttctgctattccctttgtaatatgtggtttccattatataatcccatatcaactggattagggctattacctatcaaggggcctgaactagtataatctctgtttcctgtttgcttgatgtcatactacgtagatccttataccagcgtaccccaataccctctatatccggtctacgggtataaaagggacccccggacctaaggcatcaaatctcaccaccaacacaaaccaccacagcctacgaagtcgaagcctataggagccaagtcaccgggtgatctagtcaaaccaactcgactacggtctcgtcggtatcatcgagttctgttattcattttgtaatctgtggtttcaaaataagatatcatatgattatatttcgataacatatatttatatgtttcaaccgttaaaattcgatgtttcacttggtgagaagagaatgtgtcatttaaaattagacaatgttgcacatttaaagtttttttaatggatgtttttaatgttgcatatggtattatataaatgtttcaataagtattactttatttacaaatgttgcacataatccttttttatgtttcagcaggtttttttttcaacaattacaactctgtgctacatggatgagataaagaaaatattaaaagtaattaagtatttacaaatattttgtatattcatatgaattttttgtgtatcacccgttcgtatttaatgtttcgtataatggttgtcattgttataatcaatatattttatatgttgcatttctctagaacacatttcattagtgaggtgaaacaattttatataaattgtgaaacaacagttgatttttttacatatatttttaatcaaaatataactgtataagatatgttataaaaatttcaaatataacaaacttaatggtataattaaatcacaaactagatgtatattttaaaagaaaattttgattaacttttggtgaaagaaaaaaaggagaaaaaagtgctagtatatgtgagaaggaaagaggaaaagcaagaggtggtgtgacaggcacatgtgctagaatatacgtggtaggctgcatgtggcatacggaggcatacggaggtgcatgatagacggaggatgcatgctgcacgcaggaggcatgacaggcgcgtaggcatatttggtggaatatctgacgcggagtcgtctcctatttttttttcctatacaattcccaaccaatattttcttacaaatttaaggaaaaaacatatattttcagtttttcttccttccgagacagcattctctagatgattcagttgttaatatcctatttgtttaagatagatcgataaaccaatagatttatcaaataaattaaatgacacattattcaattattttcaaatactgtctacttccatgatctgtttaaacatactccattctttttacgtactggtgactatcacggagattaactttttctgattagtgaattcacctcggcaagtgagcaggatggaagaatactgtcgtcgtgactatgctagctggttatattgctgttaatgctgataaaaacacgaaacaaaatgcaaaagaagtacccgaacaagtaagcagctctctcctctttctatctcccaatctttagtgactcaaaattttcacatgtgaattcgcaaccgaggcttacattgcagccttggttacattcactctagattattgcatttatgaaaactataaccactcagcttattgcatttacggaaacacattcactcacattcggttccttttcttattaagattcagattttacctcaatttccgtcgggacactttttaaactactaaatggtgtgaaaaatttctatacagaagttactttaaaatatcaaatatatctatttgttaagtttataataatttataattaattaataatgtgcaaatgattttttcgttttacgtgcgctaagttaaactagaaaaaccgcgtggcttcgccacgcatggtaaagtgaacccagctgattcgactttagtggagtaactaattagggccccccttacttgaaagaaaaatataggaacttttattgtgtatagaaacaataaattttgctataggaaaattttctatatgattctttgaaccaaaggattattgaaaactattgagtcttatcaaatttctaaggaatgcccaaattcatacaagttttggagtatttttaacatgaggtccaatatcacgcgaagtctcttatgagtttatctctctcatctaattcttgcatttttcgtaccgtccaatcaaatgattattttatatatttttttatgtgttttataattctttgttttgcgcttgattttttgtcagaattctatgtttttcctattcatccctcaatctttatttcaaagtagcccttacaagacatatataggttgcatttgaccggaggagaaaaagaaaagggacaattttgctagtacaattgtacccctactttgatgcccaatactgattttaccctacattttagggttgttgttttttgccctatttttttcaaacgaatgaggagtttacccctcgttttttgatggaattgagtgggattggacttaatgcggcaaagaattagagaaaaaaaagagataacgattttttaaattatcgattgacccttttacccctagaaaatatccaagtaccgcttggtgtccctccaggcttgagcacttggcatcgactcttcccttcctgaacccaaatccccgttctgaagcagtggcggcagtgttcgtgggctggccggccaggcaacgggcacgacccgagcaagtgcaggccacccaacccagttgcagcgtgcaggaggaggctaggcattgcgcaagaggccatggtagagaggaggacaatggcggctgctgtagctcagcgtagggaggaggtgcagctgctcgacgtgtcgaggaggcgatggggaggaggacaacaggtcaacggcggtggtggtggctcgatgagaggaggcgacaacggcagcttagcgcggggaggtgatggtggcggctcgacgtggggaggaggcggcggcggctcagtgagaagaggaggcaacaacggtggcggcagtttgtgagaggaggcgacgacgacagcttggcacatgtaggcaacagatttgcttgacttgtctgtttgtttttttcaagatatgaaattttgaagcaaatttttgttgatgtttatgttaaaattatcatattggtaaaagtttatcgaatttgcaaggttcatgtgctaaatgtgggcaaattctcaatcataaacaaaaacaggggaagtttgcaacatgagtaagggtatttaatgccttctcgctaaagatttaacattgttaatctgcccatcaaaagtaggagcaaaatttatctttatttcaagaaaccatgggcaaaaacaaaaccctaaaatactggggttaattggatccatgccactgcaactttgacaaattaaaaaaatgccactactattcatcatattggctacatgccattgtaaatttctaaaattgaaaccatgccactctcatccctttttccgtctcctctctcatgccatttcccttcccgtcctcgtcctctctcacggcgattgagcagggcacatccaccaatcactctcatcgccatgctgcttcattgcttggccggtgttgagccagccttgccggaacatgagaccgagcaccatgaggcttcttatgtatggatgtatggcggcactgtacaggacgttggcggcaaggaaagagtcggcgtcgaatccatcctcatcttcgaagtcaagctccccgaggtagtcgtcgtcggtggcgtcagcgtcaggcgtttcgggagatggtgccgcgtcacggaactccctgaacatgctgcgccggcgacgataagctcttgatgtggatggggcaccgcggcatcatcatcgtcgtcggcggcggtgtgccgtggaggaggtacgcggcgctgccgttcttgaggacggggaacggcagaggagatcggaacaggaggaatcgttggcgagcttcttggcgaggccgaggagccgcgggcgacgacgacaagagcatgggggaggagcagcggcagcagccctcgtcggcgatgccggcggcaccgaatctggaggaggagacggggatcttgaggttctcaccagagatggccgcggtgggcgacgacgacaagagcttggggaggagcggcggcaacggccctcatcggcggtgcccgcggcgtcggatctagaggagacggggatccccgcaacgctgctcgccggctggttgctctgcggagcgggagtagcagcggcggcacggtgcgcgcgacgagaggacagggaggagcagcggcggtggacctcgtcggcggtcctggcggcgccggatctggagctctcctccggctggttgctctctggagcaggagtagcagcagcggcatggtacgtgcggggagaggacagggaggagcagcggcggcggccctcgccggcggggagaaggcgaggccgacgtggtgcggtggcgttggggacaaagaagatgtggtgtggtgtcgacaacgggaagggaaacagcgtgagggaggaggacgtaaaaagcgacgggagtggcatggttccaattttagaattttttagtggcatgaaaccgatatgatgaatagtagtggtatttttttaatttgttaaagttgcagtggcatggatcgaattaacccaaaatactgggcaacatcaatgttaaacatcaaagtaggagtaagaatgaaattgcccccaaagagaaaaggttctatgatttccgtagaggaaaacacagaaaagaaataatataaatcacatgagtacagatacaaaataaggaaacgcaggaactgccaaaggatggatgtttgcaacgtaggaattttagtggatgatttgattacatcctgttaatcctcttttagtctctaaccaaagtatgtatcattacttctttagttctttagtcctcaatatccggtggtaggaggaagcaatagctgcctgagctttgccagccgtacggcggcaacgcgaaaaatcacatagcctgctgtgcccccatggacctaattgctcgatcaatagaaacttctggacgaccttctggacaaccgctgcacgcacgcacacgagcgtttcacactgtacgcacgcaagcaggatcgagccgtcccgcgaaaccggtgttgccacgtggcacaattcttctttcaattttttgcatgaaattcgtattataagatttcatctctaccagttttaaacaccctgaattgttggtccgcttaggattgtaggaaggagaagaagcaggtattacttccttctcttgcatcgctatatatataaacggtgggttgcaatgggaagtcaatcagtacttattgcaatgttgatccttgttggaggcatgccatgaagcccttcggccggacctgccgaaaccatagtaccagcaaggattcaagctaaagatgtcaagacctttcaagcgaagccctatagcgaaagctataagcgaagatggcgaaggctggaaagccgcgtcggtactccgaaagtaaaggcatcttgggcgaaggcatctcgagcgaactacaaagacttcgccatgacgagttcggcatcaaggaggcccaacaggctgcccccggtcttttaggcctgttcactatagaccaggcccagcctatcagtccattaaaggcccatatgtgtaaatgacactgcgtacccatgtaaatgtccctttcataagggcacccatgtaaaatcccctataaccctaagccctagaaggtgcaagcttgtgctaaggctataaatagacctctagggccatgtaatgggggatcccaaaaaattctacgaatcaatacaattacttttaaattccaactactgttaggagaaccacgcctttcgacgtggcatagttgtccatttgacaacaatcctatacgaacaaccatctatttttatactagtaagtacaaagggatacttaaaattatgcacgcttaaaatattataggagttaatcctatttctattattgacatttagtataactaacaacgatctcttcttctgtgcttcgtgcatatattcagcacccatctcttttgctgcgaacttcactcttctcccaatcactactacaaaacatcaaatagttctcgccactatagataccggtagtgctaaaactggtacctatagtccttttcccacctccgcaggttgaaatcgtaaaaaaccggcacctttaagcaattataggtgtcggttccaaataaaaaccgatacctattatatattgtgtatttttttaaaaaaaccgatacctataatatattataggtgtcagttaattaaaaactgacacctataagatattataggtgccggttttttaaaaagactgacatccaaatcgagctgagccggctagccccaccaagacgagataaggataaggcgctcgctagtggcttctcgatctctctctcgcccctctatctctcagtttctctctctctctctctcaccccgtccttcttctccccgcatatggcgtcgtcgttggctgcttctcccgcggcggatgcggcggtgggggtgggcgaggcggcctcggcggtggtggtggcagcgtcggcgtcggcggctcccacgactgatccggcctcggcggcggtcgggtggcgacggcgggcggagccgcatcaggggtcggcgtctgcggcgggtcttgcgatggatcctgcgacgcagtggcaacagtgattgtttctatgaaattgttgagggatctgtgatttgtgattctttcatctgtcatttgtgtgaaacttctgtgatttgcttcgagggatatgtgttggatgaatcgatggtgatagtgtgaaacttctgtgattttgttttggatcgaaggtggtctcatgtgagaaacatctgtgattttgttttggatcaatggtctcggggtgacggggaacggctcgatgcatcggctcgattcgagccaattcatcgagccctatttttttggattcttgggacctcaaaggtgtcggttcctaaaccggcacctttgaatacttacatcagtgctgcctcctttgtgctggctgggaaaaccgacatctatgtggggttcccaaccagcactgatgtggtgttatgtggtagtgaatgtaatatttctccattcacatcattgactgctaaggcatgaaaataaaaaaaacagttgcattgtggaaccagctatagttcttttacatgttttcgtagttatctatatacatcatatagtcaattatttactttcaagaacttataattaacattttcttaatgctagttgtaacacaacatccaagaccatacatctgaattttgtagccttatcttatatgtttcgattaggaagcattggggaagtatatttatccaagaccctacataatccaaggaaattatatgcttggattaggaagcatcgggaaactatatgtatgaagaatcaccattactagccacttagtcgtgcgttgcacgactttgggtgcccgtaatgtacaatcatacttaattttgattttttttcttttacagaatcatacaacttgataaactattagttagaactatagattcagctcaagctatatttgaactgaaggttcaaataatatgtccaggatcaacctcttaccgtataccatcaaaagatgagaatgtttactcagcaatatgatgcataaggcataaaatagtcaaacctaacgcaatacacattagcaaactaaacggcaatctagtccatgatttgaaaccaacacaaattgctcaaagatcatttgacctctaagtatctcaagaaaataacataataaacatcacaaaataaaaatgcacaattttgttatgaagtgtagtaaaaaatccagagtcatcacaattaatgtagtttgtctgtttgttcattgttgccaaccaaaaacccttcagcccaaagctaaggaggacttctcaactcttccctgtaggcctgagaaagtagatatgattgacatttactaattacatacgctaaatgcaaagtcagaaattacactattcaggtgattggtgtacaactaaaaaggtgccatcgatgtttgttgttaattaacaggttaaggttaaggtgccatcaggcctaatgaacacaccagagaaccaataacatagtgaccatgagctgtttgcttggtttttagcttcaaaactcagaaggcaaaaatattaaagtgaacaggtaataatagatattctatgtgcttagcatttaattgtgtcctaaactcctaatacatcgatgcccttgattcgcatatttgcacaacagactgacgcagggcaagaaaccaagtgtcttttactgtcatcgaaggcacattaatgtcaaaccaaacctttagatcattgctgatgatgctaaaaaaaccatcgtccaagaaaaaagaatcatttgagttggctatccgcctttaagattaaattcccttgctgaacaaaacacaacaacaatccttttttttaacagaaacataattgtacatgtgttttttaatatatttttatagcattgctctttgtcagtccatcctattactgatatttttttgaccttatatgtagttcccggctacagtgtgagaaagcaaagataggaggtgatgggattatctgagtttgtgacttaccaaaatatttagttgtgatccgatgctgttttggagctgcgattgggattgggatcatgggatggggatggggatggggatgagaaagtgagtggagggtgcgtggaggcgaggaggtggcggcaatgggtgaggggaggaggcggtggactgtgcgaggaagaaatgccggttgcagagagggggaggggaaacgacgccgggggcggaaaggagaaggcgacatcgtgggagtcggggtggatggaaaggcagatgaggaacttcgccggatggtaggggaggatctgaggcggtggggttgcgcaagcgacgtgggtatggaggggcgagtgggcgcggtggaggaggaggcagaggaggcaacggcaatggggaggcggcggcgatgggtttcgggaggagatgggttctgcgctcttttttttttctttttcgtatcctcttacctgctccgtgattctctttatctttatatacgtacacgacgcttcagctccatggcccatgggctgtttgccacaatctggaggattctaccattgaccagattttatttttcaactcaactttactttgcatctgatagcagctattgatttccttgtgtatccaacggtctgtgtttaattgatgacgtggcacaatcaagattggagaaactttagtaatttcactactttagataggtgcaaaatacacttgaaattaggatataacttccaagagaagtgttaggaggcatgcagcttgttatctcacgcagccagcctgatgccacatggattgctttggttgcaccgcataccatgatcatccgcagcaccaagattctcgtgaaaaataacgatattgaaattacataatgagctatttgtttttcgagggaagagctctgccatttcattaactagtgtatgataaacatcgaggcagattagacacacacggatcagttctttaggaaagtttcctgacttatttggttgttctttctttctttcttttttttttttggggggggttgcgggattggactctgtttcattacagaaaagagaagaatggtgtggtgagatcatgacaagggaaacaaagatggattgttggcatatcctccctccgtattttaatgtatgacgcc

SEQ ID NO: 22912 - DNA, 21066 bp, Oryza sativa
aatttatgtaattatcatttattttattgtgacttgatttatcatcaaatgttctttaagcatgacgtaactatttttgtatttgcataaaaaatttgaataagacgaatggtcaaacgttagttaaaaagtcaacggcgtcatacattgaaatacggagggaggactatgttagctttcttctcgagctttatgatccatcataacttgtaaatcaaataagataattaaatgacttatttgaattaatcaaactaataagacttcacggaatgaataactcaagctaacaacagcgaatatctaaatattgatgtcctctgaatcccatgatggccaacctgtattgaaaataagtcttagcacatttttttgtaaactataaaactgaatttccgttagcacttacttatgttctgcatcaatatgccactacaacagaaaagcaaaaaggggacgtgcctataggtgccggaagttttaaaactgacaactatataaattttgacaaattttgctacacaacactgcttatatgtggttttagccctaggacactacccaaactcacttttgagggaaaacacaccataaacgtggtaatttgccagtggacaccgcgctgattaaaataataatttccagttgaagaggagagagaaatcatgtgaaatgtcaaaaatgcccttgggcccacatgtcagctctatctcctatctctcttctcatctctctctctatattctctctcagaggagcatgtggcggcgtcggtcgccagggcttgagctcgtcgcagcggaggagatggtgaggacggcggctggtagagtggagcaaggcgtcagctgcggtggagcggagcttgcggccgaccgaagcaggtgggcaagcacgcggtggccggtggattagagcggggcggtgtcggcggtggaagaacgtgcgatggccggcggagtggagcggggcggcgtcggcggtggacgagcgcgcggccggcggagcggcagcgtcgggcgattgcacggcggcaggtggagtggagcgccggcagtggcgggcgatcgctcggcggctggcggagtggcggcgggagaaggtggggaggataaggctgcgccagcgggagagggggaagaggcgaccgccgctctcgccagctgtcacgaccggaaataacccaacgggcattccttacgtgcgtgcattattccttatcccaggaggcaaggtacaccaaaagttgatacaattcagagtttaacaagcggaagcgtaattaattaatctattacatgggcggcgaaggcccagcacacaagaagacaaacgaaaaacagcggaagactagggcgacgaccacaggcgcttgacggcaggcacgagctagacaccaaagccttcatcttccaggaactcctcttctgagtttgggaaaaattgagcaagactgagtacaaccaccgtactcaacaagacacatccacaagtgcagaataaatgcaagggagtacaagggggttatagtataaagggttagggtttgcagcaaacagcgttaaaagacacttagttgctcaaagctattttgtaaacacggtcctagagctatacaatattattaatcaaggccgtgaacccacacgaacctgccttaacccaaggcctacgatgattcagaccgaattggcaacccgaccctgggtcctagctcgtcccaagccaacccaggccaaccattccacattttagttgttaagcaggttttaagaattaaaaacactaacttaggtacattgctcggcttgcccataaccgagggcgcggctattcgaataggttatactctgatcagaggtgtacatctttacccacaagacacatcttcctcacgtgtatccacgtgccacataccaccacggtatacggacggaagacgtgacatagtttccaacccatcctagccatagacaagagtaccgacccaaccccacctacggccggaacccccgggacaggtaggcaggactgagccccgagcagcaggacaccggccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgaagaccgatccttatatggccgaggtgctactatcaaaaccatgcaccccgagcccagactaaaactattttgagggttttgaatagagggggaggtgtgaatccaattccacaataatccatccattccatagtgtccaggtgatgagaatattcccaaagtctagagttgtaaaaccacctaatgttgcctaattaaccaacgaagcatctacctaaaatcatactagtggtaccatgagtagagtgtccactagttggggttttgtttattctagggtgaacaaggaaataataacaataacaataacaaggtcataacaaagataaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaatggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatgtgctctttaaatgaatatttgcgaatttcttcatttaaaatttaatttaaaaagggtttattgcgtcagccgaggggagggggcgcgcggaccgggtccacgggagtggggcccacgcggcagcctcacggtccacggtggaccgggtgcacccgggctcacaccggtcggcgccgtgggtcccacgcgtcagccgcacccgagggcgcgggcggctgacggccgggccccacgcggtggccactcggcgcgcccgagggcggccactcggcgcggccggcgggaggcggcgcccgcgcccctatggtcgccggcggcggccataggcacggcggagcggcggccgagagaggggaagggaagggggaaaagaggcgacggtccacggctcaccctaggtcgacggcggcgcagaggaggcggccggagcggagggaggcggcggcgcggctcgggtcgacggggtcgacggcgttccggcggtcggcgaccgaaacggagaggtggacgaggtcggcgaggatgcggcgaacccaaaggaggcggcgccgaggtgggagttggtccggggcgacgacggcggcggaccggagctcggcggcgacggcggagagagagagcgatgtcgcgagctcgaatccggtgaggaggaagggcggcgagaggcggaaacggacggaggaggtgtggggagggtttaaatagggttggaagagggagagagcggccggcggggaaggaaaccggcgcgggaggtccggccgccatcaatggcgccggcgagatttgcgggggcaaatccgcccgtttgaacgagagagagagagggaaaaatagggggaaagggagaggggatcacggggagtaattccccccactttattgcacgtggggacgacgggaggcggcgggattcgtggcggcggcggcgctagggcacgggggaggcggcgggagcggcgggaggaaggggatgacgggtgggccccaccagtcagcgagggtggcgggcgggcccgcccgtcagcggcgcgcgcggggagaggccggattggccgcggggagaggagagagagagagggggggagagatgggccgggccggcccaagggagggaagggggactttttagggtttttctttttataaaatctttttaactttgtttatttcttaacaattattatttgtgctctgaaaattccactaaaatttatttacgtattttaggcttttaggaaatatacaaaaatcctctaagccttatttgacttttaaccttgcacattttaattgttggaggctttcacacggtttttaattattctaggcataatttagaggatgtattttagagttgtgttgggacacgacaccagccgcggctcacgcttgccgctagccgccgccgccgctctatgcatgcttcgtcgccgtggtagctgaagaagagaagaagagaaaagagaaggagaaggagaagagaaataggagatagagctgacatgtgggcccaagggcatttttgacatttcacgcgatttctctatcctcttcaaccggaaattattattttaatcggcgcggtgtccattgacaaattaccatatttacggagtgttttcccccaaaagtgagtctgggcaatgtcctatgggtaaaaccatacataaaaagtgttctgtagcaaaatttcccataacttttcccacccccgtaggctgaaaacataaacaaccggcacctaaaataaacaaccggcacctttaagtgactataggtgttggttctagagataaattgaaaccaatattataggtgcacattgtttttttaaaaaaaaccaacacgtttaatttatcataagttcagttaattaaaaaccaacacctataatatattgtaggtgtcggttttctaaaaacagcaccagtaaaagacaaaccaagccgactgttcatctttatcctcacgaacagataaggtgagaagtgaacgacactctccatcgcgcctctctcttcccacctgcgagcggtgacgccctcccaccgctaaatctggttggagggtaggcatggggctccctacatagtggcggtggtggcaccttccccttcaccagatccagcaagagggatggcggcgggctccccacccagtggtggcaacggaggcaacaacctctcctcccgtgagtagtagcggtggcgccgtccccgacgccagatccaacggaaggggagacggtgggttccccacccagaggtggtggtagcagcgtgctccctgacattggcaacggtgagcggcaggcttactattgttgtgttcttagtgttcttgtgttcttagtgtggcttcatcaactctttctatgtgttgttgtgtgttgattttgttcttttatgttagatcgaacttgattgaatcgagccgattaaaatgtttattctatgattgaactcgattgatcaagttgttaaaatgttcattctattattctttggaatctggtcggtgtgaactggagctgctcgaatgagccgatgcatcaagccgactttgtttttttcattcttgcaacactacaacaagaacccccctctagcaatacatgcttggcaacgcattaagcatgcgttgccaaaatgcgaccctagcaacgcttagtagtgggtgagcccaatttgcaatagataatatgtgttgcagaacatgcgttgcagagattgagtatcttgcaacggccgaatccactttacaacagatatcatgcgttgcaatggtcttgatgccctataaaaacttttagaataagcgaacttattgtattttttaaaataatcgagcgagatatttatttttacatttcggacctctagcgaactgttttttaaaagaaattatgaagtgagttgcttttttttttcctgttaaaacttttggactaagcatgctttttaaaaaataataataattgagcgagctgtttttttacattgtgtactgggcgtgctgtttttgttttctaaaaaatttatcaagcgagtttttttaaaaaaaaatgccacaagcgaagtggctgctgataggggaaaaaaataggctgctgatacctgataggaataaattaggggggcaaagatgcaaacagatgattcgaacctaggtctctaggatagaatatgcacaaccgaaccaactgagctaatcacatttcttattaaatgatttctttagttgtttatattataacaactaaaatacgatctgtgcactttagcaggcaaccttaatctcccaccttctctcctctcctctcgtgtctctcacctcacccaacacgcacgagagcgccgccccatcctgttcccacactgcatctcattttcttctcacgctctcgcacatcactgccacggcgcacaccgacggcggcggcggcagcgcgcatcggcggccagcggcgcgttctcagcagcggcggcggcgagcccgcgaggggatcggccgcggcaggccggcgacgggccgaggccgacgacagcgggtcaacggcaagcacggtccttttcttagccacttctcataggttgattccccatttggccccaaatccaggtcagtgtcagatccaggtcaatgtcagcttttttttttattattcaggtttgttgcatcatgagtctatctgattgagtttaataacacctgcagatttttcttgttcatccgaacggatatttggaacataggttttaaacacatgtgcttctggagtcatcatctgtagattaactagaggtaatttatagtaaggaatttaacttggagatgacagctttgacattagattgctggatgttttttctgtaaattgatttagctcttctctatttttgcagagtaaaagcttttgtttcagtgtataaaggaggtctattaggttgtgacaaaattagctgacactgattttatactggtacttttctaattgccctatttttgctacatcatgatcataagagacaattccttgtcattgttattatctacaagaacctgaaatatcaattttttttatataggtcgaaatggatttagaaaccatcaagattcttttgcgctaccctagaggttctgttgagtacttagctggagtagatggatttcttgaatttgtatataaagataagttagaggatacaaagatttattgatttaagttagaggatacaaagatttattgatttattgtccatgtgaaacatgcgtacatactatgctactttcaaaaaatgatgtctatgatcatttggtgtgcaatggaatgcttcagagttatgaccaatgggattttcatggtgagtcttcagaggagcaaattaggaaccaacaaccacagcctcacaatgaagacatgcgtgctaacatgcacgaattaattaatgatgcacttaggactgtgtatgacgacatgcctatgagtgattctgcagattcgccatgtacacacactgatggaccaaatttagaagctcaagcattttataagttggtgaaagattcagagaagcctttatgggatggaagtgaactatcacacttatctctgctagtgcttttgttcaatatgaaatccatgaacaaatggagtgataaatcatttggagatctacttgatattcttcacatggcaattccaaatggaaaagaattgccaaaaaacttttatgaggctaagaaggtggtttcaaaatttggtctagattatcaacaaattcatgcatgtcccaataactgtcagctgttttggaaagagaaggttaatgatgatttttgttcaacttgtaaggcttctagatggaaagataaaaaaccagaaaccaagttaacgaagaaagaaagaaagaaagcaacgccaagcaaagtcttacgatattttccaataaaggagaggctgaaaagattgttcatgtgtagagaaacagcatcgctcccacgttggcatgatgaagagcgcttagtagaggatggtgtgcttcgacatccagctgattctccggcatggaagaactttgataaaaggttcaagcaatttgcatctgattctcgtaatatacgatttgggttagctacagatgggtttaacccatatggtatgttgagctctacctatagttgctggccagttgttttagtaatatataatcttccaccatggctctgcatgaaggaacctaatcttctaatgccattaataattcctgggcccaaaagtcctggagataacattcatgttttcctccagccgcttctagaagatttaagagacatatttgtcaatggcatttccacatatgatgcatctagaaatgaaacttttaatttgagggcagctgtactgtggactataaatgacttgccagctttaggaatgcttgcttcacatatggtgcatggagaatttgcatgcccgccttgtggtccaaatgtatggtccaaacgtttggcacatgggaagaaatcttgttttatgggtcatcgtcgatttttgccacctaatcatgaatttcgttttgatagaaattcttttgatggaaccacagagattagtacagagcctatgacttactatgggcgtccggtattggatgaaataaatgctatcggtgattttaagaagtcaaaaacttataaggcagtaagtagtttattcacactaccttattgggatggcaatcttcttcggcataatcttgatgtgatgcacatagaaaaaaatgtgtgcgataatatttatggtacacttctaaatttagaaggaaagtcaaaggataatctccaagctcgtcttgatctcaaggaaatgaacattagaggggagctccatccacaacaaagaacttcaagcaagttctacttaccacctgccagctttactatgtccaaaagtgagaagcaattgttctgtaaagttcttagggatataaaagttcctgatggctattcttcaaacatatctagatgtgtgaactctgctgaaggaaaaattcatgggctcaaaacacatgattgccatgttctaatgcaacaattgatgccaattgctttgaggggtattcttcccgatgaaatcacatctgtcttgtttgacttatctgcttactttcgaggaatatgttcaaaagttctccatgttgatgagcttgaccgtttggaagaagcaattaaaatcacattgtgcagaatggaaatgatatttcctcctggattcttcactgttatggttcacttagtcgtccatttagctactgaatgtaagattgctgggccagtttgctatcgatggatgtactttattgaaaggtactaaaaatatattagcatacaatttataatatttctcatatgtcatatgatacaatactaacttattagttttgtgccttgtatgtatattacaggtacctgggtaaattgaagtcgtatgttcgcaacaaagcgcgtccagaaggttcaattgcagaatcatatttggcagatgagtgcatggcattttgttcacgatacttggaaggtttccctaccaagcataacataccatcaaggaataatgacaaaccagatcaatttgagactcccatgagtaggcaagaatccactttgtttcctccagtaggaaaaccattgggaaaaccatcggcgtactccttaactgatagagagaaattgcaagcacatagatatgtgctatacaactgtgatgctgtagtgccatatctgaagtacgtattgtcctaacatagtgtggatattatgggtaccccatacccatacggcatggttatccgactagttataggggataacttatatttatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctaccccccatcctatataaggtgggcaggaggccctctagggggcagatgagacaacctgatcgtcagatcaatacacacccggcggattcaaatccccaaacaggagtagggtattacctctcattgagagggcctgaacctgtctaaatcctttgtctctacatccatccacttttaggtctcgtgcgctacccccttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcaccgggtttttttccttttcaacttattgttgtttattagattgatctctaaatgtcagattaatctctcttggtattttctgctttttgcatgtaacgccgcggcactactcttgccgacttgtgtttccgtctgcacggctggcctgttatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgtctacacggctggcctattatgccgccgctgttgggcgtctacgacttcaccaccggcctgcctccgtcgccgccgagtggtgcctccgcctgcacggctgacctattatgccgccattagtgggcattttcgctttcaccgtcgaccgccttcgtcgccgccgactggtgtcttcattgttattgatggacgactttgttcccacattggccacttctgccatctccaaggggaatattacaaagctaagtcatcatttattttattttttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgctaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatatcactcatatgcatgtttgggaaatgcctaggccgactcccgatgcttgtgggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcggccgccgccgactggtgtttccgcctgcacggctggcctattatgccgccgttgttaggcgcctacgtcttcaccgaccggcttgccttcgccgccgccgactggtgtttccgcctgcacggctggcctattatgctgccgttgttgggcgtctacgtcttcaccgaccggcttgccttcgtcgccgccgactggtgtcctcgcctgcacggctggcctttatgccgccgttgttgggcgtctacgtctttaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctggcctattatgctgccgttgttgggcgtctatgtcttcaccgaccggccgcctcgtccgccgccgactggtgcttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcctgcacagctggcctgttataacgccaactgatgctatcttcttcacggctggctacatcgctgtcactactaataggcatcaatatcttcaacacaagctgcctacgtttgccatggctgccgactggtttcttcacttccatggctgcatgattctgccagtgttgattggccttaccatcttcatcgctggtcatctcgtctgctgctgactagtgtcctcgcctctacatctggtttatacagctaccactactgatggacatcatcatcttccgtcgccgactgattatgccgccgccgactggtgcttttatcttcacaactgcgcgtcttcactaccggatttctacttggacatcttcaacacatatcttcaatcaagcaatgactactcgacgacaagaagctataattctcgactctatgttcagttgtttcccaactaatcaaagagtcgggggctacacaaatacaaggctcaaaatttgacaaattttatgtcaagctgaagaaattaattcatcaaccaacgagtcaactccaggagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgttcaggggcttattagctcaaatacaagtattatatcttcaatttggacttgctccggatacatgcaacatgaattcatgatcatgggtctattttatatgctcaaagactggattatttattattccccgtaagggttatcaactgaatacttgcgccagtcgggattcaattgttacatctattttggagtatcccataagggataaccactcagatcagaagctattcatatgagctacgcttggtctatattactcggaagatttattactcgggagcatgtcacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatataactgtcccgctgacttttttatatataagtcaaggtgctgtttgggtttttaagcaattgattaggtacaatatcattgcttttcgccacgtaagtgtgcatttttattgaccaatattatggcttaggctgattatatattgtggtcattttctaggcggttggtaaatcctttatgagtttatttactcagattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagcctccacagtcttcagatttggtaaaagtactcgggagaccatgacaaagatgattgaagcactcggctttggagtaatctggttcgagagaaaattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcacatcaatacatactcggcggattcaaatccccaaacaggagtagggtattacctctcattgagagggcctgaacctgtctaaatcctttgtctccgcatccatccacttttaggtctcgtgcgctaccccttttattattgccgaattcatgtttcgacacatagcctttttttttatgtgttgtaagtgttttgcttcaaatttatgtttatttgttttgcagagaacatgctgctgatttacaaaggaagaaacgcaaaaggctaactccaaaaaacattgagaacatgcaaaatgaacaattccctgattggttcagagatcatgtaagtctcaaaatttaggtttctctttttcaaatatgagtacaactaatacatcttttggtttggtgtagatcttgcagttggagaatcaaagaggtatcgatagtattgacgaggatattagatggttggcacgtggaccaattgaggtagcaaaacgacatagagcattcaatacccgtgggtataggttcagatcaaagcgttatgacagggtgactcaaaacagtggagttgttgtgactgcaaaaacatcgagctacacgtccgccagtgatactaaccctgtccttggtgatatcatgtattacggaaggatacttgatataattgagttagactactatggaaatttctcagttgtgttgtttaaatgtgaatgggtcgatgtaactaaaggaaaaggagtgaaaatagataagtttggctgcacacttgtgaatttctcaaataaaattcataccggtgaaaagattgagcatgagccctttgtatttgcaaatcaagtcgaccaagtgttttacattgaagaccatttaaatccagggtggtctattgtaaggaagatgaaacccagagatgtatttgaactgggcgaagaatggaatgatgtggaatgcgaaccataccatgtcagtaatcttggggagctatttgacagtgcacatgatggtcagacatggattcgaagagatatagaaggaacaactgtcgataacatggtaactaattaaaggtgaggttatgaaggtttttcactatctatctatccattatcaatgatttccttatattgtttatatcttcacttggggagcactttatttttatggcagtaattttggatggagatttactgcgatgaaggcttcttcaccacaatagcttttctggatgaaaatgtcattcgtatatttccttggattgtctaagtgattgagccagatcgattcaactttttatttgcatacataagtcctgtaataatgttctacattagttatatacagaattggtggttagatcttatttttaaatatccaggatatcatattgtttatatgatgagaaaaaggaatgggcgtttataatctttgcatctattgtgttatgttattccatttccaactatataaatacctggagaaaattatttatgttgtcaatggcacctaatgtgaataagtaagtcgaacggacaactccaacatgaagtggacatggcctggtggtacatggcttcttcagccgtattgaagactgtagttcaaatcctaacaaatgcattttttccatttcttttttttccctatccttcttagctggccagataacgagaattttttgaactttttatttttaattttaaaattaaaccgatcgaaaacttattttttcaatataaatatttttggccacagcaactattattttaggacaaaatatgttatggatttgatcatgcgatcagtatggaccgagacgacaacgaaaaaacatgtggtttttttggtcgtgctaacataaattaaataacaattatttaaagaaaaaatattttacatcctaattttatacggcttgtccagaccgtgtcgacaagaaaaaacaagtggtttatcagtcttgcaaacataatttaaataactattattttatgaccaaaaatattttacatctcaatttcatacggtctgtccagactggtcgacaacgaaatagcacgtgccttttcggtcgtgctaacagaatttaaatttccatcttatataaatacctggagaagtctatttacattctcaattgcagctaacgtgaaaaaataaataagggggacatagcctagtggtacttagcttcttctactgtattgacaactccagttcgagaactagcaaatgcataattttttcatttcttctctagtggcaattcctaaaaactttttcctctccttgaacgggaaaaaaaattctgttgccccagaaattttttaattttttgaacttttttatttttaaattttaaaaataaaccattcaaaaacttattttcagaatatccggatttcatccggtctgtccggaccgggtcgacaacgaaaaaacacgtgtttttgttgtgctatgataaattaactaactactattttaagacaaaaaaatattttacgtacagatttcatacggtctgtccggatcgtgtcgacaattaaaaaacacgtggttttttgttgtcctaaaaaattaaatcactgttatttaattatatatatttttcatgtggtctgtccggaacgggtcggcaatgaaataacacgtgattttttggtcgtgctaacattttttaaataactatattttaagaccaaaaatatattgcatctcttttccatgcggtctgtccggaccgggtcgacaatgaaataacacatgatttttttgtcgtgctaacatttttaattaactatattttaagacctaaaatatattatgccactttttcatgcagtctatccggaccaggtcgacaatggaaaaacacgtgtcttttcggttgttctaatataaactaaataactactattttaagacaaaaatatgttatgtccgaatttcatcccgtttgttcggaccgggtcaacaatgaaaaaacacgtgttttttttgtcgttctatgataaattaactaactactattttaacacaaattttacgtccagtcttttcggtcgtgcttagataaattaaataagtactattttaagaccaaaatatgttacgtccaaatttcatccagtctgtccagaccgggccgacaacgaaaaaacacttgttttttggttgtgctaaaaaaaattaaattactgttatttaattatatataatttttcatgcggtctgtccggtcaagatcgacaatgaaataacacgtgatttttttatcgtgctaatataatttaaataactagtttgacggacaaatcaaccccaaatcgatctgaatttagcaatttgtgcctctccgaaaattattttcttctccctccactctttccctcctttttttttgctcccgcaatttttttctcagttttcttttttttgccgccaacttttttttttgcccccaccttccccatcgagaaaaacaagccaactgcccctaaaaatctctttcctctatcctgactctctgagtaaatctctttcctgttgtgggattcctttctcctatgaactctcccgtcgttctacggttctcctcctcgtcttcatcggtgttgatctgtaggtaagatgccgggcgctttactgacccacagccccaagcaggcgctcctagatcttccaccgctccgctccgccggctgctgtaccagccatcgctgctgtcgcaccttcctgccgattaacagccacgagcaggcgacccccatgccccatggatgacgtagggcatgcggcgggccagagacgcccccagccgatgtgccgggtgaccggggcactgcaattgatgcgggttatacctcccgacaccggctgtccacttcgctctgctccacgccgcgcggctggcggcaatgtttccaagccccggaatctctgcctccctctgcacatcttactacctctctgagtcgccaaattgcaatggaggctaattcccttccagtactacaatacttaccaatttgatgtgttgtattttcaggtttggagtcagatgcactgaccgtccatagctgaaggagcctggtgtacgtacggctaggcttcacacaactgtaagcaatacaatatgtgatctagttttaccttgcagccaattaaattttgttatttctacccattacttgtttcaaattgttggcctataaaatggacaaatgaattagtgagtatgacaaacagatccatattatagcattacttttgggacagcagtactctgttgttcttcaaaaacaaatccaaaatggctcagggtataatcaattctgaaattattctttctgaaactatgtacagcacagtcctacttctaaaatgagaatgatatactttcgacgccataaatgacagataggttttttttgggtgcaagagatatggcaaggagtagaagaaggcgtattgttcagagcaatgaggaatatttgtcagaggaacagattgaagaagaaaatacccttccacagcttgccacaccatctgaacaagaaactgtatgtcatgattctggagaaggcaatgaagacattgatgacgattttgatatcaatgatggagaaggtaatgaagacactaatgacgatgttgatattgatgatgaaggcaatgaagatactgatgttgatattaatgttcgaggtaactgctaagtttaacagtcctaatggtaagaaataatgacattattactcgtatccctgattactaaggatcacttttgtctttgcaatttaacaccgaacagttgaaaatggagcacctgaaacacgtggcaagacaaaactgaaagatgtttggaaccttccgaaagggcttagaattgtggttcaatgcaatgatctcaatcaggcggtaggggaagaagctggaattttgggtaaatttcttggaatgatagctaggaatggtagtctgtgtagcttaggctacacagactggagatatgtaataggaaagagagagaaaaatacaaatgaactaaaagttaaaaaggacatacttaagcaagtaaaggtaattccttttcagatcaacatttttgctaacttcttgtattatgttatgcatatccccatatggccatatgagtttctgtgttgctatatgtagatgagattcctttatgctcctcggatggaagagttcatattaaaaaaaattggagaaagatggcggcaatataaagcaaaactaaaagatttgtattttgatgtgaatgagactaaggaagctaattgcaacaatgtcccagaaggtgtgctttctgaccagtggattgctcttgtcaatcattggatgaacgagaaatcgaaggtacatgtaccatattcatttctgtaatggtcttacaaattagaactctgtactaaacaaaacaatgcaatattcttttttgattgctaactctacgagaccataacagagaataagtgagcagaataagaaaaactgccaaaagaagaaggcaattcacacagcagggacaaagagttttgctcgcacaa

SEQ ID NO: 22913 - DNA, 1654 bp, Oryza sativa
atgcattgaaccaatagtaggagatgacaagcctgggcgtgtgcatggtcttgaactagttccaaagcctaaacaagtgcttgatgtgccaacttcccgacgtttgcagaatataaatcttactacagtggaggataactccagtgaagatgtaatggctattagactgcagatggaaaagttagaacgccatgttgagaataatgatgctaaacttttacaattaaaagagaaggcaaccaagttggaaaaggcacaaaagaatcaggtgaatttaagggagttgagtcttaaaaaaattatatgagcttgtgtgtgacccaatgaatgcatctaacttacctaattgaagttacagggaggtttagatggagcgtctacaaacaaagaagctatttgtgatgacatacctaattcaaaaaggaggctatgtatctttatggaagaaatatcataacattttctgcattatctcataaactgtggtatagatctctgttcattttctgttatggacagagagtgtatggtgacaacccctcgcaagaaatttgtatgtttgaggagggaaacattatggatcagcaggacaacagtttgatggtaatgtgatatagcaccatcttataactgggaatagctgtgtttttttacttgggaatagcatttattttctctcttttactatagaatacacaaagccatgtgcacgatgagaatttgcaaccaccaactaagcattctactgtttacaaggtccttgcctttgcatttaaaatattattatatatatatatattcactattatttacatagcattcattataatcatatgccttcttttactctagaatacacagtctttgggccagaatcacagtgggaagcaaaggaagattacttcctgtgcaaacaaggttaattttcactttttcattaattggagtgcatgatgtcagagtaaacaaataattggaacattatagtttgtgccaattttatgacctattccattgcagcgcaaaggaaatttggaccagaatgagcttatgcaaccagggaagagtatttctagtgcatacaaggtaagttgattaagttctctctttatcctttcaaactcaatgccatagtcaataagtgtttgaaagtagcttaatttcgatatataaatatatatatagatttgtaaaatttatttgttaccttccactgtagaacaataaacctgacaaccaggacaactatatgttgaatgcacacaaagttacaagtacacacaaggttattttttcatcactttaagtcaccatgtctacagatataagctctttgaaactataacacacatgatttactagttataatgattgtattgcagaacaaagagaaccttacccgcaagcttgttagaccaagcctaaacaagtatagtactgcttctaaggttagtctaattgtttcaagttcaaaatgctatttctatttattgaacactacacaacaactaaaatagcacacacatcatgttggtttttactgtaaattctctctattttttcagaaacggcaatgcaacacaatggactttttaactgacaattcaacagtggtaaaccttgctaatattttagtctaaatagtttaataaaa

SEQ ID NO: 22914 - DNA, 334 bp, Oryza sativa
  unsure (1)..(334): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnntgatcagcgatcgctctttgcagttgccttcgtttcttccatctcgagcagtcaacatggataatcctgtcaaatttcttcctcagagatggcgctggattttctgctatcgctctgagcaccgcagacgcacccagtccatcccatccgtcaaagtagatggacttatgtgcagcactgctggtatcctccaagtaagggattagtgattctaccgccgcctcaacactagtcgcatcaatgcgctgca

SEQ ID NO: 22915 - DNA, 805 bp, Oryza sativa
cattctaccaccgaaagtgcgtcacacgatcaaacctctatgcgccttcttcaatgcaattggacagaagggtatagatccagaagatctagatgggttgccgaccgatattgtgaataccctctgtcacctggagatgtttttcccactatatttctttgatataatggttcatctccctgttcatctggtgaagcaaacaaaactatgtggcccggcttttctaagggaaatgtggccatttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcctgcgtctcgtcacgagggaaggttgtcaggtgttggcacaatcggaaggaaaagaattaggcccgatcaagcgtcgtacgtgcaggctcattacgctgtactccaacatatggcagaagttggcccatactttgaggagcacttagagaaaatccgagatgagaacttaggacgatctaatgcatggattaacagagaacataattcttggttcaacgaatggttcaagaatcgtgtgacaatgtccacggatgtcccaaatgagacagtacagttgttggggatgggaccgtcttggaccgtagacacatggcaaggatacgatataaatggatacacattttacaccgtcaaacaagatgacaaaagcacagtgcaaaacagtggtgtccgtatagatgcattccaggatcaagttggg

SEQ ID NO: 22916 - DNA, 6249 bp, Oryza sativa
ggatgaagaagtgaccaacataaaagttgtagatcttgatgagaggatcaactttattgttgttgcctttttcatttgaaatcatttactatttacaaatgctgttttaatttgtcatattttcaaaatcaatttcaagctgttgggaacaaagttatatatacaaatgaccaaaatgaaagttgtagatcttgataagctctacaattttgttgttgaccatattttgatttgaaatcatttactatccaaaaatgtattatgtctaataaattgaattattatatagtagctatatattttgcactcacaaatataaagacttgatgggaaaaatagaaaaatagtcatcggtgacgggccttagtttaagcccgatagagattagtctatctctatcgggcattatcttagggcccgtcacagatgagtcatccgtgacgggcctgaatgtcatctcaatcgggcattagtatggagcccgtcaccggtgagtcatctgtgacgggccctacggcaatgcccgtttgagatgactcatcactctactataactagggtttctcagatcggatcaaaaatttttctaagtcccgctacagtttcccacctccttagaaccctagcgccgctgtcgtcctccatcgccgagcccgccgccgtcgccaccagcccgcagtcgccgccaccgagcctcctccgccctccattcggaccgtgtcacgcccgaaaattcactagtaatttccgaacttatttgtgcataaaatcctcgtccaggaatcagccgaggtacacaaactgacaatttaatatacagattcatccaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctagatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcaaagagttaagagtagtaaaacagtagagtaattaatcagaaattttaatcaacactgaacagcacacccatgctgcacaggcccaaccatcctgaacaaccatacccggctgtacagatctaactccaaatcaggagctaagcaaattattaccaggtataacatccataattattgtgagaggtgtgagactaatcacgaaaaacattgctcaacccgcccataaccgcgggcacggctattcaaatagttttactctggccagaggtgtaccactgtacccacaagacacagccccacaacatgtcaccatgtgcctcaataccaccacggtacctcggaaaggagctatgacaataccccttgcacaacataatccaccacagcgcacctttcctggatcataatcacccccttataaacaaggcatggactccccagcgacccccgtgggcttatctccgccacttctcagtctggtgctccacaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgcgagctatcattaagccatcattaaataataatgaaacattaattatcccaatagtgtgctaatgtttctaagcatggctaagcaatcatatctaatatctagctgaaccaatatatatagcccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttggatacttccggcgcactcgtaaaccttcgcaacgacggaaacgacaagctaacacgcaaaacaaagaaaaagactaataaaaaccaaataaacagtacataaaaagtaaacaaacatgtagatcataattttagatgaattatgagacttgaacggcctcattctgacttcaaatgaatttattaagaattttactagattaaatctaattaaagcccatttaaaaaggattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattattttttaaaaggaaaagggaattattgcgtcagcggctagggtttgcggtggaccgggtgcacggcggcggctcacggaaatgaacgaccgagatcgatcctatccaaaacggacggccgagatcgaacggtccatgactgggccacgacggatggtcccgatgacgtcagcggtgacgtcaccaccggcggcggctcgggcttgcaaactcgccggcgaacgacggcgcggcgacgcgaacggagggcaccagcacgtagagagtgacgcggcgaactcaccgatgaccaaaacgacggcggaagatgaacggacggcggcggcgtcgaggaaaagacggcggcactcttcggcttgacgacggcgacagtgctccggcggtcttcagcgacggcgaaggggtggacgaggacggcgacgcgatggcgaccacgatggcaaccttcccgagcgatggcgacgactggagcgacggcgaagcacggctggagcgacggcgacgactgcggtacgaggtctcacggtgctagggcgcttccgacgacgagagacgaaggcgagggtggcggcgggtagcggcgacaccgggggtccttttaaaggggctagagagcggcgacggaggcccacagtgaccggcgacgagaaggaaaggttagggttcggaggaaaaagaccgatccgattcgacctcgaatccacgaacttccaaagcgaaaaagacgatgattccaaaagagaaaaggtagaggagatcccgaagattgtttcccctcaattgatttcaccggagaaggaaaggcgcggccgaatttggaaggagacgacggcggcgcggcgctagggttcgggcggcggcggcggcgcgaggaagacgaagactgacaggtgggacccacctgtcagcgagagagagagaaagcagagcggcggctcggcggactgggccgactgggccggggaggagagagggagaaggaaagagagacttgggctgactttcggcccaaaaccaaaagaaagattttaaaacctttttctatttaaattattcatgaaatgcaattccatttattaaaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacaatgataattagatcattaatgatcaaataattactgaactgttctttgtatcatttaggaattgagctccgaaaaatccgagaaaatttcagagagtagacttaatcatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacagaccgccgccgcctcctcaacgacgacccctaccgagcccggcgacatccttcctcatcgtcgtcgcctcctcctctccgacgcctgacgccgcctccaccgagcacgccgcggcctccaccgaccccggcgacgccctccaccgagcccggcgccgccgccgccaactcctccttcgccgactcctccctcactgagcccgaggccgccgccaccgaggcagccgcctccaccaagcctccgacgcccgacgccgcctccatcgagcatgccgccgcctccaccgagcctgcgacgcccaacgcccgacgccgacccccaggtgagtcctccatcgcgcatgaatgatgaatagatgaatgtggttcgattgatgaatgtgatgaataaatgattagatgaatgtgtttgaatacttgcatgtgtgtggatagatgaatgtggatgaatagatgattagagaggaatgcggatgaatagatgaatagatgaaatattcaatttatttatatgtgatattcaattcattttacatgtggatgaatatatgattagatgaatgtgtttgaatagatgaatgtttatggatagatgaatgtggatgaatagatgattagagatgaatgtggatgaatagatgaatagatgaaatgtttaatttatttttatgtgacattcaattcattttattactgtgagatgtgcaatttagtttatttatgtgactaatagattttagaattttggattcttagccattgaagcactaaatagtgtattttcgttatttagaaaaaagtatacgatgtcttagcaaggcgaaccattgtcgacgacaactagtgggtcctcaagggcacgtactcctaggacagggaacaaaatccctaaggaacggttccgcataacagtggtggacgccgtagggttgccgacatctccaaggaaaatattgagtcgatttaggtctatctgcggggtcatagggaggcagaagttcaatattctgcaagatgacatcaagcacgtgccggccgcagagaaggacattgcttggctaacgttcaaggagagcttcgattatcctgcggagcatgaggaccgtctcaggcgggctgctttcaaggttatgggcaacgcttgaaagaacttcaagactaagctagtcggcgagttcgtctacaacccggcgaatccagatccaagagagaaattttcttggatcacggaacaggtctgggaggaattccatgcgaagaagtcgacccccgagtccagagctagtagcgaggcatatcgcttgctccagaccaagaaccagcatctgcatcggcttggcaccgccggatatgccggtaaggaagaggaatggcagcatgaggatgaagaagcggaggaatcgaacacgccgcttgtgtttggcgatatcccacacccttgggctaggaactgggccagggccaggtaccagaagaaggatgatggcacaatcttcatgccaaatccagaagatcaacgagtgtacgaagctatagtaagtgtctagtcaaactagatgtttgcaaaggttccgatcatgcagtttatttaaccccactaaattgtaatgcagaaggagttggttgccgagcaacaagcctcgcaagaggtctgctctcgaagacgtgaggatgacctcctcacgaaagcgttgggcaacaaggaacaccgtggacggacacggggcattgggtcttctgttccctggaagtatggattaccagactacgcgtggcagtacaagaagcggtcttccaacaaggcggagaaagatgcacgccttgaagccaagatccgggcgtcgataagagctgagctgacatttgaattcgacgaaaagctcgagtcaatgagggccaagattaggcaagagatccgagaagagcaacagaacacccaggccgctgctgttgctgcgcacgaagagttaggaagtcccacccaaaaacacagcagctacgcatcaactgaggtggcggaaaatccaacatcggtggacaagcccggtggcccacataccggtaaaagtttggtccccaaggcatgaaagacttaacgagtccatatgatatataatattctta

SEQ ID NO: 22917 - DNA, 4949 bp, Oryza sativa
gtaaaagtttcgtccacaatgcatgaaaaacttaccgagcccatatgatatataatttttttaaaaaatcgctaaatctatcgcaggaaccaacgagctgcaccctcacagttagggtgatgccgaccttcacggttccagcagccgagggacttgcgtacaagtcgaccccagagacaagagtgcatggagcgcaactcaggggcgactgtgcaaaagttcaagtcgactcggtgaagccggaatatgagctattcccactaaagtatccaccgaacgacgaggtcctctcactaggaaatgcccgtggtaccttcatccaatggcccaaggacctcattgagatcaaatggcccaaggacctcattgagatcagggttacagcgaggccaaccactgcatcaggcagtcgtccaccaaagagacccgcctctgctccttcagcccctcctgctcaagatcgtcatgcacaatcttacgatgtgcagttgcagtacgacacggattttggggatgaccgaacggaggccgacagcaaggcgattcatgaacccccaccgatgaagaagagcgggaaggcacactcttcccctcagagaattactctcgataaacccaaagcaaaggggagaggaaggggaggaaaggtgcagtcctcgcttctagctccaagaaagctagatctgggcaagggccaggaagagactaagggcaaagaggtcaagaagaaatacgtcgctccataggggttccaactaggcatgccattggttggagatgacgtgcttgccgcaatgggcaccgcttgcaaggaccttcacgcatactacatggagaaatctaacgccaggaagccgaataaagctactgatatccttggagagcacgatggaaagtcattccttgatccaacaaattatatcgtcgtcgacttcaaggatctattcgacctctacagactccgagcggttgacacaagcctccttaagtgctactccttgtaagtattgtcgcccaactcaatctggtaataacaatcggattaactagcttacaagatcgtttatcctgtgtgtaggttaagttggcaatggtgtcagaagaatgcaccagaagttgccttccatgatccacaagtggtcactgtcacaaatctccagaatgaccgtcaaggaatgatcaactacatctacgacaccttgtggtcctgccgagacaaggagtacattatgtgcgcctataatcaatagtaagtgtgttatctaaatatacacaacagcatgacacattccttcagtacttaattaactttcactatattaatgccacagtcccattggatccttctggtcataacacctaagtggagtaaatgtcactacctaaactccagaattgataagaacgcatatgattggaccccaattcaactagcgatagatgaagcgtgggcccaatacgtgcaaagaggaggcctcaggaagacaggacatgacaccctcatccacaaaaaagacttcctggtgaagcaacaaataggtgaccagtgcggattccatgtgtgccacaacatgcgccttctgtacagagaaaaggtgaagactttggctgagtttgaggtcggtggtctcaattctgatagactaactacattttagtacttatatatgatcgatcaactaatctagaattatgataatgtagggtacaataaccaagtctctgcctaccagctttgaggaggttcgcgaggagatagccagcttcatcctccgcgaaataattaacaccaaaggaatgtttaggcttaaactaaaatgatgaacaatgttgaacttatatgtttaggcaatgatgaacacttattatgcaactgtgatgatgtaactgtgatgcttatatttatgtatatatttcatatgtttatgttaagacttgctaaataaatatttgatccaattaacttggttttgcaggtgaaatatgataaatatttgaatggatgtgaaatatgtgaatagatgtgaaatatgagatggctgtgaatgtgtggttgtgtaaaatatattgatgtctgtgtatgtgaatgcatatgtatatgaatgggtgatgctggggagctggggatattggatatctgtgtttgtttctgtcatttctgcagtgggcatggctagcaaaggcctgaggctagccaaaaaacaaaatttattttttttatggattatagtcatctgtgacgggccataactaaatgcccgattgagatgatagtcatctgtgacgggctctagtttacgcccgattgaggtcagtagtcatctgtgacgggctctagtttaggcccgattgaggtcaatagtcatctgtgatgggctctagtttaggcccgattgaggtcagtagtcatctgtgacgggctctagtttaggcccgattgagatgagtatcatctgtgacgggctctagtttaggcccgataaaggttagtagtcatctgtgacgagcactaattgtggcccgattgagataggtcatctgtgacgggctatagtttgactggtcgtatgggtcaaagctatcggtgacgggctttacttagggcccgattgagatagattcatccgtgacggccgtttgcccgattgagataactcttcacatcaatgacttctagcctgtgacggacgttgtgcccgattgagatggggcttaccgcccgattgagatgagggtatccgttctagtgtatcgcccctcccttaaacataggggagccaaggctgattaaaaggaatcaatcaaaagtgtttgcattggtcatataaacatcctctcaaaagtaagtgtttgcattggtcatataaacatcctcaaaagtgtctctacattggttgaaatgtctcaagaaaataccttttatatattaggcataaaagatgcctctataagataaagttaataaaatatgctaaaaatatctctaaagtatatatagagtaaaaatattatatgtaaattttaaattgtttgtactaagtgtctctgcacattgtaactcgtaattttagaggcaatatgaaaattgtcaaaaacaaaaatagatgatatgaaaattgccaaaaataaatatgtatcttcatggtgaagcgtagcttaactggttaagtttcttgtgacggaaccagtccacctaggtttaagtcttagatttgacacaggtgctcgcatttacagctaattattcttttggtggtaggcgacccgtcgacagcgagatgcctatgttaactttatctgtaccttaagatacgctggcccatatgggtatagtgttttttcataaaggtgagtgtacgcgtattataaatgcctgcatttgtactatatttaaagaaaatgtttttacatggggttgtttttagtgcctgcatcctccgagatatgcatcttgcacaacacttaatgtagtaatacttcaaatcttttgtattgaatgtagtggtttaatcacataatccgagatcaaccagatgtgtcattatggacaaccatcgaaacatcagttacaattctttaagaactggctacgccgctgattctgaaggctcacctcaccactgcagcatgtcttatgaagtatgaaaaatcaaacggaaataatgaggaaaaaaagacaaagacttctcacaaatgatgcagccacctgtgtttttagtgatatagagaaaatatacaaagtgttatcaacacttgctcatacaaaatgccatcgataaacatgagttgtacaatatacatgctatcagacaagtgtatatatttactttttgacatcaccattatcaaatttatcaaaaaaaattaaccaatttttttgtgaaaagtatgggtaaaagacaaaccatcacaaatactgaacttttaaaagttgtattcttttagtcatggtataccaacatggtttgttcttttgcaaactatagttacaaaaaccttccatattcgaatatctaaaggaatagaaccattcaattcagcaattttcaaaaaaaaaaaaacaaaaagaacttcccgtatatgaatttcttagaaaacttatttaaatacatttttctatcttataacagttagtttatttgtttgtgcccatgaatagttatcaaaaaccaactatctatggagcctggtttgcagtataaatcatgcatggatccaccagatccactaattctcaaacatggactcgtccgctaagacacatgcagcaagttaagtatgagtacataaagtatgattgcgagacacatgttttgctagcgaaacaacaagatacaaacttgccacacagcaaaaagttcaaagctcctttcccatataaacaaaacaattttgtccatacttatcgcataaactgacacacttgctcagtgctgcccggtcgctctgtccgggggcgacgcgggcggcgaacaagccgcgccgtccccgcccttctcttccccccccctcccagcctcgccgccgcccgagccgccgccggcaaagccaggcggctgcaagtacggcggtggcggggctctctctccctcgctcgcggtcaagacggtcgggacatcggcacggcaggagctcagggcatggcgtcggcgccgaccggcggcgtccagatccagtgccgtggtgcccggatccggtcccccagcgacgggcggcggcgtcctggtagctcggcggcaaggtttggcggtgggtttgggtggtcgacctggcgggagacgctgccggagctggctccagtacccgagcacggcggcgcggccagacgacgggtgcagcggtggaggtgccgagagaacccgtggtgacgtcggtgatgcgggaggaggcaacgacgcctctaaccaaatctgctggcggcggttgcggctgccgacggcggcaatgac

SEQ ID NO: 22918 - DNA, 4459 bp, Oryza sativa
aatgtggcgaccgtggacgtggctgtggcggagcaggtgaggatggcgacggcgaggtagctgggcgttcggcagcggtggctgcggtggcggtgaccacggtcaccggaggcatggcggcttcggacggctagctgagggcgtggcaaacggctgcttctggctggcgtggcatcatttggaggaggggtcggagactggctcggcgcgagaggcgcaggcggcagagatggaggctgggttggcgcgagagacgtagccgatggagagaggccggattggcgcgagagacgcatccggtggaggagaccggcttggcgcgagaggcgcggccgacggtggaggaggcgacctcggtgtgaggaggagctaccggtggatgtggcatgatcttcggcgcacggagcctggccggcaggggacgctggtgctggggtcccacatgtcggcagagcttgagtggtggtggagcatcggtgcgtcagccatggattcgcaggtggtgagcggcgggtgaaaacctagcctggccttagctggaccgacaacgattgttcattccccctcttgagggcgttgtcgtgctgtctcacccctcaagagtggttgccgggcgaaagcccagtcttggctcctttgagccccgacggacggcagcaacggtttttccgtcgcttctcttcttgaagacgtcgttttggcatcccctagggggcaatgttgtctgtgttcctttgttggtctagcggcagtcggttcggtgctagccttctcccgggttgtgtgttggcgctgtcggtgtgcgggtggtgctatattttttcatttttcctggttacgatccgccagggttgtaatcttgtaattttttcctgctctatcaatagaacttcgcaccgtctcgtacgagtcgttcaaaaaaaatacttatcacatcactctagctacatcgtcactctagctatgtggtgccataaatgtgcccggagatatgctcttgcttgttacttagggcttgttcgaagtagcatgttcggttagctaaatgaccatatgcaaaacgagacgaatcactagaaaataactaattaagtattaatttttataaacttaaaaaaataggtttatatttgaattttttaaaaaaacttttatataaaagttttcttttaagaaatcacaccgtttataggtttacagtaaacgaggcagttgataaaaaatctaataatcctcatcaatatgttttgtagtgaatctggtggtttattcgtgtcatcatggaaccatcggaagttcggaacatcacttacgtaaactcctttactaactggctacgtacgcgcgccggtgattcagcagcaggctcacgcacctcacccctcagagcatgcgatgaagaatcaaaaagcaaagacaaaaaatgggagaaaagacaaatttcttcccacaaaacgctcacagatcttttgccattattacttttgctgactcttttcaccgatcgagttcctctcttgctcctaacataattcctcggtttcatcggagcagagatcgaattctccccaaatcctcagctcgcgtagtctctcacagccaaattgttgctcgtacgtgaatccgtttgtttgagctgaatctcctttctgcatcatcatatcaaatcccctttcgatcttcatcttcctgaatccgtttgtttgagctgaatcccctttctgcatcatctaatcccctttcagcatcttcttgggcatcatactgttcttgtccatggctgcgcctgctgagaggagatcggagccggactggagctcgggcctcccacggaagctgctcgagttcatcgccaagaagctgccgtccgggcgcgacgccgcctccttccgcctggtctgctcgccgtggtgcgccgcgctgccgctggagacgttctacccgatgctgatgctccccttcgatccggactcaccggacggcgacgccgccgtggtcaccttctactgcgccatggacgacgacgacgaggccaccatcgacctgcgcctccccgaggtacgcggcaaggtcgcctgcggcatgtcccacgggtggctggcgctcatggacggcgccgcggccgtcacgctgctgaacccgttcaccggcgccgccgtcgcgctcccgccggccgacaggaacgtcgccatggcgtcctacaagacggtgtccatggtcgacggggcgtggattctgcactacatttctggtgccaccaagcccatcaagttgagcaacatgagggatgtcttcttccgtgagatcgtgttgtctgcgtcgccaaggaactccagaggtgtcgattgcatggccatggccgtgctcgcgagctcgacgttggtcgccttctgccggctcggggacgccagatggacactggtagattcgaagctcgagtacccagtgacgtgtgtggtgcactgccgggacaggtttgtcgcgattggctccctcggagagatctcaatctttagcgtcgataacactgatggtgtagctcctctcacggcgagcctgttgctcttgatgcctccgccggcacatatctgccagcgtagctacatggacataaatggcgagttgtacctcgtcggcgccattttacgggtcactacctggacaaggtatgagatagtggtctacaagtgtaacctcctcgatgagaatccgttgtggtccaaggttgaagattccgaggacattgcatttttcgtgtcgaagtacttcaacactggttttggtgtagcaagcacctccaacattagatggagctgtgtttacttatctgaaccgaggttctgtactcatgaagatcaaaaatgcacagttgatagttatctggaaatggtcgatattaacactaatgaatcagcattgcaagcttaccgccccagtattcagggtttaggggctctatgctggattcgtccgaatctctggagttgaggtatgttatcaaatcaaatatggacatatttgcctttatttctaaaggaaaattgctctataggaaatggatatgtttgcttcatgaatttaaattcagttgatctgcttaactaaatcaactattttagcatcatgggagcgtggacagaagaaaaatgtagaaatagaattcatcttctaggattcctgaaatattgagtttactggtgtatcacggacttctcaggcggtagggtgttttctgcccaagcccaaattaaaatcatttttttaatctagcaaaagaataattatatttatcaaaatctgttctgaaattccagaatttaaatattcttattgtttacaggaatcctcatcaaaatatttttgtggattaatttgttggtttctgattatgtgtaggtgagtgatgctgaaaacagcgaaagatcagaagagaagcatgcattcgcagtctgagacagagcacaatgaaagtccaggactgaaattatgcaatccaagggtagatcatcgctgcttcatccaaggctcggtttggagggctcagtttcttttaatcgcacatttcgtaatcccttttaataaaccaaacttttcctttttgtcatcatgagaggagtatccttgatagacaaatggtgattttcaagcatgcctgtaaacatttccagggtctatttaattttggtgccaataggatttgtaaattttgaagattgctatacaacttctttcagcaggattttgctgctagcagattccattgtgttttgtctgaaatgcatttgcttttccattgttttggaaaaatgcatattttgattgagctgtataccaaggactgcccagaatttgtgcttcacctgggcatatctcaagagcttaattaataattttactggagaagaaagaatgcacactgtcctttgtcgatgtcattttgaatgtgttccatatagagaatggctgttcattcagcggagaaagagtctcaaagatcaagtggaattttgtatggtgagcagtaagattgaatattgtatatttttgtccagagatagttgttgatattgccttttatgatacatcagatatgctactttatcacccaatgtaaaacatgcaggggagattctatgtggatttgaccctatctccggagatgaggtatgtgaccggttattccatgtggtttgcaggtcttagggtttatgcatgagcgtaatcgaatgtacacttgtttgattcatatacacaagccagcggccagctataaagtcagacatgccattttggttggatcgaccatattatacccgatttggaatttaatttattggtattcgagccaactatgaaatatgaatatatgaatatagagaacataggtgaatggttgacaaaggtttgacatttatctacccaacatggaacacaagacatattcctctataaacgttca

SEQ ID NO: 22919 - DNA, 21591 bp, Oryza sativa
catgtatttctagttatcgtcggtccagattttcaaaacctatgtgtagctacaaattggcttgaggtctcactgtttcagtatttttgtattagttaaatgacatattgttcgggttgttccattagaattttagattgctggcttgtcatatattaataagattatattccactaacaggttttggcgagtctatatgctgtctgtgcaaattagtaatgggttttgtcatgctcaattataatggttttgtcaattgcaaatggctctgttgtcagactaatagattcttttgatttctgaatagttattttatcatgcgcacttttgtttttctaatgcccactcattctgaaggttttatgtgcctacctcaatatctccatacttttttcaaatagtttttctctagcatcccccatttcatcactgcttactcattcgaatgttttgttgtgcatatatagactaaagttgatatactcatttatttatggtttttgtcaatggcgagtgtaggattattgtcaacctcaattaatacttgtacccagttttattggtacatatagttttgtctatacaactttatttcctgatgcttactgaatcaaaggttttgtgtgcttaaagttttcgattgtcgatggaaaatactaggtttttgagcatttgtcagccttgatatctcaaatatttttcctcattagttttgtcagctcagttatgtgagatatgtttcctacaatatttcaatttcaattcacaatatacttagggggtgtttggttcatggccacactttttcacaccacacttgtggctgtcacagtttgttaggcatgtgtttggttcgctgccacagttgtggcttgccacactttttcaatagcatgtcccatatgtcatagactcaattttcttaccaactttgccatactttgtggctagtaatttgtccaccacacttttgtggctgccacaacttgcgtaacgttagctgtggcaaagtgtgaccggcaaccaaacacacccttaatctttgtctccttggcttctgagtattgttttatttcctgggtcaattaacactacctcgtcctggagattttgtgatgcacatttggcatgtttttctcatttgagaatggtacatttgttagccttaatatatcactactaaaaagacttttgcgaacaccacctcatttttttaaggcagacatctgtatgcacaaatatactaaaggcccaatagaaaacctgtgtgtgaaaatccattttcgcaaacgaacctcttaagagatccgtctacgaaaataggtttatttttgttagcggtcctattacgagatccgcatataaaaaatctttcacagcctcattttcactccttttgtttttattaagtcctccctcctcacccagaggcatggcggtggacttcaagcggtgatgtcagtcttcaggaggcgtcgaggagcttaggggtggtggactcaccggcgacagcaacaggaacggtggatctgttgatagcaattggcgatcttaggtagggcctcacggcccgtttagttggagggagttttagaagggattgagagtttagagggataaggctattaagtgttttgtttggttgggagacatgggaattttggtgggataggaatggggaattgaggaaggaactccctccttttcaatacctgggtaggtgcaggtaattgggagggaattcctcctttactttgtgtaagcaaatctcagccatccgtttttattaatgacctaatctccaactaaattacctatcaatttccatcatctctaccaaacaagatattgggattaaaaatcaaattctcatcttaatctcatcatcaattccctcatataaacttccaatcgtctttcctcgagttaccaaacaagccgtcaaggctctgtgcggcagtggcagggtccgtcgacctcgaccgtgacgacaagggcggggctgtggccagggtttgcatgttctagatctgaataggataggattttaagattcttttttttttggggggggggggggaatttccaggcaaatggcttaatatgtccgcttgggaaattaaaaaaagtaggtttgctatcatcggatttattacagttggattatatgaatgcaatgcgatggtaattaacaaaagtcctacgacgatgaacatcattataatattttattatgctaattgatcctatagtgtttataatctactcaggacaacgatgggacttgcagagttcatatatgcccaacctgacatcaagggcaaccaacccaggtaagatacgtatgaccttgctctgttaacccaatacagatatattcatcagatagtttgtagttttctaattcttacggcatggtgggaagaactcggtagtcgatcgatgcagggagacatccagcgtagcaggtgcaaaatgaatccaaaccaagattaccagtcaaatatcatcctgctgtgacagctgatttacattgtccaaaagctgatttatcatacgaattgaaaatagccatcccaccagaaaatcacgatcacaaatagtcgtgtgaccacaaatcaactgacatatcctaaggacgatttaagagggggtatggatgacaaatttgcgaacaccagaacgacagactttctgcttgattgattcagaagcccttgcaacagcaagttgagattgtcatgcacttgaagcaccttctcttgccccctcacttgtagaagcagcatcaattcctttcaaaaatacagggaaaaagaaaagaaattgcatcagttactgcagaaatgcagagagagagagtcacatcagcagggtgatcgatcaacactttgcacttaagccgtattagtaggaacaatacacgaaaatcacatcagcagggtgatcgatcaacacctaatctgctaattacatgagaaaatggtaattttacaacttatactaatccaaaagcaactaactggcatactatttcttacagtctagtagacagtaacaaatcatattatatagccaaagagaaattttatggtacttgaggaaataaccgcatatacttggaggtaccaacttttacactagaaaatgtggtatctcccaataccttatcaagaatagtaaaattactcatagctaaaagatacataattagcatagcagcacacatatgtaagcagctagttagctaaaggatgtataatcaatggagtagcacacatagatatcagcagcagaaacttagctatatatacctggaatgcagaagcttgtgtagggaacaactgaagtgcatttgtcaaacaccttcctggacctccttgaattgagttggaccatatagacagcagcagggtgatcaggcgagtgtgtgcccacaaagatgacatcggtgccctccacggcgccgagcaactgcacactactgggaatccatggagtttggagggcgccatcggggagtagcggctcgagctcaattgcccttcccctgatccactgcgcgactccgttgtcatccacattcctcgaccacaggcgtaatcggagacggaggcacaatttctcgtcctccggctccacctcgacgcatcgcagcacgccgtcgtcacccatggacatcatgaaaatgggggaactgctttcgatcaatggcggcgggcgtggcgggccgtagacgatcgacaaccgccgctgcccgccgccaagccggagctcgaaggcgtgcgtggagctccaggtgaagtagagcgtgtccccgacgaggacgctgcggcacggcaatggcgacctgtcctcgaggtagtagaacacgtcatggtgttcgacggtggtcgtgtcgctccactcccccgtgtcggaggagtagacacgagcggaggtggcaccggggaggtgcgggaggaacgggctagggctgtggctccagatcagggccacgaggaatgggccgccatggcagctgcggtggtcgcaaccacccccgccgccgccggcggcgcagagcaccgcggcgttgaagccgcggccggtgattgcgagtggcgacgacggccgtggcaggcggcggtgctcgttcgtgaagggatcccagacgacgaggtcgtggcctaggctggtggtggcggcggcggcgcggcgtgggcatggcgtggcgaagagggcgcggccgtggcggcagtcgaggacgagccacagcgggaggtcgcggctgccggcggcggcggggcggcgggaggaggcggcgccgttgttgggggtgtagcgggagccgtagcgcatgtccccctctcccatgccgatgcggaggaaaccgacgacggggggagcacggtggaggcggcggcggagtgcgcggtcggcgaggatgcggcgccagaccttgcaggcgagggaggcgcggaggaggcaggcggggtcgtcgggcgggaggcggacgaggatctcgccgacgagctcgtcggagagatcccgcagcgacggcgacggcggcggcatgggttttgggaatggattgcgacggtttggggtatggaattttgctacttttcaacaaaacaaaaaaaataaaatcgatagtacttaacaaagaaagaagaagagatcgatatttaccgaacaaacaaattactagcattaagcccttaacaataggaatgagaatcggtatctccaatcagatcaatactttccatcagtgtatacttccttcgtttcacaatgtaatactttctagcattaaccatatttatttagatgttaatgaatctagacatatgtatgtgtttagattcattaacatctatatgtatgtgaacaatgctagaaaatattacattgtgaaacggatggattattacattcatgctatccttattatcatgacaagcttaattgttaaaactctaattggataattgaggttttgttttagggcagaccgtagaaacagtccagggtgttcttaaaagctactttctccgtttcacaatataagactttctaacattgcccacattcatttagatgctaatgaatctagacatatgtatgtgtttagattccttaacatttataacatttatatgtatgtgagtaatgctagaaaatcttatattataaaacggagggagtaagcgctagtgtaacgtatatgccaaagtcaaaaaaaaaattaaaaaaattaattttggagttggttttaaggttttcttttatcgtattttctatttcaacattaccattttaagtcatttagagcacataggtaaaagttttaactataaattattttcttatcgctaatacgctgattaattggccaaccgatggcagcctacacataacgcttgtgaatttagcgggcttatcggagagttagtaccaaagtctatctgaaaagccgaaaacgctcccttaaagttgtctatttcccatgaattaaaattttaaattggaattcgaatatgaaaccaaatcatcctccaaatcaatccaatattaaagagagtggtttattcctactcgacgcctgggctgatgaaagcctttctctccctcctccagcatggcccagcccataatagcagcacgggccggtttttctattgtgggcttcctccagcagcccacaatagcaccaaaggccctgtacgtcgctgccgacgctgtcatcaccgtgcctgttacttgtatgagaccttaaatttttttaagaaaatgttttggctggaacattaaaatttcacggtagttttgtaagttatgggtagattagggaatgtagtagactgacgctgaaagttttggaaatttagaacttcttttttccaaaaacaagataattagtaaatactaaaactatactaaaccttttggtttcttttttttttaaactaaatcggcaggtagaggctgccaattatactttcaataagcaggagtaaaaacccagacgggttacgagaaaaagaaaacaaaggacgctattgttgtcggccgaacaagttcacagcacgcacaacaactcaacgctacaacccactcaaaatagaccatcgacggagcctaaacacgagtcatcgttgccaagcttgccagagcaaagcagctccgacttcacggcaaacttgtgtcgtcgttgccaagctcatcacagaaacgaccaagcagctccgacttcccatggcgaacatcagccaaagcaatcgtatcaccgcttcctgcttgttgttggcaccaacacacctagagagagactgcaacgtgttatcgttaccgagcttcatcacaccccatcaacaaagcagccgagggttatgtttcgcccccggtcgcccgtgcgtggacgacagggggccgcctgcgccgtctgatctgatttccagttgatttccagttttctctgtttcaaccttttggtttcttccttattatatatttgttgagtcattaagaaagatagtacaaacgcaaatgcttaaaatataggcacacttatatctatgaacgcgcatacatattctacctttataagtatcttaaaggggcaattgcaaatttaccactgctttgaatcgttattgcaaaactgccactagaaaattgcaaaaataccactggaactgtcattcgagtggcatccttgcaaaattgaaaaaaccggtggcaaaaaagacttaatctgtaatcttgatattaatgaagttattactgtgggctacttactctgtcctgaatataagtatgaagtaattattccgtactattaataagtgctctttgcgacaaaagctttgtaagaaaatttgtaggacgtaaatcctttggaagatttccttttctcttttggaacaaaggaatgagccctatgaaattcatatgggattgctaaattagggcccctttgaatcaaaagatttacgtagaaatttaataggattcaaatcttatagaaaattttcatatttagccctttgattcaaaggattgaagctttccaattcctatgaaatggcgcattgtatgtggattttggaggaaatatagcaagagctccaatctcttagaaaatttcctttgagtctatctctctcatctgattcctgtgtttttcttgcgctccaatcaaacggccattcctgtgttttttctatattttgcaatcatctgttttacacttcaatttctatcaaaatcctgtatttttcctattcctccattgttttcaaccttacgattcaaaggggcccttagtgattttgaagaaaatctaacataatcttgaaatcttttcccttggaatcatctttccaaattactatattttttccatgtggaacatccaaccatcgcacaataagcaattcctatatttttcttatttttaggataatgccacccaaattcattattactgcgctttttaaacttatgaattacaaagaagccctaaagctagtcacaatctatgtatgcataccatatttaccatgggactacctattcttactcatgaaatgtctgggaaaattcagtccccactaaaaaatcagatttttttttcttcattgcttcattctgcactaaatattttctctttaaaaaaaaaactttgcagcatcttcactgtcaactacttcctccgttttatattataaggcgtttgactttttcctagtcaaacttgattaagtttgaccaagtttatagtaaaatttacatcttaaatatcaaattaattttattaaatctaaaattaaatatattttgataatatatttattttgtattgaaaatactactatatttttttataaacttaaacgaagagagcagtaatattgaagtgttttgaagatccagattgtttcttccctaccgcctaacaatgaaaacgattaatccgcctaatttttaatggcggaatgcaatagcatatgcataaaaccgatcgaatctatcgaagaaatgcttaactcttgtcacatcctgatttttgtttcaggatttataaattatttaataaattattattagaatttatattaaatgttcattaatttacaagtgaagttaaatgtgggaaataaaatttcctaaatataaagcatggatggatttaattttttattaaattctctatggttaattatactctctggaatattctcggatttttcggagctcaattcctaatttttaatcatacaaagagcatttcagtaattacccacatattaaattaatcattaaatggtctggttttaatatttttaaatactttgggtgtccaagtatgttcaagatttttcttggaattatttgagcataggaagtatttttaacaattcaaagatcatttcattgattaatttaataggaaaagtaataataatcctcttcctagtcttgggccctttccagcccatctccctcttttgtgtgcacggccgtgcagcccaattcggcccagccgagctccccccttctctttctttctttgctttgttttcagccagcccaagacgaaaagtctaatttgcctccctcgacactgtttatcttctgcctctagcagccgaactgagaccgatttggctcggtttttctcctccaaatctgacctttccccttgtgtttttctaaaattagttgaggggaaatattcctcttatcctcctctatatttacccctaaaaattggagctaatcgttgagtatcttatccgaatcgaactcgttttcgagtttatctccgaaaccgagtttttgatttcccggatcgatttcttgcgggaggagtccgatctcttcaatccaaggctataaataggaccccctagtcctcctctttcgtttgccccctctcccgtgatctcccgtgcctcgtagcgccgccgccacgtgctccaccccgccgtcgtcgccggccgagctccatccgcgtcgcgccgccgcctccgtcgtcgccgccggtcgccgtcaccgccgtaaggtgcgccgaggtgtgggcaagctcggccgctctctccccgctgtcgccggtcaccggagccccgtcgccggccgtcgtcgttcgtcgtttggttcgagggtgagtaccgttaggttcgtctcgtcgtcctctacgtgtacatgtcctccaaagtcgcagccgaccatccaatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcattggtggtgtgaatctattcctttgttatggcctgtttgcattgattactttattccttgataccttgggttattataacttgactagttgagctttatatattggttcagctagatattagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatggcaattaaggaccggttcgcgagctactgttgtgaaacattaaccgtgccaaccacaagccagcgtgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgccacagcctctattcgggtactttccagtatcgcgacgcatggtagacataatgttgaggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgttgtgtggcttgttgagtatgtcatatgctcattcttgcaataatcaatcatcctcagttgaagaaaaaggatctagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggttgattgctggacgaggattttatgcataaataacttcggaaattactagtgaatttccgggcgtgacaactcttttaacttttcaaggaatccttaatcagtgtatgcatatacgtctcgataatgaatcatgttaaagttcatttacacatgactgtacttaaagtctgaaaccaaagaaaagaagatcgagatagccaaatcaatctttgcaagacataaacagccatagtacatatataagggttgatatgtctgattcacaccatgtctcttctgtcgcgtatgcgcagataacccttccttcctgcctaacttaagctcttcttcccttctatacactactacacaaagcgttttcccatacggtcaatctgatttttacgtgcaaagcttcggcccgtctggaacaaatcacctaggaaaatcacgattttcgcgtgcagtggcacccgcacacgaaaatcagattttcacgtgcggtcgcttatgccgcccgcacggaaaaacaaaacaccgaaaaataaaataaaatttcaaaaaaaaaaaccctagatcaggtcggcggtggtggcggcgtcgccgctcaccggatccgtggcggggggagggcggccggccgccagattcgtgcggggaaggccgctgctagcccgcccaccggatccgtcgcctgcgcgctcccgtccgctggggagggaaggggacgggaggggagggcagccggttcccacgccggatccgtggcggggaagggcagccagccgccagatccgtgcggggacggcctatgcccgccagatcccgcgcctccaccaccgcgccatcgtcgctggcgccgcaccgccaccgtcgccgccatcgatgccgccgcttccgcctcccttaccgagggcgccagcatcgccgaggaggaagagggagatgggaggatggatggagaggtggtggggagggcgagcgcgtggggagaggataagggtgagcgtgtggggtgggctattttcgtgtgcgggcctgttaagtggcttgcacacgaaaatatatttttctgtgcgggcgacgtcctgatgcccctttttcatttttctgtgcggttgcacttatggaccgcctagaaataaactagtctggtgtccaggaaaatctttagtgtagtagtgatagtgaaggtgtacaattaaaccgttaagtagcggatccagaaatttagatcgttggtgtcataacatatctatcgatgttatagcatgctaattatatttagaatatagtgttacaatatatgcataagcagtttaagcatgggttttaccgaaagttgtcggtgtcgcctgacaccggtggtaacactgtagatccgcccctaaaccctttgctttctcaagtcaataaccaaagaaccaattgttcaggaaaaaagaaagtaatttcctgaataatactcctactttcatccctaaataaacgtaggcaggaatttactaatttcatactggtcgcctaaagctctttaatacttctatgtccttttcttatcatttttagttattcaaccaatagaattttctcctcctcattttctctctctctctctctcttcttattttctcttcatgtttatgaagggtatagtatacagtttttagcttcttctaatatatctttgaatagttaaaactatatatattttacagtgggagtaacatgtacttccttcaaaatgtagctatttctaacacagtagcttgtcttaaaataaagctatttcttcatctacctcctactctcaaccaatcacaagcattcttcttcacatactttctcttttcaaccaatcacacactttctccaatcattctctggttctcacatactttcttaatacacgtgctaaccttaaaaatgtttacattttgagacggaggaagtatgaaattatcaaatgatgaaccttctctttttgactttcgagaagcacattcagaaacaaaggttctctggaacacaaaaaactgagagagttttttagaaattagctcaaagttctttttaaaaaaaacctcggaggcaataagagaaaggagtagctaaatctcagacgcctacaaaatttcaaattccagcatacatttctgagtgtaaaattatagtagtgtgcaaatagccaaatatgcaatttgttacttctttttaactgtaattttgttgttatatagtatggctttactttatattatatcaaagttttactattttccatgtaattttgcaaatgtcatggattgtattttttttcatataattgtactgccatctaagtagagagaaaagtgaccgaattttcctgaaatctacatttcctttaaaaatgtttagctaccagggagaaaaaaaataaactcaatactaaaatgatttttacaagtgggtagaagaagacaaagaggcagcagagaagaattgaagatgctcctaggacagtagcctgtagccacctcatctcctgttttgtttgctttttttttccttttttttagggagcctctcttgttttatttgctctgcattatcatctctttcttacaccagtcgtccattccatccatccatctatacttagctgcacactgcccgaggcaacgccaccacacgcctccccttccatgctcccggtccaccatgagccaacccagaaatttatctccatgtcaaaatataaaagattttcactgaatttcacacatacatttattatattacgatgtgtcacaaccacctaaaatctcttatattttaaaacggaggaagtaaaatataaacaagtttatttttatttctttctatttgtccttaaataaatttatttttaatatttattatatcaaagtttgtaaaagtattaagataaatatattttgataacaagagaaataattacattataatttgataaagtaatggcattctaatttttttaatatgtggaattagttaaaacattaaacttattttgggacgaaacaagtaaaaggaaagtacccatggtccagtgcaacaggttcaccatctgtcctgcagtattcccttgccagtgggctacttgcacagctaccaatgcagtggaccatggaccatggcgcatgcactacgcgtgggtccacggtagactagttccatacgccagcgtgcatgcacggaattccaggacacagccctcgtgcctcctttttatgcaaaaaaaaatagaaaagaaaagaaagtgcagcgatctaaacttatttaattaccaccaccatcagagatcttgagacagggtgatagaaagtcatttgcatcaagttgaccaataattcatcatagcttcacactgtactagcactagtattttatctccatccaataattgagattggtcagttgctgacactgtgtgaacttggggttacataaactcaattacaggtaaaaagtaaaaagaattactcatcaaatgcacctctaattatcttcttttctgttcatctctctcaagactagattaattttaaccacataggaacaacatctaatttcttgagatctacacactgagggttttgtgaagcaggctaggagcggtacagggtcttgagcctctttgctgcctggatgaagcccagaatcacctgcaactcatccaattgctgctttttgtttagcatttggaagagattggagccagaggttaagacttaaaaactgattgtgtaatcacaggttatacaatacaaactgcctatctaaaagatataagtaggtctgtagctacctgagactgaaaatgctgctggaccccatggaagagctgttcctttgatggattggggttcatgcttacctgtgcatagtttttcatcattaagcgcacattagaccatggaatgatggaaatgaaaagataaggtttgctaatcaataaatgggatgatccaggctgcttacaagattgaaatgcttccagtatctccacagcgtaggagttccaagttttgtcaggtttactctctgcaaacaaaatgtaaaatatacttcgatcagaacacccgtcaaaaaaaaaaaaacctttgaacaatggcacatgatgtgcaaaagacagattaaaatcctagcagatttcgtagcaaactgaatgaattgtcaatgaaatcgattccgccatgtccacaataaggcatgcaaaatgcattggctaaacagcagaatggtctatgacaacaacagatcctacctaaccatgggccaagccacgtgatccaagggtcacactggctttaattcttgatggcacggtcagatatctcaaaagtattactcattctgtatacttattgcgatagcgattagtaattaccgttcgcagctttgtactggggtgaaaattgcctcggttgctggattttatacaggaagaccagggccttgtatgccgaactcttggctttgttggtttgtggtactctatgctcgctacttgcgaaaatagaagaaaattgttagttgatcacactactaatagtttaaagcaattggctaaattgcaattatcacagaatggtcttacaatagtccatgtctttgtctcccatgtcggaactgctacagaacgaattgttgccatcaatatcatcatcgtcttcgttaccagttggaggttccaatacactcaaagcattcctttgcagcttcacctctacaccattctttagaacctgcatttgcaacaatatctcaggtccaggtcttgtttttcattatgtcatatcacctctcctttttctttcgagaggatatcacctcaaataatggtgggtatagattatgacggtattattaacacagatgatcttttaaaaacatgtcgagaactgcttgccttgctactttctaaaacaataaaagtcaatactattttgttcattagttaaacaagcattttcaagatagaaaaccacaattgagtaaagtttaagtgggatactaaataattcagcgggagactcaccagccagtgccaacctccaagaccaacagccttcttgacaacaccttgtaggccaaccaagacggactttgttcggttgttcccagtgacgatgaccttcgtgtgccgaggaagcaccgagagctcctcatcgccactctcgtaccgaggcggagacagaacccgggaggagcatagctcagtctccatcatcatgctgattctctgccctgatctctccctgattcaaggtttggcagcaaatcaatcagtacacaacaaactcaatacagtggagtgttctatgattgactatcaacagcaaacaataaatagcactatcaacccagtgccagaaaattttcctagattagcgcaatgttcaagatttattgcacggtgcaagaaccaagtaactctgcatctcaaatctgcaggattggtgaactttgctaaaaacagtgctgctccaaaattaaaaaaagtataccagctattattaggcatagcaggatttcagaaactagctcaacataaaaaaaaaaagcttgaccctgcataaagggaatctgaaattcaaaatcgattcttgagtcctaagttccacaggaaattcatatttatattttttttgcgtacattaatttccatggggggcacgagtgaagcctgaaagcgatttacatgatgtgacacctccatgcaactcgatccggatcagaactgatgcggttgcaaattacaaacagactggagagcattagtgacccccaaccactaaccatgatggtgatgaatcggcagagacactcaccaggacccactaccagctagctagctgcaagaattgctcgttacttgctggagtagcaatcgtgaaagtgatgtgtctaaggaatatgtacaaaagcagtgcatgggattgccaggtagtaaatcagaaatgaaatggtgtaagcaatcaattttggcttaagcaatttgcttagctaggtgcttggcattaattatgggaactggatctactaaaaaattatgtggagtaaccacaagaatttaatagttggggcaggtaaacaatcttgtgttcatgctttcagtaaattcgcatttaaagcggagttatggagattgcagactacagtaatgaacagtacagtacaatctcgtgatgcattttcccccaactaataccctggtgcccgattttaataaaataatttcatatatttttttccagtgcaatctgcactgcaaaaattctgaatcaagtatagattcgaatttactgtaaaatttcacagaacagctcagaaacccgatctaaatcactttagagatcgcctagcttcaagatcttaattaaatgcaggatgaattgggaaatgctacccggtgtattagaagaaaaatcgcatgcaaatccagaattcttcatagtatagaacaaaatgcaatcaaattcttgatatgaacttctgttgactgaagatcacagctgcaacagtgtatttttctatagagacacaggatcctagtagataagcaattaaggatatctgtactcgcgctgcaaagtctactgtaattttgaatttgagaaaggagacgcgaattcaaaatgcgaaagactgtctttttaaagcgcaatccgagctcgaattattcaaaattcagagcaagaagggagattcaaccacgggtttaatactcgcagattcagataatgcaacttcgatttgcgattacggacctaatcacggaatcagaaatcgaatccatcccaatcgagcaccaggaatccaaatcaaatcaaatcaaagctagtacaaaaaccctgcaagcgagcagcgcaaaacccgctgaattccctccgagctcaaaccaccatttactcccaatccatcaaaaccacaattcattccgcccaaaaattcaactccccagaagacaaaccaactaggtaaaatgcggatcaaaaaaggaaaaattcaagagggcaagccgaggggggttttcttggctcacctgctccgatctcgccgcaatggccaccgaatcagcccgggaaacgatcgagccgggcggtgtcgcggatcagggacccgattccgagcccgaattgtgcgccgaggcgacggatcgatgcgcgagagagggaaatccgagcatgaagaagaggagagagaaagtgaaggagaaggagagagagaagagcactgaatgctttccaactgcacagaaaagagcaaacggatgagccggctttaacgcgcaaactcggctcggctcgggcttgatctcggcttggctcggctcggctcgtggagatatggctgcgatctactgtgacgtgggggttgcctggacccaaatataataaatcggtggtgtaccaagcaggatcatgagtagagagactgacgcgtggggccagttaggtcgcagaagtaggtgggaccagaagtcagtgactgtgactcaaacaatggtggtttgtggggatgtttcctaaacgacaagataggggcaaaagaaaaaaaaaagaagaaggcagatgatgatttctatttttatttaaagagtaaatttcataaaattacatatactttacacgatctatcacaaaactatatatttaataacttatttcacaaaactacagattcaatgtttttgtttatcacaaaactacaggtactttgcacaatatatcacaaaactacatatttaagatcttgtttcacaaaactatatatttaatatctttatttatcacaaaactataggtttagtgtcttcattattacaaaactatagattttgctaaaacctatagttttgtgataataaagacactaaatttatagttttatgataaatgaagacactaaatgtgtagttctgtgataaacgaaaacactaaatctatagttttgtgaaacaagttcttaaatctataattttgtaatagattgtacaaagtacctatagttttatgataaacggacatattaaatctgtagttttataaaacaagctcttaaatctgtagttttgtgataaattatgcaaaatacctatagttttgtaaaatttactcttatttaaaaaatgaaataaaataaaatcgcgccgctgcctggtttctctttctcctcgatgccgacgaccacctttctcctccttggccgtcggcgactaccgcccccattccggccggcaccgccgcctctcatctgccatattcctgtcccaatccgcccacacgagctggctgaaaagtggaagcggcgataggcggcggcgagcgagacgagaaagagaacgattttagaggaaatgattcaaaacaatattatcaatccctacgaatatactcccttctcctctgggtttttttttttgaagcgtatgaatgttagagaattttcattttcataagaaacagtttaattcctttaaaattcatgtaaaattcatccaaaccggaaaggtcctaaggctgtgttcaggaggtgagttcacctcccacgcacgtaaaatggagcagtgcattttcttatgattaattaagtgtttactatttttctaaaaaaatgaattaatattattttttaaaacaactcttgtacataattttttttcaaaaaacacatcgtttagcagtttgaaaagtgtgcatgcaaaagacgagggaggtgagttgggaaagttggagaaagaactcaacttgtgtcattttgactttttttattcattttttttaagttgaaccaaatttatagaaaaaatatagctgcattttcaataaaacaacatattgctaaatttgatgttaaaagtgtcttctagtttgaggacaaattccaatttactaatgccttgtattattatctaccttatagttcactaatacagtcttatattcctcatttctaattgataggtcaggattatctcacttaaaatctactcccgtgattttctcatctttctatcctttcggcgtcgctccctcttgccgctagcgtcaccccttctcctgaatcttgatagcggttgccaacagcgccgccccttcgccctcccgtccttgaaggtgaagcagcgtcctgcctcaaactacaccctaaccctgatcccccaaaaccctagctgcaattgcaccatcttcaggtcgtcgttcgatctccgtcacgctgcctcgccctctcaacaacacacattccccgcctgccattctccatcgtgtcaccataaagtcgtcgtcgatccctcgccgtccgatctacggtgcctggttcacatatcacatctaagtgttttgcgtttgctagccttgtaggctcaaggctgccggcggctctaggaagcggaagaaggctgccgctagtggcaagcacaagcacccgccatctgttttctttgtcttcatgtgagtttctcgctccttcgcccaccacactatcaggacgtgcaggcggacgggtgggagcggtcggatttccccatcatctacgagtctggtcctctctcgacgaaacgcatggtatcctaacctcgccttgaaccctaatgctctctgaataatttggttcatggttggtgtgacagccatgaaggcggcggcgggatttagtgcccgcacagtaatctatactccctctgttttataatataagttgtttgacttttttttagtccaattttgttaaatttgatcaaagttatagaaaaatttatcaacatctaaaatatcaaatcaattttattaaatataacgttgaatgtattttgataatatatttgttttgtattgaaaatactactatatattttataaacttagttaaatttagaaaaagtcaaacgagttataatatgaaatggtgggagtattggtttggtgtgatttctgtttgtgtatcggacacatgtgggagatcggggacaaacctaggtgtttgttttggtcggcgtgcgttgtaggcttgcagccctttcgttcttgtagctgcaccgctgtaacaaactaacaattttactactgctgtaacagttttactacgaaaaaaatccgagttgctctgggatgaagttaacttcttcattttcatgtcagccagtgtaattagagaaattgatgctatctgtgtttgcaataatgtccgtgtgattaatggtttgtgcaatttgtctcgtagataacagaacaagaaattatcaaagcatagaactatgaattaggggtcgaagaaaaatgtcatagacatcagatatttaccacctcgatcaaattatccttgttttctccgtccctttccttcaattttttttttgtggtcacaagattcagtggcttcctcgcctgtactatactccaccatcccaaaatacaagaagattttattgagatgtgacacattctaatactattgtcggtgacataggaccgagagtatcatgactagaggcttgggcaggagcaatcacccacgaggcctgaccccctcgggggggtcgggcccgagggtgatgtggccgcccccctctttgtcttcccgaggggtcggaccgctcccgtttcggccccgagggctgaggcgccccgaccccttgaaggttttttgcgccgcgtgtatgggttaggtgagagcagcgagggctcacctaaccgcatttattgcggtttggacggg

SEQ ID NO: 22920 - DNA, 19192 bp, Oryza sativa
cttcatcctagccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcatctggcgcgccaggtagggggctctgcgtgtgtttttctaagctctcgtattctttcgtgtgcgccaagcttttcctgttcagcccaatggctgaaccagcaaaggcgcataacctctctccgagtgttagcggtgacgacggggagccgaacccacgccgtcgagctcgtactccaccgccccctccacgccaaagtcctaggcgggaggaagcgctcgagagggtcgaaagatccgcgacttcgacatccacgggtgatggagaagggcgccgagatggggagcgtcgcctcctcgtctacggcgacggcaacacgccccagggtgcgctccaagctgcgggcgcgctcctacgccacccgcccgtcgtccctgacccggagtctccggcccaacgttggctggacgacgtggccaacttggtcatgacggcgcggcagcgcctagatgctggtgggcggtcctccgccaccaagacctctggtactgctgctaccggctccgcgtcgtcaagacggagggcgcggcgagcggcggccgctgttcgccattcggccgccactccttcgtcagcgcctccgacccgggaagatttgcgtggggggccggatgcccgcatcagtatcgagcgccggcgtaatggccgacgtgctgcccacgcaacggaaggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacatgaccgggatcgaggccgccgggggtgacgacagggtcatggcgaatttctttcccatggccctgaagggacaggcacggggttggctaatgaacttgccacccgcgtccgtccactcttgggaggatctgtgacaacagttcaccatgaactttcaaggcacatatccgcgcccaggtgaagaagcggacttacatgcagtccagcgaagggatgatgagtcacttcgctcatacatccagcggttctgtcaagtccgcaacaccataccatgcatccctgcacacgcggtgatttacgtgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgctgctcagacagggcggcgtgacaggaggaggaagaagaggtcagcccattccgacgacgagggtcatgtcctcgccgtcgagggcgcttcgcgggccacccgaaaggggaggcctgcgagcgacaaaaagagggaggccagcgctcccagcagggagcgcccaaccggcaagtggtgcaccgtccacaatacctcccttcacgacctcgcggactgccgcgcagtcaaaagtttggatgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggttttcaagagcctggggccaccattgccactgtcgatggaggagcgtgtgctcacgtttctcgccggagcctcaaggccatgaagcgagagcttctggccgcggcccctactcatgaggcgacgcgccgggcgtggtggtcggaggttgccctcaccttcgaccagaccgaccacccaccgtgtgttgcccggggaggacagattgcaatggtggtttcccccactgtttgcaacgtgaagctggggcgtgtcctcattgatgggggagcagccctcaacatcctttcccccgcagcctttgacgctatcaaggtcccggggatggtgctccggccgtcccagccgattatcggtgtgacgccggggcacacttggccgctaggtcatattgacctcccggtcaccttcggtggatccgccaacttccgcacggagcgggtgaactttgatgtggcggacctcagtctgccctacaacgcggtcctagggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttggcacctccgcccccgccgccccgaggcagcagatagtcatatgcgacgaggtcccggtcaaggaggttgccctgagcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggcctgttcggcagaaagtgcggcgccaggccccggaacgtcaagccttcatccgcgaggaggtggcgcgacttctggaggccggattcatacgcgaggtcatccatccggagtggctggcgaacccggtggtcgttcccaaggcgaacggcaagcttcggatgtgcatcgactacaccaacctcaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacttattgttatacgacaatgcccttcgggttaaagaatgtaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttcttgggttcttggtctctgcccgaggcatcgaggccaaccccgagaagatacgagctatagagcggatgcgccccccagcaaacttagggatgtgcaatgcgtcaccggttgcatggccgccctaagtcggttcatatcgaggctgggagagaaggcgctacccttatttaagctcctcaaacgctccgggccgtttacttggatggaggaagctgaacgtgccctcactcagttgaaggcgtatctcagctctcccccagttctggtcgccccggagccaaatgaacccttactactctacttagcggcgaccccgcaagtggttagtgcggcgttgcttgtggagcgcgatgaggacaatcctcattccgcgcatccccaccctgtgttggcttggcccgggagagagcagggaagagaggcccccgagccgaacggtggcccaaggcccccgacgaccggagctggccctctgcccgcttgtcagacggtgccaggtgcccccgacccccaggatggcccgggggccactgtgggaaggctgcacctatcgccctctgaccccgaggctaaccctgtgccgactcgacccgggagagagcagggagaagaggcccccgagccgaatggtggcctaaggcccctgacgaccggagttggccctttgcccgcttgtccgacgacgccaggagcccccgacccccaggacggctccgaggccactgtgggaaggccgcccctgtcgtcctccgaccccgaagtcgtcggcacagaagacgagtgcgccccgcgaggccgcttggacaaagagcgccccagggatgtggcccctagtgaagaggatcggccccaccgaaaggtgcagcggcccgtctactttgttagtgaggccctccgggacgccaagacccgataccctcaggcccagaagatgctttacgctattctgatggcttcgaggaaactgcgccattacttccaagcgcatcgggtcacggtggttacgtcttaccccctcggccaaatcttgcataatcgagagggtacaggacgggtggtgaaatgggcaatcgaactttctgagttcgatttgcactttgaaccacgccacgctatcaaagccaggccctcgccgactttgtggcagagtggaccccagctcccgagcccgtctccattcccgaggccagctcgggcccctcgcagctgcctcacaccgcctacagggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcttacgtgcgccaagtacggcgtatggagcgccatttcgacgagattgagcttcggcacgtgcccagacgggataacacgattgccgacgaactctcacggctcgcttcctcgcgagcccagaccccaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctatccgaggactgcgaagggagtgaacgcgtccagcgcatttccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggaaaagcctttcgtcaaggtttctattggcagatagctctcaatgatgcagtcgacctggtccggcgatgcagagcgtgtcaattccacgccaagcaaatccatcagccggcccaggccctgcagatcataccactttcatggccatttgctgtctgggggctcgatatcttgggaccgtttaggcgggccccgggcgggtttgagtatctgtatgtcgcgatcgacaagttcactaagtggcccgaggcttatccggtcatcaagatcgataagcactccgcacttaaattcattaagggcatcacagcccggtttggagtgcctaaccgtattattacggataacggcacccaattcactagtgaactcttcggtgactactgcgaagacatgggcatcaagctctgcttcgcctcacccgcccaccccagaagcaatggccaagtggggcgcgccaatgcggaaatcctcagaggtcttaaaaccaagaccttcaacatcctcaagaagcacagcgattcgtggatcgaggagttgccagcggtgctctgggcgaaccgaaccacaccaagccgagcaaccggggaaacgcctttcttcctcgtctacggcgcggaagcggttctcccatccgagctcaccctgaggtcccctcgggccaccatgtactgcgaagctgatcaagatcagcttcgcagagatgacctcgactatctggaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccttaagggggatcgggtgtcaggtttcaggctcgggccaaccccgcacccccctcgggcgtgcagggttggccgggggctaccacatatgcatatttttatttctcttatatatgtatttcaataaaagcattttcgatttcctaaaggctgtatctgtgctgttgtttccttttgaagaatcttgacttgaaataggtcactcgtattcaatcctgccctcgggggctcgggtcggctaaaatcgccaaacggggcccagaaccgagccgtgccccggggcgtggtgaactccgggggggaatcggcaaaaacccacaatcgggccacccataaccctcggtcaccacgctcccggcctggccagtctcgacatgtgtatctccccaggcactaaccccgacccgagccatttgaggactaggacctgggcacgagcccttgttcaagccaagacacaaaaggaccgcggcacagacatcctcgtctcatacacacagcaaatagaattgacacaaaaaatttcctctttatttgattgcagattaaattaagtctatacaaaaaggaggcctgaaggcctcggaagaagaaagaagaaactatttaaagatcggcgggggcctgggggctcactccgatgcacccgggtcgccagcctcgtcgccactgtcgcccgctccaccgtcatcgtcctcctcgtcggagttgagggcgaacgcgagccgaggggccgaaccctcgaagctgtggacgatgtggtcggcggcgtcccggacctgcgcgcgcgcgccgtcctcggtcccgggagggaactcatccagcgtcgtccatggggagaagtcagggtctctggcctggtagctcgccagtacgagctccaccgctcctcgggcgaggtccctcgaggaagacttaatcgtcctctcaagctcctcggggagccgttggagagtcccggccatctccgagaggcgctgggcgaggcccccctggttggcggcgtacttcacagtccgcccgccccagaggcctgcctgccggccggcgtgatctagacgggagacggcgtcccgaagcatgccgggccctacctcgcttgccaagcggagggcctcgacctccccggcggacgagtctagcgcgccctgcagatcggcgatggtgtgttcggcagctgcgaggcgggcggctaaatcgctttcgcccgtggccgccccgtcgctgcgcgccctcgtgtccagctcctttgcctgcgcctcgagttcagcggcccgctggttcagtgcggccctctcggcgcggacaccttccagattgcggcgcgcctgctcctcccgcgctgcctcgcggagggacaggctgtccgccagccgttgcgccgcggcttcggcctcttcgagagctcgctcccgctcggtgagcgcgtcctcgcggaggcggagcgcggactcctcttcggcgcaggcggcctcgtgcgtcgccagcgttgcctcccggatggcaacggcggcctcgcgatccgccaggtccctctccacgacgcaggcacgctcttccagcgccatggcacgggcctcgagggcttcttcgcgccgccgggatgccacctcggtctccgccgcccgctgttctcgggcagcggcagcgtcaaggaccccctgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaagtcctgcagaaggggttctgcgctcagtggggcgacggaaggcgtggggaagagccgcctcggagaagatgccgcgcggctcggcccgccgatggatgtgccggactcggggacgtcccccggacccggcttgtcctgagcgtcgcccgagggagtgggcccaagcgatgcccccgcggcctcgtcgcgagctgcctcggaagtcgtcgtcgcctcggcctggtggagtctggcctcctcccgagcagcttcttcagcttggcgagctcggacggccacctaggcagcttcctcggcatcccgaaggcgatccgcggcctcttgccggtcagtttcacgggtcgcctcggaggatgtcgtcgcctcggcctggcggagtccggcctcctcccgagcggcttcctcggtctggcgagcccgggcggcttcccgagcggcctcctcggcttcccgaaggcgatccgcggcttctcgccggtcagattcccgcctccgggcctctgcggtcgccgggtcctcggcctcagactggccggactgggaatggcgggagggacgcgacgggatctcgctgaaacagaagaaagaccagaagacaaacaagatgggtgagtgaaaactcgcgttgagagaatgaatacagccacgatgggcatgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctctgggcgcctgctgctgacacgcgccgccccgccccctcggggaggagatgggggaggggttcctccctgtttcctcttcccccgggcgtcggcggggcggctgccccccgggcccccgtcgcgaggcccagaagcacgaccccctcccggggtagattgttcccccctgcggctcccgcccgcgccatcgtggcctcgaggagcccgctcctccgacgccccgaccgcctgcatgatggtcaggatggaggcgcgatctggatcgctgcagagggggaggactccttggggaatgagggatgcctccacggagctgagattcagcacccgttggaccactatcttgaagtcctcaggagcccagtcccatctgactccctgatgggtcctcatgtagtcttcggacccggtgtactcccaggcgccccgggcgcgccgctggagcggtgcaatccggcgacgaaggtagtcgccgtacaccatggcccctgtgagcccctgggatcgcaggcccgccaggcggtcgaggacggcgtcatagccatctcccagatctaccggcgcccgccagctggaggcctgcgccgggggctggctcggaagtcggaggcgcacttcgtcggcaaggggggtgtagaaccagtcgctcttccagtcatcccacttcttgcggaggacgcaggggatgtagcggttcagcaccggcccccgcggctggaagtagcagccaccaaccaccgacggcggcgacaccgactgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaaaaaagaagaaaatggcggaaccagccctgccattgcaaaagggaggaagaagacggaccgccccgggtagtgtggcgctgggcgtccctcgcccagcgtgactatctcccggccggtggcagattccggcatgaagcggcgcggcagcccggcctgcctctcgctcacgatgcgggaaggcggcagcacgctaccatcgagcagagcggagccccgtgccatgacgccggaggaagagatgtttgagagcgagcgcgtgtggcgaaggtagggcacaggaaacgcggagttagggcacaagcggcgaagacaaggggaataatggcgagaggaaggaagcaaatctcttcctcggtgtctttatacccttgtcaacgctgtgcccggctcctcgcttctcgcgcccactatttcgctccctcgtttctcgcgcccacgcttccactaatcccattcgcccgcttgcggcgcatgaggtggatatgcggaagtggcagtcgagatggaacatatcgtgcgcgcgttaattacgctcgccgaccgaagcgccatcaccatatctccaggcaaaacgaaccggctcgtccggattcgcgtgctactcgagtaatgtggcagccttgaagaggccgctcattattgacagtcgaattaccattgccgatgtgcgtgattggcgaccgttgggtttctgcccaactgtggagaccggtcccacctgtcaccaggccttaggaagtggcgtcacgcccgaccgcttccctcgaggagggcgatcgccctggcataacgccgggggctactgtcggtgacatgggaccgggagtatcatgactagaggcttgggcaggagcaatcacccacgaggcctgaccccctcgggggggtcgggcccgagggtgatgtggctgcccccctctttgtcttcccgaggggtcggaccactcccgtttcggccccgagggctgaggcgccccgaccccttgaaggttttttgcgccgcgtgtatgggttaggtgagcgcagcggggctcacctaaccgcatttattacggtttggacgggcgcgtcacgccgcatgtaacgcagtacagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggaggtggcacgttggacccggtcagatatatgtcaggcttcatcctaaccattacaggcaagatattgtatgaagaagggcgaacatgcagattgttaaactgacacgtggtggacaagaatgaccgatttgtgaccggtctgacactggtcatgtcgccagcagacagccatgttcccacgtcgcgcctgcctccggcggaagtggaggtaggtatgggccgtcccatcagaaggtcattcggacggcaaccatacaaatctccgtccattaatgaagagaagggaagttggagggaaagagaggagaagtccccacacaaaatagagagatggtgcatgtggtatccccttgagttataaaaggaggaccttgcccacttagagggggggggacggatcctgaacgatagaggctggattcggatcccagaacgatcaggggctagctcgcactttgtagcttcttcgtacacagatccaccaaaacacaggagtagggtattacgcttctcagcggcccgaacctgtatacatcgcccgtgtcttgtgtgtttccattctcgcgaaccttccacagaccgagagcttagaacctcacccagggtccccggccgaatcggcaaagggggacctgcgcggtctcccggtgaggagccccacgctccgtcaactataaatttggataattagtatatctacattcaaagtattagaatatgtcccatctaatcaaaactatttatctttcaggacggggagtgtggcagttaagagaaaaaaaacaatacgtgtatatctttttattggcttccaatggctacctggtcgggatgcgtacaagaagacagaaatatgccagacatgttgccaactgaaaaaagtctgcctggtctgcctgctagatcttgaaaatttgtgagaactgagactgttccttctgcaatggggtttaattgttcctgcacatggtttgggcatgattatcatctctttttttaatcatttgctgtactgaaatttggtttgggatttataacatgtgaacaacaatctctttgccactataggatctaacattcatatgttagcagcccaacgatagatcgacactattaatttttatgtccttaatctcaacaagattgtgcctttgagtttcaggataaggcgttccaatatttcttccgctacgtacaagtccctttaaagccattcagaaattatttggttctaatatattttttttacatcaaggcttctattctgttttaccaatttctgaattttggccatagaatgtctcagaaactggcagcatgtcaattctgagcaggttgttaatgccttttacttttagcactcaattactgtagcaaaaatatagagtacaaggaagcaatttgtcatccacattaggagctgtgatattcacatctggtctcacttggattaatacatgcagttaagatgccaatgggcttccaagcaaccacatctacacatgtgtcagcagttgggctacatcttgtcaagataagattagtgcttattgatagtatattgaatggtgtttcttcctcttacttgttctgttgttattcgtccagttccatatgtgaactgcaagtttatttggaaacttttccagccattgggttttaaggcagatgacacaaagctaaagtgtgtaggattggattattagctttatgcctgtatattatgtttttattccaggaatgccagtatcctctcttcctaaatccttaaacaaataaatattttagtgccatatttgacttggatcttttactgtaaatctataaattttagcggactctgcatgagacaggggttacactttcgatttcggcgatttcggtaggactgaaatttacgaaatttcgtgattttcggcacatttcggaacaaagtttcttgaaattttgacagattttaacagtttttgaataaactttgactaacttcaacaaaaatttgagaaaacctgaaaaattcggtcgatatattgatttgccagtggggtccgaaatttcgaaccgaaaatgcaatcactggcatcagatgagaggacaacacaggaaagggatgctataattgaagcttgatttataagaaaatagtagtcaatttgatggagttatatctacaaaagattaggcagaaaaggcattcatattttatttccttctcttcgatgaaataactaactgtaccttatttcagtcgtttacgtatgggtggatcaaagcctgccagatcgtgtaaatcaccctggtaaatctggagcaaccaggttgtgctggattagtggatcgagctgcaagaggagaaaaaacttactacttctcatgaccctccaattgtatttggtatagcttggataatgaattcggaagaaggttctgttatctaattcatctttgtccaggcttgttccagtatgcagctagccatgctcctttgagaattgaagatcttgctgcctacattcagtcaaacaatatggagcttgaaactacacgttgaaattaatgaaaggtttgggcgaggaaaatccatcacatcagacaatgcaagaggatacatgggctaatctatctattaacttattaaagaaatagaaaaaagaacatccatgttcgctctcacagcatagaaattctcatattaatcagagaaaaagaaaaacaaagtccatatagaaatacaatttagaaatacctgaaattcagaattaaaaaataaggaatattggaagaggagactagagtccatatagaaatacaattaagaaataatagaaattcggaattaaaaataaggaataatagaagcagagtatagagtccatatagaaatacaattaagtaataatagaaatttggaattaaaaataaggaataatagaagcagagtatagagtccatatagaaatacaattaagtaataatagaaattcggaattaaaaataaggaatattagaagtagagtatagagtacatataaaaatacaattaagaaataatagaaattcggaattataaataaggaatattaaaagtatagtatagaatccatataagaatttaaaactaagtaaaatttgaaataaacataataaaattaaaagtagagtttagagttcatataaaaatacaatttacaaataactaaaattcgaaattaaaaaaatagggagaaaagtataatttactaagttacttttataatttatataaattatttttagactttattaaatttacgatttactttcgtaaatgtatttacttgaagatcttctctacgctttggttatgaatttacttcacatagtttcttacttcaactcggttataatgtaattacttctaatggtatacatagttacttcttttgcatatctaagttacttataatattttaataaattacttttaaattaataaaatatttgaatatatttaacatgatcttgttttgtcacatatttttagtaaagtacaatgatgcaaatagatcttaaaaatgatactccctccgtcccataatataagggattttgagtttttgcttataatgtttgaccactcgtcttattttaaaaatttgtgcaaatataaaaaataaaaaattgtgcttaaaatactttagataataaagtaagtaaaaaaataaataataattcctaaattttttgaataagacgaatggtcaaacagtgcaagcaaaaacgtaaaatctcttatattatgggacggagggagtatgtgatttaaaaaatataaatcattaaagatgttaagaaaagacatgcaccatagcctaaaggggaatttgtatatttgatagagtggtctccggttaggactaacgtactaccgtgcactacatagttacatctaataaaataatatgttttatgttcaatagctaactatcatatatttttatgatgttttatagcatattcgcgttctttctgagttcgaagttaatggcatccaaaactaaagaaaggtcatcgatgattttcgacaatagaaaaaaaaagcgcaagaaacggaattaatcaaaggcctgagcagatttgatcaacggataggcaagatatagatagatactcctatcaatcagagatctgcggctgtgcgcccgtggacccagctcacatgcctctctcgtgcctgagccgacgagccgcttagccgagccgaagcgccaacctagctcatccctacgagccgagtcgagccaagcctaacataaaaaaggattaagggagtgttcgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagagacaatctctcctatctccacctaacgaacactccctaatactagtggcactaaagttctcggctccgtaccaggtgggccccatgcgaggcgacacgcgtccgttccagctgtcggtcccagccacccacgcatcccccgcacccccactccctccccaccgacacgtgggccactacgtggttcggtcccaccctgtcagtgacacgggtacatagcaccccggtgcgtctggttttcgcgccgggggggggggggacgggtttattgtttggggctcaagtccatgaggcgccctggtcacaagtccgcagccttttctcacgcgtcacgtgtttacccctgcctcactgacagatcggcccgggtgatggcgggacccagtcgtcagtgggtgcgaggtgggttttgtgtggggtgtgcgatccccgcgcgcgtgctccttcccgcgccggttttgatgtttcgcgggtctccgttcgaaacagcgccggattttgctcagctaaatatgccgtcatgtattttcttctatctaccttttcccttttggccttttcttttgggactgacgatgggttgaccatagcataaatgcatcatcattttattcattttagtatgaaaaacatataagtggtgtttttgatattggtggtgtttggataggttaagatgaaaatgaagtcaatactcataaaatgaaaaaaaaatcattaaggctgtgtttagttccacgccaaaattaaaagtttgaaaaaattgatacgatgtgacgaaaaagttgaaagtttaaagaaaaaaaagttaaaatctaaacaggacctaagtaggagtaattgagtgttaattattataaatttgagaaatacatttatttggtacttaaaacaacttttataaagaaagtttttgcaggaaacatatcgtttagcagtttgaaaagtgtgctaacaaaatttgaggtaaaacctatcttaggctgtgtttagatccaggggtaaaaagttttaacatgtcacatcggatatacggacacacatttgaagtattaaacatagactaataacagaataaattacagattccgtgtgtaaactgcaagacgaatttattaagcctaattaatccgtcattagcaaatgtttattatagcaccacattgtcagatcatagagcaattaggcttaaaagattcgtcttgcaatttatacgtaatctgtgtaattagttttttttgcatatatttaatactttatgcagcatccaaacattcgatgtgacagagtaacaaattttgccggaagatctaaacatgccctaggctgtgttgttgtgttcttaggtgaggattggaaaacacataagagagttggtatttggaacacaaaaatagcaaataattcctttcttattcctgtattttatctttcttacttcgtttcaaacaagtctctagactttaaattttgttgtaaaacaaaccaactttatattcttgtctaacatcggtttagaaattttatttcttcgaaacccttatctacccatctaccaatacaacttttgtattaattaaagatattttgtttatttgtgttccttcttaagtcctttattaggatgccaagatttaattttttttaatagagtaggtttcgtatgaaatatgattaagctagttttgattgttttgaatacctggactctctcactatatttaacttcatgaccactccgcttactaagaatgcttacttaaagggacaattgctaatttagcctcgttttgaagcctaattatcaatctgatcttacttttacaagtttactcatttgaccttattttttaaaattgaagttgtcatctgaccctgttttctctacaccgttagggttccatttcatcttggggtgtgtttagttcacgctaaaattgaaagtttagttgaaattgaaatgatgtgatggaaaagttggaagtttatgtgtgtaggaaagttttgatgtgatggaaaatttgaaagtttgaagaaaaagtttgaaactaaaacaaggccttggttaaaatgaccaaaatacccaggagtacacctcaacaccatctccttgactccttcccattctctgtctgccccattcgctcgtgaaccacgtctcgcctccccatccgcgcacagaggcagagagggtggtggcggcgtgtggaggaaacggcagctgcggcgcacgggagcctcgacgtgcgccgcgcggagggtgcggcggcggcgacgcgtggagggagtggcgacggcggcggcgactgcgcgcggagaaagcagcgggcgtcggcgccacgggagctccggcggcacgcgggaacctcgagatgcggcgcgcggtggtggtggcgcacggatgaagctgtggcgacggcgcgcgaagaaagctgtggcgccaacccagtcctccgccccaggcgcttctccttcctggtcctcagccgtgcagctccactcgtctcagcctactccgtgccatcatcttcgtcacgatgccaacaatagaccagctcatggagttgtgcacaaattatgctgttgcacatggatttgtgctttgggatgtctttgttagacatgaattaacttatgttctttatcttttgacaaatattggtcaaatttaacaaaaatatgacaaatctaggtcaaatctttcttgatactccctccatctacttttgatagtcatatttccaaatctgaaaaatttatttttgatagatatatttcaatccaacaacctactttctctgtttcacaatgtaagtcattctaacatttcccacattcatattgatgctaataaatctagacat

SEQ ID NO: 22921 - DNA, 14932 bp, Oryza sativa
  unsure (1)..(14932): unsure at all n locations
caatatgaatgtgggaaatgttagaatgacttacattgtgaaacggagggagtatcatcttaataactttctcggatttaatgcgtgattctctattctttcacacaagattatctatatgggcatcgagaaatgtaaatattaatgaatcgcttgtttacgaggaatgactagtagcatatttaaatagatgataagtagaatatgactattaaaagtagatggagggagtatttcacaaatctttctcgatatgtccaatatacaaaaccagctcaaactaactaaaagctttgataaaataggatcaaatgagcaagggtaaacaaggcattttgtgctatatatagttaacaccgttacctcaccttaacataatagggtcaggctatatcttcgatttttgaaaagaatggttaaataagcaaagttagtaatagagggttaaattggtagttagccttcaaaatagggtcagatgcacaattaccccttacttaaatcgtcaagtttttgtttaaaaaagagttcatttgtaacttgttaggtaccctcgaaagttttatctcttgactactattgtgacatcctagcccaattaagataatgcatgtgtggcatatgtgagctatgtgcacatatttagtactccctccgttttaggttttaagaagttttgactttagacaataaaatcaaattgcttcaactttgaccaagtttatagacaaatatagtaataattacattatcaaattagttttattaaattaataattaaatatatttttataataaatttatcttgggtaaaaaatattactatttttttctataaacttggtcaaacttaaaacagcttgactttgactaaagtcaaagcatcttataacctgaaacagagggagtaccgtcttgctagtttagcatcagtggaaccaacttataagacctattccaaccatatcactctagggttaacccttttacacgaagcaaggacgaaagtgtaagtgggcccgcttgtcagatgggctggctacgcggttctggagggagggttgttacaaatggtatcagagccgaccctcgtgcttgcacgaagcgaggacggaattgtaagtgggcggagtggtatgtgtaagtgggcccacctgcaagatgggttggctatatatgtgcagccgtggatattcgtgtccaacgtttgaccgtccgtcttatttgaacaatgtttgtccaaaatttacatatatctcatctgcttttataaactataacacatatatgtaaattttgtaaacaatgttacttaacactttgtcggatgaagaaatgacaaacataaaagttatagatcttggtgagttatacaacttcattgttgatgactttttttagttgaaatcatttagtatttgaaaatgttgtttgaagttgtcatattttcaaattcaaattcaaactgctcaaaaaaaagttatttaaaaaaatgaccaaaataaaagttataaatcttggtgagttatacaactttgttgttgatgacttttttagtccaatcttcgtaagttatacaactttgttgttgataattttttccatttgaaatcatttagtatttaaaaatgttgtttgaagttgtcatatttttaaatttaaattcaatctattttaaaaaaggtatatagaaaaatgaccaaaataaaagttgtaaatctttataagttatacaactttgttattgagaatttttccatttgaaattatttactacccgaaaaattattttgaataataaaataaagtattatagtgtagtaaattattttgctacaggtcaactcacaaatataaatatttcatatgacaaatggaaaaaaaatactaagtcatctcaatcgagcattagtatagagtccatcacggatgagtcatccctgacgggcctatttgttaccgattgagatatggtcacacaggcctgagttttatgcacatctaacatgtctatgcgaccatatctcaatcgggcaattttttggcccgttacagatcactcatccgtgacgaccaactaatcacagatatgatagagaccgtcatagatggaaggttatgtactagtggtattatctgtactattattatcgatctgtggagaaaatcatcaaattacgcacaaccccatagttgatagatgcataccttagcaaatgaatcaaatttcacatagtgtggatcttcaaatttcacatggccagttttattcgtaagcatatagaggaaagttcaggcatgcattgtaggacatttaacatctcgatcactgtttatttttgcattggaagagtagtgtctagtattagtttcttaatgatgtgaattttatggaaactatgtctagtgttccccttttttttgggngggggggnttttngngnannanaatgnnaccgcnttgtantnttntnanaacccccccgaaatattttnttttnaaaattnaannnaatttnaaaatttgggggggnnggaannaaaaaggggtttttgggaaaaaangcgannanaccgccnnacatttctggaagggtataactctatatgaactaaatttgctgagcttgaaattagacatggtgaaatgcacttgtattaattgcattttgcatataatgtagaaggaaaaaagtagcgaattcggatttactctgatctgtaggtcttggctgcaaacattgcaactaaaattttttaattcacttcatctgcatcaaaaaggttttgctggaaacttatcactgagaattgagactgtcactgctggagaaattataaagttacatagcctcttctcctcgctggcgcaaaagaagccaaggacgctcgtccatgctgtttccgtcaagttcggtatgcaattccttggccccactctcctctcccatttccaatgtctcacgttggatacatcgcctccgctcttgcccccgaaccacataggctgtctttcctgccaccgatcctacacaacgccctcttcattcatacagctctaatggtgctccgaccctacacaacatcctcttcatccatatggctctaatccatctacatctatatctacatcagtgacttgatgaatagaaatagaaagaaaaaagaattttttatcggaattgctaaatgtcattcaacagaaatttaggtatgaaatcttatagattttggacagttggatccacgccaagattcgcgcgtcaacttcttctcctctaattccggtaggcttcccttcttctccggcgccaacgacaccccaaactttggcaaggagcatacgggttagtgtttgggattgcggttatgataggaggggggttggaggagggaggaggggggggggttcctcaggacttagagggatggttgtgggcggttggtggtggacaagagcgggttgcgaggcgccgtcagagccaaagtcacgggattggcagcaggtggagggccggctttggcggcgggagaaaacaacgagactggttaggaggcggcggccagtgatatccgacggtggggagccgctggagacgaggaagatggtggggcaggggcactcagcaccacaaccttgggggaggcctcgccagggccattaacccggcagggtagcagcgactatgcaggaggtggagcactgctcgtcgcgtgcgtgagcgtgaagcggcagcggttggcggactaagaagggaaggaggaaaagtagggtttaggtatgttgcacaaatctcaaaatatcaaatggtcctgaatttggaatatttggggagttttttctttgtcaaaatccacctagaaagtccttttttatagttagactgacattcactttgatgaagtttataggagctagtatgtcatcgatgataatgatttgagaaaagtttagttgctttggacaaggccaatgtttgtgccaccatgagcaataggagtggggtacactggaaagagccacaactatgtccaaatgtacaatgcttatgactggtaagaaaataaagtgggcctcgctgggttccaccaaaagaaagaaaatggcaaaaggtcccgcatggcagccaaatgactacaaataaacaatttaatgcaattttgtattttattagtatgaatagcaaccctatattttattgtcttgtgaccacaccttaagcttaggccaggtgcatcttagcttggtgatacttatggtgtatctccacaatggcaaatgtgcaaaacttagtagcattaaatacttaatgtgaccttttttcaacattgtggatgcccttggagcaggtacaatagcagactataagtaaactataaacacatatcgagaagataaaagaagagagagaaaagcagcgggctataaatttatagccagctgcaacacgaacttcaagatacaatgtgtgtatgatagctggggtctgttggtatttcttaacgacattactagaaatataattcccagcaatgatgcagaaatacttctggtacattattgttacagagttcatctgcaagcgcacggatataccattgtagcattttacccgagagtattccaagggtatcatatttgtttaatcccgtgagaagattataatagagagaactatagtaataatttatatattacttataataatccaaagtctaagcaggggttaatataattcagagagtagagtgacactaagcagaagcattcatactcttatttataattacctaagctaagtggaaagaatatagaaagatcatattcctatacttctattacgcaaacatattatgcatacatcctagttatatcattacttagctaatgccctctttccgatgtcctcttggtgtttcgagaagccacccctgattgcagagtttcttacgacaatccattatgaccattcaaccagggctaaatacagaggagtaccctccccaggaaattaacttaggactatatacacgcgcggaggaaaaccggtactgagctgtcaccatcagcggcccacctcgcttccacaacatataaccccaaataataatatccagtaatataaacaccacgcttaaattaccaaatactactctaatatcgtcgtcatgacatagagtcatcatatacacgatgattatacgcacaccattgcatctcctagataagctagcatcataacaaatatgacttggatatataataaagttggtattcatatactcggaaagtaatacaataccaaagtggtataaggaagaatattctaaataaagtacaagtcttacaaaagaaggaaaagctattagagccgtactcgaattattccgaagactccgaggactgaagattatattctatttctattccactatactctagagactatactaaacttatactaaacttgagagatgaaatgaacttcttgcttgaggtgtgtcttgaaatggagagactgagggggtttatataggctggtaatgacggttggaaaggtcggtaatatccaccaactgtcattgaagatcaatcccagccgtctagccaaaccctgcaaccatcggcgctgcggctggttcggccgaaccctgggctggcccaaccggcccagttcctagcaggcggcctcctctcctgttgctcacttcggacttgtgaattttggtccaattgatcgtgtcatttctgagttcttggtccatccttccataagtctgattcttgacatcgtccgattgattgaccatctatttttatgtcgattctcctctattttatgtttattctttgcaagagattagtaatcctagtgctagtggaatatatattatttaaatacaaatatgcattgcgagcataactagttcttattttagtaatattgacgggcgaaactgatcgctaacgaccgtcaacagggccatgtattagtagtgtattatatgactatatatgatttgaatagtagttagctatactattaaacttgcttttaggagtcttcatcgtctcactcaattggcatctcctcttaggcctagttctttccaaaaacgttatatcgaatctttggatatatacacggaacattaaatatagataaaaataaaaactaattacacggtttgcatgaaaatcgcttgacgaatcttttgagcctaattagtccatgattagctataagtgctacattaacccacatatgctaatgacagcttaattatgctcaaaagattcgtcttatggtttccaagcgagttatgaaattagttttttttatttatgtctaaaaatcccttcggacatccggtcaaacatctgatgtgacacccaaaaattttcttttcgcgaaataaacgcatctttactaaaccatggaccttatccatctacaatttcacatcatatttatttaatgaccgatgaacagaaatagaaaaagaaagtatttttttaagactaacattcgatatttagaaaattataatggcatggttataatttttttttatggttagccctgtttagatgggactaaaacttctaagtccatatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggacttaagttaagtccctggatgtaaaaaccacctaacattcactccgcacctaccgaacacaccggaaagatccaaacccaaaataaacaacgaaactcgcacaaaaaagggaaaaagaatgcgccaccgtggcccaccgccgtgacctcgccgccggcgaggcctcccctgcccatggactccgccggcgtcatcctctccatcctcagcaagctgcagtctctcggcttctgcgcccatctccggatcggcgacgccgcggcctccggccccccctcggacctgttcgacaccgtcctcgccgcgttcctccgcgaggtctacccgggcggccgcgaggtgcgccctctcccggcgaagctcggcgacgggagccgcgtcgacctgctccgcctcttctccgccatccgcgccgccggcggctacgccgcgacgtcgtcgtcccccgccgtctgggcctccgccgccgagtccgtttgcctcgacgccaccctcgccgcgcccgtcaagctaatctaccacaagtacctcgccgccctggaccgctggatccagaggctcgtggaggcgcatggacccttcctggatggcaacgacgggaggaagaagccagagccattcttcgattccaatggaagggagaatgaagaaccactcttggaatgcaatgggggagatctgcagcatccaatcttgaagaggaagagggaggacatggttgggatgttggattgggtcagggagcttgccgagaatggcggtgaggcaggcaccatggctgccggctcggcgaatgggtactactcgttggcgttggcagcgaggaaggcggtgttcgcgaagagggctcgccgctcgagcatgacgatgaatggtgcactcatgcaggttattccaataccttcagtagcactttatcgaaatgtttggcatcattcatgttgtttaatcgtattttgatgtactaactgaattgaggttagcttaactatgatgattcaccgattgtattaaggccttgtttagttggggaaaatttttgggtttggttgtcacatcggatatacggacgcacatatgaagtatgaaacgtagtctaataacaaaacaaattacagattctgccaggaaactgcgagacgaatttattaagcctaattaatccatcattagcaaatgtttactgtagcaccacattgtcaaatcatggcacaattgagcttaaaagattcgtctcgcaatttatacgcaatttgtgtaatttttttttgtctacatttaatactccatgcatgtgtctaaacattcgatgtgacaacgtgaatttttttgttttgggaattaaacagggcctaaatctttttgctcaaatccaattgataatgcttgttgagaatagaccaacttattgacgcatctttgtgatatttggcattttagtgtaatttggagagtacatttgtatttcttagagattacactgatatgattgtttggaagatagtataatgccaacagaaagcctaggcgaaaacattatttccgtcaattcctcccttctgagccatagttagatactcgacataagttgctacctgagtcgggagttggctataattgttgatacatgctaaaatgatcattctaatcgtacctccaatacttgattatttgatatctatttatatgttctatagtaatcttgataagaagatgcataccttttcgctctttgataacttgataccttcacaataataaaatttagaggagtttaaaggttttctttgggttctgattgattcataaattcaattgagtttgtgagaatggttaagtgtctgaatttcaaaggatatgcattgcataaaaaacaaataaatccaagttttttttacatcaaaacgagttgtggaaaacagcaataagcagcactccaaattctattttggaagctttttatgatgggaaaactatcaatgatacttttaaagcttttttagttataatgaaatgaaattgtggaaactcccatagataggcaacttataattcacatgctatatctttcttaggtattcaatcttagctaagcttttcttgaatttctctgcttcttatctttctctggcattcatcactgtggaatttacagaacagtacagaattcagcttgaaccatgtttcgcacaggcaacagcaatactctgggtcgatctgcaatattattaaagataactttgaggaataataatagcattcggctgctatacggaaagttcttttttatgactaactcatactaactaattctctctcctaggcagatggattatatttttgactccacctaagactgatcatatgattccttgtttttgttccagcttctagggtttcctcttgtataatctcatttatatactgtaatcaatgtattcatttatgatcttttagcttaggaattgaggcctatgggggtctcatataattattgctttgaatatttgtgttggtggctgtaatgatttgttcaaacaaaactgtttttgctacaactcactgacacatcgtaatgctgttacaaataatttggggcctatccttttataattttcatggcactgaaacatactctttccttacatcctgctattactagacttctatttctgcaaaaatggtgcagactgcagcgtaatccacagactctgacccctccactaccaactttggttcactattcaatttggggatactgttcagtttagcaacagtacttaggaaccatatttatttttgtagattactgatccaaatgccatcatggatacaaattacagattatatcagattaatgataattatatcctctgaatgttttggtttatggcaaaaccaactcctactgcatagcaaatccttctgcacactctgatttcccaaaagctttgtttgaatcatcatcttggatgatcaagaacttcgatatctactgacaaagaagtataaaggctcttaaatttagtctacattgaccatcatacctaaaactcctagtttatgcataaatccttctgcatcctacaatttccttaaatcttcaaatagaattagattttaattagaatggaaccacaaatttagtttttgtttggtttccaaaggaactacagtatataaatcgatttgtaagccaattctaagggtcaatttgtgtttgctgatttactgtgctgcgctgttgttcttttgtttttagcatggaaatgcagatgtaaaaaatattgtagtttactttgtaaatcaaattaagtttagttaaattttgttatcaaactattaatttctcgaactcattcagtttttggttgccaaaggaaatgcaaaatccgaaatcaccatgacgttgtgattttcgtgcatgatattgtcctagcacctaatataccccttttttgttttctgtcgtttgcaggaaatatttccaatggattgcaagtgctgcatgagttccagcactactggaattgacacacaagaaaaatgcagtaaaaagattcaacttgtcattccacaggctggttcagatattaatgaattgataaatgttgtagaaaacataaatgtgccttcaattggaatggagcaagagaacaacattattggacaagcgaaatatgagagtaggaaacatcataactctgacaactggctttttacgagtcagcagaggaacaaaataccagtgggctctgagttccaagcacaagtaccacaatggactggtgagttgcctgtaagctatgataatgcagaaaccaggaaatggttgggcacaaaggtctggcctctggaaaatggtaacaggaaattatcatatttttgtaaccctgttggaaaaggtagagaaggtgtttgtggctgcaaccttccaggatctgtagaatgtgttaggtttcatgttgcagaaaggaaacttcagctgcgacgtgaacttgattcagctttctatgcatggggatttgatcgtatgggagagaaaatcgcactttcctggacagattaaaagggagcaaatttcaaggctttgcgtgcagcttaatgcccctttttcaggaaggaatttctggaagcgtctccatatgctttttcagtcaaagggtaggaaagaacttgtgagctactattttaattgttttctacttagacggaggtgttatcagaataggatgactccaaataacatagatagtgatgatgaggatgagacagaatttggattcttgggtaaccgccttggtcataatgcaactaagtatgacagttcaagtataccctttgcatcgaaagtacacactgcatggatctcaaccaatagtttctgatcagcattaatgaagatgattgaagtttagtagttcacttctcttgctgttgagtgtcttggataaggtttaaataggcggattggagttttggtgtttaacttctctcattgccaatggtttctgcgcgatataaagaagcttactgaaatttggcaattaatttcttccattgccaatggtttctgatcagatatagagaagccgattgagtttgataatacacttctctctttgcgaaaagtttctgatcagatgaatgctttcatccactgatttcttatgcagacggaaatgtaaatgcttaagtgcaagccaatcatttgaacaagttgcttaccgctgcggaagatttgaccgaagcttgcgattgaagttgggaggcaagttttgatagagtgtagtggcactgatatgtgaacaatcacatggattcattatatccacaaggtgaaaaagagaacagcggtagcatttttaccgatgcttccttgaaggtatcacatgtaccattttctagttttatcctttgtgtaaagtagttttgcatacattgcacagtagtatgattaactgttccttgctctaggctcccttttcgtagtatttatctagactaagggctcctttggatgcacggggagaaaacccctgggaaataatcccccaaggggatcttccctgtgacatatgaactccctccatttcctagggaagttgctcccgtgagggaaaagtcccctacgttcatttggaagactcccacgaggggaaattccacgctccattcctttgaaaatgctagctgctagggtttaaaatgcgtagcatgataaaatataaaactcacgataactaacgagcaggagaagataatcagggtgacaaaataaattcaaaaatttcatagaaaatttggaatatccacagaaaattccaaaaattcagacattcatatggaaaatgcatagcaaatttggtaaaaatccaaaaaattcacaaataatttgaaaaattcaacattcagctaatacaaaatatgaaaaattacaaaaattgaaccttggatgattggaatattttacataggcttacattaaaatgacagataaagcaagctaaaacattagtgtgatgtcttttcaacaactaatgtgcaatcattaacagttggcacacaaatagacacacatgtaagcaaaggttaagtggaaaagatataatccttggaattttcaaataatcatctcggtgcaactggtcttaatctttactcttgtcacttgttgatccccaaaactgcaatttcacaatagataatatgtcaatttttttctcaattaatggttgcaaatcaaaacacaagaaacaacaagggacaaatttcgcgaatcatcgctgaagtgctaatgtattgcatccacaattatgcttctaggattctatacaagaattatgtatccagaattttgagggctattttcatgtactagactaatgtactttctacatgcatactgtattatgttaccagaattctacagtgctactaaggtaagtttttcatgctatgctgcatacaaagtcaaaattcctgaatcatttcccattgcatacaaccagataaataaccaccaaacaattgcaaacggagtttttaatggacacttaacaacattggagataagaagatcattaaaaactgatagtgattcagaattatgtattgcttccagaattctacaccagaattatgcattcataatttagagagctattttgatattttcatgtattccaaaattctatacagtactagtcaagtaagtttttcatgctatgttgcatacaagtaaaacattctgcatcctagggaacttgacatagaaaattctgcatcatagggaacctgacaacaataatatctcaaattctcaatcaaccagaacttaacatgatatttcccattgcaagtatagcagggaccaatacgaaaaatagttcatcatcctctagtaaaaactttctaatttgctcgtttgcagagcccatcacttttctgttagaaaatcagactaaaattacaacaaaaaaataaaacaactgattggtaaaaaaaaagagagcaagattcatcatggcaaacacaaaaggggcaagaaagaattatgcaagacagcataagcaggtctgccactaaaattgacagagcaatactgtacgtaaaaacatctcaatacagccactaattcttcctgcaataagagcaggatgaacaccaaaacaggtttaattgcaacaatttctttgatgtgctatggttcactgtctcatattcagaacacaatttcaattcagccatgttatatactacaattcagtgattgactagcacagacaacagttaaatcagctaaaatacttcaatgaacagcctactaaaaaatcttatctgtacaatgtactttgcaaacaaaaatcatcatgccatatactgtgcaaacaatgaataataacattattagggatacacatgcagatgcagtgcaacacgtacttgtccactactatattagtactcatcatgtctgcatatagctataatagtacccatgagtgctgtgcacaatacactgtagatatgaaatcaactgaatcctgaatttctgatcatctctgatggcatatgcaaaacttatagctaagctgccattaattaattagacatactgttatgtggatcgatctttcggcgtatcgatgaaatgaacaagtcagtgctagctgtatataagctagtaattatatacagcaagacaaatctctgtgatactaaacagcaaaacaaatctagcaagaaggagatagatagtcataatcatctcttgcagtgcgttctcacaatccacagaccagaaactccattgaaccctagcacctgcgtgtacccatccctccacggattcaacgctcaagaacaacataaatctaccgggacaacacagaaccaagcttacagcggggaagaaactaacagagcaagaattctttgcgcgcgtggagaaacaaaccaaatcaagaaacaaaccaaattctttgctaccttggatctgcgcctcaacgcctcctccgccggtgcgtcgcgccaccttggatctccccccggtcctccgccggtgctgtgcgcccgtgctgccgaggcgccgctgcgtcaccgccgcgtttctgtgcctgcgatgcgagagatgagaccgaacggaggcgaaaaccctagaggaggagaacgggaaccctaggaggatgagaggaggggaaagaggagaagggcttatccttctcgccggaggaagagtcccggtggtggcgcgtctcaccggaggaggaggcacggcggcgcccgctcttggtcgctgcttttgcgcgagagagcggcggatcgggagaggaaaatttcctgacctcgagaggtcgggttcctttccctggggtttccccgcggattgggccgggaaatccctgcctcgtgggtttccaaatggaccagaaataaggaataagttcaccggaggtccctcaacttaacagcgatattttttgaggtcccttaaccacaaacccagaaatgtgtacccctaaactcacttaaaccgtttaccggaggt

SEQ ID NO: 22922 - DNA, 2775 bp, Oryza sativa
aaattttttgaataagacgagcggtcaaacatatgctaaaaagtcaacggtgtcaaataaaacgaaacggagagagtatatacgtctgcatgttatcgggcggaaaaccaacaagaagctagctaggctatagctggtcgtctccatgcatgcatatatatgctcgtacgaagacgcatgtacatgcggccgtctgtacccggcgtatatgcgtatgagctacgacgtcaagtgctaccgcgacgtcgtcgaagacgacgagggtcaccgcgcccgcgccgaccaccgtccacgacgccgatggcacaccgagcgtggacacgctcctgctgcagctgcgcgagctgggcgtccgggaggactatgggatcaggccggcgacgctgccgccgccaccactgccgctgtcgcggcacaggaggagcgcgagcgactggggtgcatcgtcagccggcacttcgagccacctatgcacggccactgcgacgcctggccgatgccgccgaacggccgcgccgtgtagcctcgcccacggcgacgacgacggtggagagccgatgatgacggcggccacggcgcgcggttgctccgcccgtagcctccgctccgccgccgcgctctaccgccgggatcacccgccgtccgctccgcccacagcctgccaccgctctgctgccgcactcgccggccgcccgcatccgcgctcggccatcgcggctgcgcccgccgccagcctgaaggagaagagagaggagagaagagaaaaaagaagagaaggagaagaaaagagaagaaaaaatatgtgaagctgacatgtgggccccacgtacttttttaattttttttgctgactaggatgccacgtcagcaaaaccgggcaaaaatactgccgaggtacctccagtgaacggtttgagtaagtttaggggtagacatttctagttttgtgattaagggacctcaaaaaatctcgctgttaagttaagggaccttcggtgaacttattcccagaaataataccagtggcaatttcccccgcgggcctttctcccagggattgggccgggatcccggtggtttcctgggctgctaaaggagccctaagggttagatccttaaaaagctatgagcatgtatgtagaggttagtcttcggaaactatcacttttttaagataatggaagctttattaagactcagtcaaatacaccaagatgatacattccaactgagcccacccccggcctctgcataaaatgcacacaaccaataaaaggacaaaactaaacccccatcacgaaacatagatattagtgactatcaatccatagactagattgccacccatgctcctgggtaaaaacatcccgtgccacctggtccaaatgtcgagatatcaccgcaatagtatcccgtaatcccggtttgtggaggatagcccaggtacgtaaccaccgggttactagagtaataacctgtagaggagaagaccctaacttgttatcaaaaataaccccgtttctggttagccaaatggaccaacaaataggtggtgcacccatcaaaaacagatttttcatttttttaggaacacatgaaagccaacgcccaaacatatgagtaacatttcgaggaggttgaaagttagaggccatatgaataacggaccatacccaacgagatagatgacattggaagaacaaataacgagatagatgacattgaagaccaaatgttgaatggtttcatccttatgacaaaagcaacattttttactacctttccaatttcgcttagctaggttatcttggttagaattactccccgacgtaagtaccaaaggaaaacttttacttttaacggtacattaatcttccaaatacgtctattaatattcgggacgcccatatgaacaagagctatgtaatgtgaattgatcgagaagacccattgggggtgagattccagcgaaattcatcttgctcttgtgtcaacaccaaagtaaggtttaaaagccattttttatgccagccgcttattttgcttccattaaaatttcttctcctaaaaggcttgaaggtttgtttgaagaattgtaatttgcgtttgtttatgcctaactataacagttatagagacaaggatattgatctctcaacgaggcattacccaaccacttatcttcccaaaaccttatttgagagccatccctaatacgaaaagacccaaaccgaaaaaaatcttgtttggccttcataagactatcccaaaaatgtgagtcgcctgctttccaataagcctgagataaaggttgtgatcccaaatatttgttacgtatcaactgttgccacattccgtttgtggtaagcaacttgaatagccacttgctaagtaacgctatattctttacctcgaggtcatgaattcccagcctcccttgatctttgggacgacagatgatgtcccacttagcaagctggtattttttcttatggccatccccttgccaatagaacctagatcgaaggtaatcaagttttttaagtaccccactaggtattgcaaggaacgacatcatatacattgggagactactaagtactgagttaatcagtgttagtcgccctcccaacgaaagaagttttcctttccagctacttaatttcttttcaaatctttcgaccacttctttccattccgcatttcttaacttcctacaatggatcggaatgccaagatatcgaaaaggaaaattaccaacctggcaaccgaaga

SEQ ID NO: 22923 - DNA, 1342 bp, Oryza sativa
tcactaaattgtcagctaccgagctaattggtttgtggcgaccttagtgaatattttataactgacatttaacaagcatattggtctatattgttggattcgatttgcttcttcaactttcggaataagagtaatccccccaaagtttagaccaaaaattggaaggctgccagagtggaatcctttaaataatctcagtagctcatgcttaatgacttcccaaaatttttggtaaaattcaactgggaaaccatgtggtccaggagctttattatgatccattgcaaagatcgcttcctttatttctttctcagaaaaggagcagtaagaaagtcattttctgcttgtgtggcctgagccatatcctcagttatgtgctcatcaagtgaaaatgagttttccgctggcggtccaaagaatttcttgtaaaaatttgtaatgtatgttttcaacgcctcaaccccctcaatttttccttcatcctgatctaggaagaagatccatcttcctatgtttgccattggcaatcaagttaaaatattttgtattattgtctccaaggagaacgtctgagacttttgagcgttggtaccatctaatctcctctgcacaaagtagtcttgcaagattatccctcgattgatcaagaagatttctttcttgatccgaaaggagtcacacctctgcagcgatatctagttcgtcaacggtccgttgtagatgagcttttttctatttaaagataccattggtatgagcagaccaacctctcagatgtcggcgtaaagcgctcatttttttattccatcgttggactgcattacgacccttgattggtttattccaaatttcgacaacacgatcatggaaatcgtcgcgcagaaaccagctaagttccatcttgaactgcttaaggtttccggcaaaggccgcttcccctgtatcaaggaacaaaggcgtgtgatctgacacccctctatctagtgcatgaaccgattccatagggtatttggattcccattccgtggaagtaagaaccctatctagcttctcatacgtcggtataaggagcgagtttgcccaagtatattgcctgcctgttagagcgatctctcttaagtcaaagctatcaatcacaacattgaagagaaaaggccagcgagcgttgtatcggtcattgtttatttccgcactacttctcaaaatgttgaaatcccccctattagagtggggagatgattatgctggcacgtgcgaactaactctgccaacaaactagatttaaaatcatcttgggccggtccatacactcccatcaaaatccatttaaagttatcctccc

SEQ ID NO: 22924 - DNA, 1351 bp, Oryza sativa
ggcccaccagtcatagacaacccaggtcacaccggccttgctccatcctagtcctaatcggagccactactttaggtcttagaggcatatacaacctaaaagactagtctgatatgtaagaactatcctcgccttttaagtcgtgctcccccataatcaattacctatgtaggactaaacccaacaatctcccccattacaaatcggactaaacaatctccctcatcacatcaacccatctgaccccgaagacttgttaccgggctcctccaccatgtgacccatggaaattgttccagctttccaaacctaggctataataccacttgttagagtgtgcagcctaacccaccaaccatggttcacctaggtcacattgggcatgctccaccatatgcccaagcgaacatttcatttttcgtgtcgaagaattttaatactgactttggggtagcaagcacctccaacattagatggaactgcatttacttatctgaacctagattgggtactcattaagataaaaaaggcacagccgactattatctggaaatggttgatattaacactaatgaatcagaactgcaagcttcattgctcccatctataacgtggtacgacccaacaaataagtatttttgtttgggaatagatttgtgtgaatggaaagtgtgtgaaacattttgtgtgaacagtacatgtgcataacatttttgtgtgaattgaattgtgcacatattgcttttaaaaattagaattgtggcccaatccttggtccacctctggtcatggcggggtagaacgtgacgttggtgtccggtgaaatgcatggacatgaatggtggggctgcaaactggcaaatctgatatcggtaatgtcaaccatctgtagatgacggtcgttagtgtcttcttgatcttggtgacacaacatgggctcatataagtagacgcggttccaattggatattgaaatgttggacacaaagaatgacgtgtcttcgacatcttccaccttggagcaccatgaattctcacagaggaggtcacacaagtatatcattatttcataccttgtccagctggtcacatgcaaaatggcacccattgaagagatatcgctcgccattcatatccaggtagctatgttggtagatgtgtgcaaatggaagcaccaacagcaatgggctcgccgtgagaggagcaacaccatcactgttactgccactgaagatggagatctctttgagtgagctgatggcgacaaacccaaaaccctaaaccctaaatagtagagtggtaagctcttgcaaatccgattcgttagttgtaatgtcaaccatctccagat

SEQ ID NO: 22925 - DNA, 351 bp, Oryza sativa
taagacgaacggtcaaacatgtgctaaaaagtcaacggtgtcaaataaaacgaaacggagggagtattagccaagcatgtgtatatggctgagcacactcacatgtatatatcccattacatgcagcggaggagcgcggatgcggggggtgcagcggaaggcgagcgcggcggaggagcggcggcgggcgagcgcagcggtgggcaaagcacggagggcgagctaggcgaagcggaagacagtggatgggacgaggagctcccccatgctcggccgccgtcaccgccgtggccccgcgggtggccgacgatgctaggagaggcaccgccggcggcagaaggggaagaggca

SEQ ID NO: 22926 - DNA, 835 bp, Oryza sativa
ttctgtcaagtccgcaacaccataccatgcatccctgcacacgcggtgatttacgtgttcagggggggtgtgcggcacaaccgcatgctcgaaaagatcgcctccaaagagccccagactaccgcggagctttttcagctcgcggaccgagtggctcgtaaggaggaggcatggacctggaacccctccgattccggtgtggcagcttcggccgcccccggatccgctgctcagacagggcggcgtgacaggaggaggaagaagaggtcagcccattccgacgacgagggtcatgtcctcgccgtcgagggcgcttcgcgggccacccgaaaggggaggcctgcgagcgacaaaaagagggaggccagcgctcccagcagggagcgcccaaccggcaagtggtgcaccgtccacaatacctcccttcacgacctcgcggactgccgcgcagtcaaaagtttggatgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggttttcaagagcctggggccaccattgccactgtcgatggaggagcgtgtgctcacgtttctcgccggagcctcaaggccatgaagcgagagcttctggccgcggcccctactcatgaggcgacgcgccgggcgtggtggtcgaaggttgccctcaccttcgaccagaccgaccacccaccgtgtgttgcccggggaggacagattgcaatggtggtttcccccactg

SEQ ID NO: 22927 - DNA, 718 bp, Oryza sativa
cctgcagccctgtgcatggagagaaagagtgatacatatagcttgatctccatgcaatccttgttatttagatccaccatcaatgaacgtttctatctcaactcatatgaagtctaagaatcacctctcacaaattccactttcatattcacacgaggcaaggcaaataaatgctcatatacattagtttcataattggatttatcattaatcaccaaaaccaaattaatggcacttgaactttcatcgggccgtagctgtggcgaagtgttgcactgttgtggggaggcgaggtgaccttgcgccgttgcggctgttgggatacgcgtaggctacaatagcataaatcaaaattttctatcgcgtaaaccaggaaccatgcaagtattagatcatagatcgttaccactcgacgcactgcgcagcggaagaagacgctgagaagtcgaaggaactctcgcgaagtagcgcgcgtcgatgtaaaggaagtagtcgatcgcaccggctcgaccttctcctcctcgtgcgttctcctcgctgtactcctatgccgatcagcaccgcaaaccagcagagcctttactggtatccacacgtacagggacggaacgccacgcacagatgtgctagcacccgcgcgcggctagggttttgctcggggagggaagtgacagctaaggtttctcacgtgatgcaatgcctccgcctgtcacacccc

SEQ ID NO: 22928 - DNA, 24997 bp, Oryza sativa
  unsure (1)..(24997): unsure at all n locations
ggatttacaagcttcagaagtgacacaatgaacagtgaagcacagcaaatggtcctagtgaagtcatcactgaaggtgttgcagaggctgacaagcattgaaggggaaatcggcaaagcactgcggtacaagatatcgaagcatcccttcttgttaagaaacctcgcagatatcttgggagacaacatcagagaccaagaattaaaaaagcttgcagtaggaatcctcagaaacatttccattgatggtaacacaaggcaggagattgggaacatgaaggtgctcataaccagactgatgaaggcattcctcgacttacatagaacctccaacacagatgttgatttcttgctaccaaaggtcgccgggcaagcactagcaatgctagcaatggataatgtgcacaactgcttagttatgttgaaggaaccagagttcattactaaactcaaaaatatgatcctgatccaagatgaaaagtacatatatgtggcgccaagcctgttacgtagtatgtgccagcatgcccaagctaagctcacagaattagacctaaaagaactatctcacaccttacgagaggtgagccctgctacttaatgctacagatgcaatatttgaggtggatagtgtggtatgcttttttgcataaattattttatgttagaggagggaattccacctgcatttttttcaaactgggtcatttattactagtaaaatagagtataatataccgtgttttgctgaattatgttgttaccaatcatgctacattatccactacaggtgttggaaagaataatgaatgctgaaggggcagaactagagattctcattggccttagttcacagatatgcaaagtcaatcctgaagaatttgcccaagagctagatcacggacatattaggcaaagatttgtgaagaggctagtggatgcactgaatgcaaacatgaaaccaagtgctcactgccctgggatccggagggtgatacttgagcaatccatatacatgatggagtgcaattctcactatgccaattgtttcaatgaattccggatgatggacgcactgtcaattgtagaagaaacgccctcaaaggttgagaactacatggttttcttgggtgatgtaggctttatggaatgcggcacacctctctttgctctagtggacagagcaaaagaactgatgggtcgtcaatggttgcaaggaatcaacaactaaaagtaattgtatgagatgatttctcatttacagttacagtgatttagtctattgtgcattgcaatccaaatgccgtaaatttttagttgatgcatgttgtggccatggtaaaagaaataaacagaaaatgatggcattggagtccgaaggccatgcatattactaacatgtggtaaaaagaaaaaagtgaatgtgcacatggcctttctagaaagaacacgatttgcctctgagatgagaaaatactattgtaattgtacctcattagtttctttttagaaaatggaataaacccgacctctacatccaaccggatgtacacggccaacctcattagtactgcattgtaatatgtttgcctgcttttctaatgatgatttgtcccattatcatctcttggggtgaacaatgcataactggtaatatatagattgcagttcctgtgccaggctctagcacgtgtactagttttggcatcaattgttttcttaaaatctgtggtttattttgacacctgaaaattgagttatcttttgtagcaactagccccattcaacgcaagccagtagcagcccacattgcacagcttatggagtacagtccctccctggcgaactcaactgaacaaccatgaatacatgaatcatgcgccatgtcaataatgcatgacatgatgcctgattttgattttagtagttggttttccatttttgtaaactacgatgcctgtttggaggcgagtgaacacaaaaccctcaaattcgcatatactgcgctggttatatacttatatattgagaccaaaactatggcgcattaaattttctgcaagtcgcattgcgattaatcagtacagcagcaatcgaagaaaactcccaaatttccacatccctaaaccagtcgattccagtataatcattgactctccctgttactattttcttacgcaaggacaaccatatataggaactgaaccaaatgacctaagcgacgagataaacattctgcttccttataagaaaagagacgagcaaaacgaagggatgcaaaagagaaaaaaaacgggggaaggagacaccacccgtcgacggaatgagctggagggggattcgccctctccgcggcggctgctcttctctccgcccaagatcctcccccgccacccagccgctaccgtgacgcctcgccgtcgccgcgtcggccgctcttttctccgccggagagcccctcgcccagcccaccgccgcgcccagccggcaccgttgcggtcgagggaagaagccagtgcccagataaaagtttgtacgtgggccaaatgtcaggcccttcaaaagacctagcgaaattgtttacggcccaaatgttggaacagctacaactcaacgtgggcctaattttagtcgacgtaaaatttgcacaatacccgaaatatgggcctaagtatatacttactccgtactatatttgaacgtttaatttaattatttagatcgtatatgaaaaataattatggatcataagaacgtttaaaaatatatagagcatatattccaaggagtattacactggtagtccaaccgaaaataaatgcttgcatgtaatactaaacaagcagctctgaacaaaagtaaccataataaagtaattaaggctgtgttctttccacaagtttcccaacccctttccctcgttttccgcgtgcacgcttttcaaactgctaaatggtgtgtttttttgcaaaaagtttctatacgaaagttgctttaaaaaaacaaattaatctatttttgaaaaaaaattaactaatacttaattaatcacacgctaatggaccgcttcgttttccgtgcgatggagttgggttcccaaccccaattatcaaacacagcctaagtagctttaacaacagccacatgacccaattccaccgaacccaaataaagcttgccgccgcctctctcaatcacctccgttggcctgacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctaatggcgaggccgttcgggtacgtcattccggactggagcacgtcgaggtagcccgtcgtcgggtcgtacttcatcaggcggcccgtggagtcgccggtggccgtgaccatctcgtgctgggatcgctggaagcgcgtgctgctgtcggtgaagtagacctcgccggtgacctggttgacgtcgacgccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtacgtcgtccagcctttgtcggcgccgtcccagcggaggatgcggccgtcggagacgccgctgtaggggccatcgccgaacttgtcgaacgcgacgctctctgggccgaccagcgtcgtgggcagcggcagcgtctcgaccagtgtggcggaggtgtccttcgcgacggccgcggcgagggcgtgcgacggcaacagcagcaggaagacgacgatcgtcagcgccacccgagtcagagtccccaccctcccggtgccgaggacggcccccatgaatgagaatcgccttgctttgcttcgtctcactatcgaaatttcttttttttgtcttggcgtgtttttcttaaatgttcttcgcttcttgcttgcactggtgccgcgcgccggagtgtgcctttatacccgtggccactgcaggcaggccacgtccaatttcggacgccgattccgattgtgtcgtgtaactgaacactaaagccgattcggagtcggagttaccaagattagtgaggtcgacgtacgtaattagcccattaatatgccaattcggaatcggcatatttttatggggtgacgtaatcaacccatttaatgtcctggacctaattagctcatccacgtaaattcagcccatctaagggcttgcttggaacatggaaattttatacacccgcaaaactttcacaccgattcattctggatttagtgcgtcgatgctgtaacaccattgcccccgcgtcgctcctagggcaggggcgacacgggaggcgacccagccgccgccgccacaccacccccactgccctccttccacctcgccgccgcccgagcgggccgccggaaaccgcgcggccgcaaggacggcggcggcgtggccttctccccccccaaggtcgcggcgtttggagcccacgactccgacctagctccggggcggcgacttcggcggctgcgatgtcgagatcaacggtggcgcatggtgtcggcgaggtggcggcgccgacgacggttgaagaggtgggcaaccgggccgacgacgatgacgaggcggcggtgctggctcccacgctctcctgcgcggatctggtgcggggggataggccgccggcggcggtgatgcgcgtggaggcggcggggtggccggattcggccccctcctgtccggatccggcgtgggaggccgagctctgaccccagcagcgaggcggcgggggcgcgcggcgctggggcggcggtggctgaaggcggcggggacggagctggccgagggcgcggaggcggcagcggtggtcccgtggctgcgacggcgcagtgcctggcggcggcggcggtgccccccagatccgcgcctctcgaccggatctggagggtggcggcagttggcgacggcggcagcggtgtggcgacgatggtggcggcaattggccggcggcagttggtgatggcggtctctctggacgccggcagcagttggcgacgacaaccgcggtgtgatggcgtcgggcagctagctgctcggtggtggagggcgacggcgcggcggcagtttgcggaggcggtggttggcgtcggtggcagcggtgacggcagctgcgactctggaggcggtggcaacgtcggcggcgaggaaggagttgggtgcgaggtgaggatgacgacggcgaggtggctgggtgtttggcagcagcggccacggtggtggtgaccgtgtttgcggtcaccgaaggcatggcggcctcgcttgactagccgagggcgtgggagacggctgcatctggccggcgtggcatcgtgcagtggaggggtcggaaaccggcttggcgcagagaagtgcagccgatggtagcggaggccggctcggcgcgagaggcgcaggcggcggagatggaggccggcttggcgcgagaggcgcggccggtggagggaggccggattggcgcgaggcgcgtccggtggaggaggccggcttggcgcagagaggcgcggccggtgatggaggaggcgacctaggtgtgaggaggagctgccggtgggtgtggcgcggtcttcgacgcatgaaggctggccggcgggggacgccggtgcaggggtcccacatgtcggcaaagcttgtgtggtggtggagcatcggtgcgtcagacgtggtttcgcagaatctcgtctgtgcccctttgttggcctagtggcggtcggtcacgcttagtggcggccgatccggtgctagccttctcctgggcgtgtgtgttggcgatgtcggcgtgtgggtggtggtatattttttccttttcctggttacgactctccagagttgtaatattgtatttttttcctgctctatcaatagaacttcgcaccgtctcgtgcgagtcgttcaaaaaaaaactttcacacccgtattttttctgtgccccaagggctttcctgggatcgtggaaattttatacgctcgcaaacctttacgcccgtattttttgtgcaccaagataacatgtaaaacaaaaataaatatatttggtaaaatgatgtttcctttcataatacaaaagtagacgcacacgccactacatgtgtaacacccacgaatgctcatcctagctaacaaacatctatgcgtccgtaatacttgtgggtgttgggattttgaactctagtggatggagtcatgcacccacgactccactcccgtatcacttactatgacaaaacataattttgcatggggccaaacgctttgctagtatttaaggtctgtgaaaattgatgagtttcgtaggccgctaccctaagagccccatcagcgcataattaagtggcttgactaaacaatgaattttagcgtaagaaaacaaagtgcacatccaaatatcgtccgattcgcaaaattcataatgcaatttcaacatttgaaattcgaaacagatttgtcaaattcacaaaaaaaaagccagccgatgatgtcagcatcggcatccctacgtcggtatcctctctagcttcttcaaccagtctaagggaagaaaccgaagtagcgcaccatcattgatgttggtgagggagggcgcggaggcccgccgcgacaaagtcaaccacctcagcgaggatggccgtggaacgaggatggccgagagctctccgcgacaacgagtgagagcttcttgaggccttgtggcaaatctgcatgctccaggcccaacgacggcaaatccacccgcgtcaggctcggcaacagtggatctagactcccaagaccctgtggttgcagacctgatgctcctgaggccggtgacggcggattcaagctatggaggtcacatcgctgtcttcacgatcgtggtcattgtcgtcatcactagtgtcgtggtggtggtggccacgttcatcgtcgcaggcccaattgatgtccctttgcctcctaaggcccaccaagttggtgtgatcgacggtgccgatttttataggcagggctaaatctacgggcttcccgttatttatacaagtattaacaagcattaatattttaagcccacctgataaaaataaaacgtaggtctgggcaaaattgtttttttagtgctagtacttccccctgataaatgtcgtttcgtttgggtaaaacataaaaaaaacatgtgaattcatgtaccgattctgaactcattaaaatcattgcatgagctgtagcagcaaaacaagctatgatgctgaaacgtgagagtattcacgcatcaaaaagatacaatgacgaaataggatgcaagtcagaatagattatagaacatgacttatgtgataaattctaagcataccagcaatactcgtgcaacaagcgtgtttggtggaccataacccctagatttatttattttttttttgggggggggggggggttgttgtagataatgagaaacagctcatgtgatttcagctagcataggaaaatctactttgtggttactagtttttttgtaaaattctcctattacagtttttaatcaaaataaaaggctaaattgtttaatttagaggagcttttagttttaagaaaagctgcaggttccaaaagttctcccaacattgccctatgttctaaactaattagcatattgctaattgttcttttagtgatagcaacttactcatcgagtatgaggtgtttataagtatgtggtgtgcaattgtccattccagttgctcatagtaataggagtgtgtgtatgtgcatgtttatatggtcactagtaatcgtgcacgtgcaatgcacattttccacgttataaaaaaaacacaaagtagattcaaagtttattatattttcctacagtatacatcacataaagtatacttcctccatttcacaatgtaagtcactaacatcaatatgagatgtgagcctatgatagagattccaataaaaaaaataactaaatcagtgcagcaaatcaagaaagagtgtgcaacacgaatcgtccagaaccaaaaactaaaaatgccaagttggtagggcttccatcatattctatataaacatgttaccacgataaaatttcaatacgtacacaggttacaaccacaaaatttaaaacatgaggctttcacgaactaacgtaatatatcgtaatcctaacgtattattgtattctgatgctcaccccttgataaagtaaatgtgagaatatcaccttcagataatcccgaggaatccttattgttttggtggcccctttggtgctatgaaggtgtaacggcaggatgacacattagtcttcttgttggttgaatgaacttctgaaatcgtagaattttgggcactttcaattttgttaagtggtggcccatgaagatattgttgattaccacaaaccagtggaaaaacatctcatttgatttaatagcaaatcagaaaattcatatgttgttattttacatcaaatcaaaacccaaaaaaatcaagacattttaatatttcagtatgatatgaaatactttgacgcaaaaaatcaaccactgatcacttccaaatacaaaggattataataattatcttcctcatatattccccaagtagctttggtcttccacacttcaccctggaatgaaaaggcattatcatttaaaaatgttaaaagccacaaaaaagaacttgtcactataaactgaggcaggaagtgaaactgtccctcatcctaatgtaggcctcaatataaaaacataagactacacctaacctctaaacatgccaatgccttctagaatgaatagagttgtgcattgagatatattgaggcaaattaagaggaaaaaatacagaagaaatttgaatcctttgcttcagagaagaccagtgataacatttttccacccttgattctggatcctcaatttccatatgcttagaaagttggacatgattagaacaaaatgttatttagccctgcgtgatactattaagcaattgctgaaaacaagcacttgaaaatgaggacgtacatatgccaaaaatcccacagtttgatgcatggcattctagcacctattagaaatgtttcagttatcaacccgataattcattttgttgaggcattaaactaaaggttgataaaccgtgcatagctatatatcagtatattattcttcctctgccctccctccgagtgttaagtctagccattcaaatcggtggagtacatatcaaacatgcagaaaatatacagaaggtaaaaattatccaataattaattacttcctccgtttcacaatgtaagtcattctaccatttcctatgctagaatgacttacattgtgaaacagagggagtacatatttgtgctgctctatgataaaaagaagagatttaccttcccctaattcagattaccaataattaccaagccattacatcatacagtacacattcacttgacacttaaaactcacaaaatagtagactccctatcagttaactgaatggatataacgcttttaacagtacaacctacctcaaatggcattgtggatagttacaaatctctcttcctcttctgttgttgcaaatctgtcaattgtaattaaaaaagtagataaataagatgattgcgtagagatttctcaaatcgtacaagcttagcaaagaaaattatctgcttaaaccaaatgggatgtttgaaactgattcaaactaaataataagcaattatagaatcattcccattggtgtgttgcacacacatttttgttgttcatggatgcagtatttaggcacgcatggacagtgttggagaaaaaaaaaagacacaggtgccagggaccatcacatggccctcaagtgtaaattaagttgcagaggaatgggcaaggtacaggaggtgtttgtgagtgagccgaggccaagcagagagaggagaacaacaaaatttgcatcaataggacatgagctaactgacaacatatatgagtgaattttaccaatctgcaaaacaaaacttttagaacaatatgtgaacttatattgaacgtcatttaagttttattgtgagcaaatgaaagcataatgtataacgttaggattatacctcaccgttaagatacactctttctaatatggggatgaagactacagctgctgcactgaatcttgaatcatgtacaaaggtaaatcaaattgaaaattgcatttataattcttcatttagagtgcaaatgaaataataccgtgagatactgaggatagttctcaaaaatatactggggatatatttgttgccaaaccgtcaggacatacaacattaaaaacatctgatttctgcatcggcaaaaatatgcaacacatgcaatcaattttgggaagcaaagagttgccaaggtggatgtgcagatcatggaaagacaatacattcactggaagctgcatagcaccttgagatcaggtctgtgttagcaaaccgattactcctgcagttcaagaactgtgaacaccaccaaaggcggccgcatcaacagctgtgacctgctgcccttcttggaaaaacaaatatatgaagatgatagcaaagcaattcaacaacctgaatcatctcatcttcatgctgatgtatgtgtgttctgtacttctggtagaaagctggagcatccgaaacataaaactcaattaaatctctaaaacaaagggattattagtgcacctttgcattgaccaatatgagggggggagcaggcgacagtagagaaagcaccaggtcacatggtagagcaggaggtgagcagtgagggaggggattggcggtagaggcgaggtgagcgggctatcggcaatggagtacatcatctcagattctcagtccgctccccactttacgatggagtccgacagtcgacagaagcatggcagcataggcgacagcactgtggccttctccctcaccctccattgtctctgcatgtggactgagaaggaagaggcgatctagcacaaatggatgcgtagcaacagcggaggaatgtaaaattggcagatccagcactaaaataagcaatgtagtcacattttcaagttttcatttgcaacagcagcatcatgcaattgcttccatagccttaccaacaaatataccatccttatttcatctctaatttcatgagaaaaattgtctattgttattcttaatttgtgcacaatcagcaaaaattccgttctgctatcatcagtttgatgggtactacttgaattgcttgaataataatttaacaatgttattttcttctccattgaaaatctatgaataaatcaaaactatgatcatgaagctcaattcttgtaaatcacatcatctagatgcattactgaaatcagagacaaagattatgaacagaggcacggggcgaggactcaccacttgttctgctagctgctgctgctcgcccctcgctgtctgatgcccttcatggatggatggcctgatatgctagctcctcgccccctcactcctgctgctcgtgccttgctgttcgctgtcgccgccgagccgctgcagcctgccacgtggcagctgcttgccgttgttgccactgcatcgtcgcttgccggcccgccgtcgccggccacgctgatagctgctagggtttgtgggctgcacaccaacggagcagctatagaaactacagaagcggcgggtgatggggaggcggacgcggcggcggtggacaggacggcgcgacatgcgttggggatcgagcactggaccaccgttgccgagttcacccagtcggcggatctgacgacgacggctgcgctcgcgaaggggactcggggacggtgatggagaggagaaggacacgaaggaggtggggaggaggaggacgcggtggcggtggggagaaggcgatgcagcagcggtgagtgggaaggaggacgacacgaaggcgatggggaggaggagaggcatgcagcggcggtgcgtggggaggaggaggacgcggcggcggtggaaggtcagggagattcggtggcgcgggggagtggcaggaaggggatcgatagcggtagtagcgagtagcgcgggcggagtcctcgcgcggtgatgggagcgaaaatcacggtggagataggatgggattgctgtgggagggtgaatcgcactggacggtagggatgagagtgatgcggacgtggatacagatggatggtaggatcaacatgttgatttcacccgtacgattgcaaaaaggcaactcctactttttatattagtatagatatagattatcgcaagattagcctaattgtattctattcaattacatgattattagtgagtgttaacttcttcctccgtctcatattaagtttagttttagctcagtccatttgtcccaaaataagtttacttttgggaggaatcattgcatcagaattagtaaaagtaaagaataattgtattaactagctgggtggcccgcgcaattgcgcggctagcacccaaacaaaatcatatattttttagtataattttacttaaaatttattaaatagctacctagctatctcatagttttaagactttaaaataccaaatcttatcatcctcgtgtttttaattatatagttttaaaagttacaccagttgctaccccttatgtcatatccttctttatttgtttgtttgatctaccactatttctattcattcttcttagaacctttaaaaattgaattttatagtttttagagtttattgtcacgttaggttttatttttataatttctagatgtaccgtcaaacgttgccattatactcctctacggcccgtccactgtctcttctctttgttgtcattgagactttaaaaatcgaacataattatcgtttgggttcattttttactttttagaagtcccgcccaaccgtcagcggctttgccattgtactcttctatggctcgcccgttgcctcctttctttattgtcattgagattttaaaatcgaacatgattatcattgaatttttttactttttagaagttccaaacctttaaaaattggacttgtagttttattttttataatttttaaaagtcccatcaaacgatgccactatgcccctctacagcccgttcgccgccaactcttttttgtcattgtgattctaaaaatcgaacataactattgttgtaattcattttttattttctagaagtcccgtaaccatcggcggctctgcaactatactcttatacaccccgcccgctgcttctcctttttattgtcattgacattttaaaattgaatatgatcatcgatgttttttttttactttctagaagtcccggcaaccgccttactcatttttgccttactcatttgcttcatggcctgcctgacgtccctctttttaatcgtcattaggattctacttggtgttttattaataatttttatatctcgtatcaaccgccaccactctactcctttataggcatgttacttaatttatatcgtcatgtgttttttagatggtcttttctttcaataatctttatttttatcacaaattttagttatttataaattgtattcctaattgaaatcttatttttctttttctaattttagaatttttttaaaaaaaattagttaatatcgtattgtgttattttaatgtttttattttttattttgaatttcagttgtttcgaaattgtattcctacttgaactctcttttaatttttctaattttagatattattttatttttattctaaattttaattaatctcgtattgggttcttatatagattcttctttcattattgcttattttaattccgaatttcagctaattttaaattgtatttctacttgaactcttcttttattttcttttgctaatttcagatttatttatttttattccgtattttaattaatctcgtattgggttcttatatggactcttcttttaatatttcttatttttaattccgaatttcagctatttttaaattgtattcctacttggactctcatttctttttctaattttggattttattttatttttatttcgaattttgattaatctcgtattgggttcttatatggaaacttatttcaatattccttatttttaattccgaatttcagctatttttaaattgtatttctacttgaactctcatgtccttttctaattttggattttattttatctttatttcgaattttgattaatctcatattgggttcctatatggactcctctttcaatattgcttatttttaattctgaatttcagctatttttaaattgtacttctacttagactctcctttttcttttttctttttctccgattaatgtgtgattttctagctcccacagcgaacgtggggcctcctttcaaagctgttttaataatataatagattaggagtagataaagagatgaattgcattgggatttgatatattaggagtatttctttttattattactacctccgtcccatattacttgtctttttgagttttcgtttgtcaatgtttgatcattcgtcttattcaaaaaattttggaattattatttattttgtttgtcaattgctttattatcaaaagtactttacatatgacttatctttttttatatttgcattaatttttcaaataaaacgaatggttaaacgttgcaaataaaaagtcaaaaacgtcacctattatgagacggagggagtattattggtatgtgtaggatgggtaaaatattaacttatttgggacgtatgtagtagaactagtatatagatatactaatgtaggattttacactaagatgtacgctacattacaagaaacaaaaatgacaagtagtgctcaatcgcagttctatgtgagaagttatcttatattactaaaagaaatttacagctaacaattcacggtcgtgcgaatatactagcatttcaatacactatgtatcaaaaaataaagtccacgtcctaaatatcaggattgttgaacaggcaccgcaaaatgtgactatccgaagttagagttttatttgaaatcaaaatatacagcatactcctatattcccaggagagatgaaatgcaaactattacataggtagttcggccgaaaattgatacttgcatctaaaacaaaataagcgctctgaaaaaagcaactataaactaatcaagtagcgctagccttgacgacggcgacatgacccaattcaactgaacccaagtaaagcttgccgccgcctctctcaatcacctccgttggccagacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctgagtgcgagaccgttggggtacgtcattccggactggagcacgtcgaggtagcccgtcgtcgggtcgtacttcatcaggcggcccgtggagtcgccggtggccgtgaccctctcgtgctgggatcgctggaagcgcgtgctgctgtctgtgaagtaaacctcgccggtgacctggttgacgtcgacaccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtactgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaatcttgctttaatccataaatggatctctttagacgacatcccatattttcgtttcctttcatgacaaaaccttttggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctatgtctcttttgccagtcagcatctgactcactttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagatacccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaagtacgtcgtccagcctttgtcggcgccgtcccagcggaggatgcggccgtcggagacgccgctgttggggccatcgccgaacttgtcgaacgcgacgctctcagggccaaccagcgttgcgggcagcggcagcgtctcgaccagtgtggcggaggtgtccttcgcgacggccgcggcgagggcgtgcgatggcaggagcagcaggaagacaacgatcgtcagcgccacccgagtcagagtccccaccctcccggtgccgaggacggcgcccatgaatgagattgagaatcgcctttgctttgcttcgtctggctgtcaaactagcttctcttcttcgcttcgcgctttgtaatggtgagatgttcttcgcttctgagatgcttggattggtggagagcggtggccgtgcctttataccggtagccacatccacgtcgtcgattcggataccgactccgatccgattccgactccgattttacaacgaacctaacctcagcttgttgccttgtttacagtccagactgtgcttaatttcggcctgtgtatgaatggatctggatctaatgtcagcccatgaaaaaaggttggatggttaggcctgcattgaatttgatatggatgtatgtttggcccagatataattttatatgggcttagtttccagccgacgtatgttatgtcgtgggcaatttacgccctcagttaggaataagttcactttgagtccctcaaaatatagctccatcaaatttatatccgtgaaccgcaatatcagatattttaaacccccaactattaaaaccggtgtaatctcactccctcagcaattttgaaggacaatttctttgacgtggcctttgacttggtccaacctgctgagttatcctgtaaggcccacccgttagtgacccttatataacttatcttccttcctttcccctccatttgatcggcgccacccctcttcccccttctgctccacgttgggccgccgtcaggaaggagaagtgcgttaggagcgacgtcgaatgcagtagtggcagtagggagagtggcagaggtggtgcaggtcaggggtggctctccggcgagataagctacggcggcttgacagaggtcgcggtttgtagtgacgatggcgtggttgtggcggttcttcgatgagataagctatggcggctcaacggcgcgcgcaatccttttggtgagataattaagctacggcagctcgacgggtgtggtgctctgcggtgacgataacatgggtaccgccgtgctcattcgcattgaggtggggtgcttagcaacgacaaggtgtctagtcggactagttccgtcccttttctttgctcttaactaaacataggagcttatgtgatggcaacaagaacagagaggaggcagggtggcggaaagacgtagccctgctttgtcttgaagtttgaagcaaggaggaaaagcttgaagctagtgttttagtttttctttattgtttgttatatatttcagttatgagattaagaatgtaacttatggttgtataaatatccacttgaggtcggatttctaaccgctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactaggggacttgggcaaacactgcaatacccccactcagttcacctgcaagccacgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacagtactcccacgccccggggtacaacgtcgccaagtgcatggctcccaagctccatcccgcggagctcaccgagagcaagtgcggccggccgctcggcctccggttccacaacacctccggtaacctctacatcgccgacgcgtacaagggcctcatgcgtgtcggcccgcgcggcggggaggcaacggtgctcgccacggaggccgacggcgtgccgtcaagttcaccaacggtgtcgacgtcaaccaggtcaccggcgaggtttacttcacagacagcagcacgcgcttccagcgatcccagcacgagagggtcacggccaccggcgactccacgggccgcctgatgaagtacgacccgacgacgggctacctcgacgtgctccagtccggaatgacgtaccccaacggtctcgcactcagcgccgatcgga

SEQ ID NO: 22929 - DNA, 2850 bp, Oryza sativa
  unsure (1)..(2850): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataccccgtttaaaatattttggatcacgaggccatcagattcatagaactaccattattaagtaccaatgtttttccaaatcgttgtcattcattcaatactacagtgaatggactataccaacccactgtgtcggtagcgtacgaagtacccctacgtggtcgtacgtaggtagccatgtgatgagtggcgtactcctactggcgtgccaccgcagcaacaaactatagtacctccgttacaaaacaagtgcatacgtggatatccgtgcccaacgtttgaccattcgtcttatttaaaaaaaatgtgaaaatttgaaaatatttagtcatacataaagtactgttcatgttttatcatctaatagcaatgaaaatactaattataacaaattttcaaataagacgaacggtgaaacgttgaacgtgaataatgcaaaactgcatttattttgggacggagggagaatgtttccgtacatgcctgtcttcgtaagccgtgagattcgacagctacagtgttatggatgccgattgatggcaattgcggtgacttggtgccgcgtcccaattactgaaattatgatattttaaccttttaaaaatttattttaagaatagttcttattatagtactaacctcggcctcagttcaagagggtttggcactaattttgggggtttttctggcagggttgaaataatatttttaaaaacgaccaaatggtcataacttcatttctttttatgatataattttctgttgaaactttgatcactctattgttagtaataaatttgtaagtatttaattaattgcatgccacaatatcaaatatattgctctcgtgaaaaaaatacgtaaaaacaaccgtataactttgttcatcgcaatttaaagtaaaccattttttgttattaagagggaaagcacatgtgtgttttccatttaataaaaaaattactattaaaacaaccatttcaaaccatttctgataatagatactccatccgtttcatattatacactttgaaagtttgattaagtttatagacaaatttagcaacatttaaaacaccaaattagtttcattaaatctaacattaaatataatctaataatatatttgttttgtgttaaaaacatatgttttctatgaatttaatcaaagcaacttataatacaaaattaatggggagggagcatgagggagaatcatctcttatttccaaattgtaacaatgcctaccgacgctgacaattactaggaactatgggagtaataaatagatgatatgataccctcacgggtcataatcaatttaagagggcctgattttttgggtcgattctgcaggagattttctgtttgctgtggagagctgacctattatttgtgatctatgggcttctaaatattttatttttagtggtggatctaaacaagctacagtgcgtaagaggtactcccttcgtctcataataagtttattttatgatcctttcatttgtttcaaaataagtttatttttaagtaactattgcatcgatgtttgtgaagcagaaactaattatattgggagtagataaagtaaataatactaattggattaggatttgttaaaagagaggtattctagtcattttggtatatatgagataggtgaaaaataaatttattttgggaggtgggagcagcagtagttttaaattctactaatcaacacaaggtccttttatagagacattctgcatccacgatggaacgtgcactctcaaacatgattctgaatcctgtatttttttttaatttttcaggtgtattgggccaaatgattggaattttaaaataaaaaaatgattggaaatttaatacgaaaaaccgacccatccgagaatctttccttggccccacgggggaagcagccctaaaacgcattggtatattgttagtttagcaccaactttattttacttttggtctttctgtcaccatgttactctttactcatgtattcatgacatgacatatatatcagttgtatagccgccgattggtacgctgagtaactacggttaaaattaaaacatactccctcagccaaatttatttgacattagtttttaattgaaatacgatgttgtcccgaattttcaaacactacatcagaaattataatggcaattggttgtaaactccacataagtattgattccccaacggcaccacgtaggcagcaatgatgaggaagaatcaaaggtgcggtgtaggaatcggcacatatgaggttccccgaataaaaaaatctggctcgatgtatcgccttgatttgaaccgatgcaccaagcgcatccaaccatgtcactcgtgaaatcaatacacaaccaataacaacaaactcacaataatcacatctcacgtaatcaacatccaagaataatatattgcttccaagatcgattgacatcaagaactcactaaaaaaaatacatagaggaggacgcaaaaggagagaaggctgatgccgccgctgctcaccgttgttgtctgcccacctgcccatcaccttcaaggccggatctggttaccctcgagctcgtagcagccgaatttggcaattctgagctcatggtgtcctcaagctcatggcggccttgactccttaccatgcatcaccgcagccatcatgtgatagattgaggactgctggatccgactgcccctaccaccacgacgctggatttgctgact

SEQ ID NO: 22930 - DNA, 8938 bp, Oryza sativa
tcggctccaggctaaaagtgcacttttttaataaaaaaatgacccttttatcccatataaaagtttcattttattatttaaaaagctggtatgttgtaggtgccatttttaaaacaaaccgacacttattaagtggtattaggtgtcggttttttaatttatgtctgcccatgagacgaggaaaagactaatatgttccagttttatatgaacagatgcatataaggatgtcccttattagctttttaagtgaaacaaatagttaaaatataatgtcgagtctaataatttgtgctaactcaacaattcgcttattacaattaagatgtctacgaaaacacagatagtcatgtaatcctatcttactataaagttatcccccactaactccttaagcttaatatgcaaagatgccacatcatcatccactagcaagatgtcatatcatcatccactaattaacaagatgccacatcatcacccactaacaatcatcacatttaaacatcgtgcaaacatgctataactttatagtttttataatttaagagcttttcaaatacaagcatgttaaattatcatccaacataattcacacaatgtttcaatgcatatctttattatgttttatgatatcttatatacttatatagttcatcttcacttagctaatgcttaaatgattaaactatggtacaaattatctttctcctttgttcctctaattaaatcatatcacatcaattgtttttagcctttagatgattaatcaacggtccaaactatctccctacttttcttcttccataaagtcataccaccttactttttccgtttgaatcgtcattctacatactatttaaatttaaattatcataaaccacattaatttatttaatctgatgttatctagctatcttacacgtttttttattgttatcatactaaatttccgcagcaatgcgcggggtttcacctagtatatcatacttgtctgttcgctagtgtgcacaattagaacactcttaaatcaataggggatgtcaaaagataaaccatgacctaacaaaattaattatcatagcagttatcactgctgattcaattcgtattatcgatcacgtcctcacactaaatagagaccatgacaagttgacaagaatgcatcatccaacgcccggaaaatataatcacaaaagctactactcctaaatgagaggacttaaattaatgtactccctcactcaataatatatatataagacagtattatatttctacacggacttgtttgatcattattttttttcaaatatattatcaacaactacaaaattaacaatatataaaaacattttcaattgtgaaacacatatatttttagtttaattactagtaaaaaaatgaataatgactgtggaaaacaacgatgccatttattttcaaacgggcaagtaattaatatttgtcgctaacttttgtagcttggcttgcaagccagccgtccaaacacacaatgatcactttcggtcttccatgtcacgaggggatgtggcaatccgacaaagctaccgcacaaacatcgataggatatcccataaaattaaatataaacccttaataccttttttgttcaaaaataagtgtagcagtatattttagatttgaactacacgatttattttgggatgaaggtagtataaatatagagaccatattttcacccattatttttcaaaaaaaaagaagctatgtacaatatctaattaatgcacggtgggtaacagctgattttttcgatcgaaccgtaatttggtgtcgacaagtaaaaagaactttgaggcatgtttggttccctatttggtacataaaggtatatattcacacgcgacagtaccttctcatcgtgctaatttaatccgtatatagatttaatccatttgaatttatagcgataataataatgagtgtgtatagaacaatacttctctgatttcacttttcatcatttcaattcctttcaaatatataaggaatatatagactttacttgttggttaaaaccttgatatatacaatttttgcatgtggatctcttaagaggcccgcatggaaaatcgatttttctatacgggtgtcttaaggagctacatgcgaaaataaaggtcattttttaccgacgccgtcacttacagtccgtctgcaacctaaaggggttctcgtatagaaaaatctttttttttaagtagtgagagttcagtaatcaaggtcatggatttagagcaagtttaatactccctccatccacttttaatagatatatttctaaatctggaaattttacttttgatagacatatttcaattcaaccacctatcctcttaataactttatcggatttactgcgttgctctccattcttctacacaagattggctacatgggcatagagaaatgtaaatattaatgaatcgcttgtttacgaggaataattagtatcatatttaaatggatgataagtagaattaattacttatccttggtcattgtgccaagatgaaatatgactattaaaagtagatggagagagtaagccacactcagttggcggtagtagtgccacgtcatccagattcataggtggaggagagagaaagctggagggagagggcaacgggcgctccagcgagcgctgagctgcagcacaagaagctatatgcaaattacaggaatcgatgctaatccgtgtcctttttttctctaataatattgctatatggccccatcaatagaacacacaggataggacagagaatagcaagttagaataaaaaataaataaataaaggaaaagtctatacgtactaacttttcttcataaaattcttactaacacttacacgtcatactatcagtgcatctagattttttataattttcatctatgtaaattaaacgactgagatgattgttagtgcaaatttagtacatgtagcaatgttctaaaaaaattaactacctaaagaagtgtgtaggtagattaatagtcagctattgtatctttatttctatctctcatctctcggatgacgggttcgtatcctctgcatctgggaccaaaggcaaagtttaccattggttccatccaggccatccatatgtcaatcaacggttccatagtttagcagttagcaccctcttagtgactaattagcagcttaagagtttgttctctcttaaaaaaaatcaaggaaacgatctccaacggtaaatcaaatacaactaatacctccctcgccttttggaaccaacttaaaaaataagataaaatcaagaagcaaacaatctcaggataagaaaatcctttatttatacaatagtaaaataattatcccacgtccttaagcatctagcaactctactgctaaaatccttccaaaaattaaacatttattttgaaaaaactaaactgtatttgttgtacaagagtattttattataagaaaattaatagacagaaccgatcttgttaattaattggactaatatacaaaaattgttatattatttaattagctgttaatcgtctttgaggtgctaaaccatgccgccgttgattgaagtacggatggtctggatgcaacaacggcgaacctgggttcgcctttcatcacaaacgatactgacccctcggatgacatgtactacatgtttataactagttgatggcggtactattaaacttgctcttatgcggtttgctttcatttgtttagtatagcatgtcatgtgttacaagggcaacacgtttataggcatatcattacatatatgatgtacagcatgtactctctgtcttgtagatagtagtcgtaaaagggttatgatataatgtcaaaaataattactaatctttcccctctttacttggagccatccacttaccgttttaccattttagtgttgtctgtcttggttgtcaggctacagaataatctgcctgcatatgggttttaatacacggtcacatttggaacacggacatttcatatataattcctacaggaaatgtatatatcaagatttcatatataatgcgatacatttcaagattttatacatttcatatataatgcgatacttccaagctctaaacaaacctcaagatttgcaacgcataacgtaataatcctgaatcgcggagaacgaaatttggttggtggtacatcccgatcggaaaaaactccgcggtttgaacttgcacagggtttgcggcaatgcgcgtccaaagccaaacaaatttctgttgtgccctaacacacggcacgtatgtacgtacaaaacaatcagttctatggttagccgaaagctagaaaagcacacatctgcaaacctttgccatggtattggcatttggtaacaatataccgaatgcatcctgcaatattattacaacaaacacaaattaacaggattataactgaagatggaagatagtaatttcagagtgccccgtaccatggaaacatcttgatacatttgcataatgaggatttaatttctgtcatttctgtttcatcggatgcgcattttaccatggaaacacggtcttatcggaagtgcacagggctcgctaccaccgtttttttgacaaattgacccttttcaaaaacttatttcgaaactaacccctgccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctaactcagcgccaaccgcttcggcgcggaggtgcccaacctcagcgccaagtaagttggcgctgaccttggctacttagagcccggccgaggccgccccagccagttcttcctccgttttttccccagccgcccgcctagggttcggtcgccaccgagttctcctcgcccaatctcccccaaaaacctctctaatcgaaggtgatttgtgcggcattgagtttgggatcggaagagaaggtaaacccctctataaaccctaagttacccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagtttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgcgcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccctaatgaaagtccactcatagaatcacccattagctgtcacgaactgtcggagaggtgtagtaggaaggaagaattgattgaggaaaacgtggaggggggcgagggagtaaatgatatggcggatgtggaggtcaggaaaagaatgacccggtaagggaggaagtccttgtaaagaaaaatgtgccgttaagggaagaagtacatgcagaggacaatgtgccgttaagggaggaagtcaatgtggaggagaatgtgccggtaagagaggaaggagatgttgaggatggtcgggaggtaggagatgatgtggagttgcctgaggaagaagcgaatgctaagatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaagatgtcagagcatgaaaggactgtgtttgcgaaactggtgggtagaaacccggaaataactcaattcgaggatcttaccaggtgggattggatgacattcatttgctaagttcatattgttgcttcaatgtttactttctgttgtcctcctttccgttctcattgtgatttttccatttaatattttttcaattactaatgattccattttcatttgcaggatggagcactttccggggttggaggatttctacgaggagaagcaccgggccccacagattgccagcggagaggttagcatcaacaatattccattatttttatgatcgaatcatgtcaaaagtataatgtagttagataaatgtcaacataagtagttagatagctaccacttgcacagttccacaatgaataattgtaaattgagttattgaatgccaattttacaaaagagaagtaaaatgaagaatctgaattatgggcttgatgcagagttataattgcaaaatctttaaatcgcaaatttccctcaaatcaaaacaaatgctgagaagatagctcagtgaggcagctcagtgaggcttccctatcctccaaccaatgttatgcatagtcatcaactcgtcatgcagaggccctaaatgtgtacccagctattgattatgcgaggaagatagcgggaaatgggaaatggtagttgtgcaggaaattattataaaatccaaagtgaaagctccggtagtagcaaaggcacttttagaagcttcctaaagtataggaagctgaaataaacacaatggcacacatatataccaataactgagggactttataccatacagtcaatcaggcaatgattcagaagagaaaaagaatcaagcaatcgcattttgttaatattctgatcatgttagttgtacacatatctgaatcataatttattacgaaatcaagaacgaacaaaacttgaatgaattcagaagaaataaaaataactactggcaaatagtgataccaaataagaaaatttgtgcagatgcacaacctctatgtagtggcaaattgcatcaacatccgaaccatttggatccccaatttcacaaagagcttctattaccatggaactgtacctagcagggaatttgtacatgatcaatttctgaatcaaatgcttgtcgaggacaaaatgaaattgtcataatattgattgcaaactataaaaaaaagtatcgccaactctgcccattgctccaaggattgttttcaatctttatgattttatattattcttgattactcagttcgctctttcatttttatttcactgctcgtaaaaagtaactatcgtttaaactaacatactgtttcatcgaatgaaaatcatacaaatatcgtaatttagctcagataaatagaacaagactaacatgttattatgtttgtctattgatgcagcgcttgaagacccttcgagtcagaggtcacacggcgcacatactgttcgacgaccggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcagtcacaggtgacacagcgtcagggaattactaacgagtcttcgtattcatttgttaatttttttgcaattactaatgattccatttaatttccggttacaggtgtgacggagctcgtggctcctcaccgggagaccgcgcaggcccccctttgccggttcggccgggggcttagggtgagatctcaagctctttctatatgtggaaagatcgcttgctcggagaaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtcccttctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccgccacgcgtcagcttaacaacgtgcatgtttgcccttcttcgtgtaacaccttgcctgtaatggttaggatgaagcctggtataaatctgaccagggctaacgtgccatcttaagagataacacgctagctccggcttgagacgagtgcctacaaacttttgtcttgaccggatggggcaa

SEQ ID NO: 22931 - DNA, 14416 bp, Oryza sativa
cttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccccagggaagcggtcaggtgtgacgccacccctaaagcctggtgacaggtgggaccggtctccgtagttgggcaaaatacccaacggtctcaattcatgcacattgatattggtaactttggttgttcataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccgtttcgattgccaccaacgcatatccacttcatgcgccgtaagcgggcgaatgggattagtggaagcgggggcacgggaaacgagggagcgagataacgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtaatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgccgtcggattgcgccgctccaacggcgcgcccggagcgcctgggagtacactgggcctgaagactacatgcggacccaccagggagccagatgggattgggctcccgaggacttcaagatcgtagtccaaagggtgctgaatcttagctccgcggaggcgtctcgccttcctcaggagatcctccccctctgcatcgatcccgaccgcgtctccattctaaccattatgttgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaagtggtcattcaaccgaccccttcgcaggttcgccccattctcattgcgaccgtctttcttctatcccattaaacaagttttctcttacccatcttgtttgtcttctggttttttcttctgcttcagcgatgtcccgtcgcactcctcccgccaccccaagtccggccagtccgaggccgaagatccggcggccgcagaagagcggaggcgagaagctgaccggcgtgaagccgcagatcgccttcgggaagctgaagaggccgcccgggaggccgcccgggttcgccaagcggaggaagctgctcgggaggaggccgcccgggctgaggaagccgctaaggaggaggccgcccgggctcgccaggctgaggcaacagctgctgctggcgcgtcaactgggcccactccctcgggcaaccctcaggcgacagcctccggggaggctcgcgacgaggccgcgggcacatcgcctgggcctacctcaccgggcgacgcccaggaccaaacgggcccgggggacatccccgagcccagcgcatccttcggggggccaagccgcgtcgcattttctccaaggcggctcttctcctcctcttccgtcgccccggtgagcgccgagcccattatgcaggccttggccgccgcaaacaccgcggtgctagatggatttagcgcccaagtggaggccttgcgagcggaacgagcggagctcgaggccgcatgggcgcgcgtcgaggaggggcggcgctcggtggacgccatggtggaggtgggccgtaaggcccaccgccgccacatctcggagcttgaagcccgcaagacggcgctggcggagatcgcccgagaggtggaggaggagcgagaggccgccctcgtcgccaccaccgcgatgatcgaggcgcaggactccctccgccttcaacacgggagctgggaggcggagttgaagaacaagctcgacgccgcccaaggggttctcgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggaggcgacgctggcggcgcacgaggccgcctgcgccgaggaggagtccgcgctccgccttcgcgaggatgcactcgctgagcgggagcgagctctcgaggaggccgaggccacgacgcaacggctggcggacagcctctccctccgggaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgagcgagatggggcccgacatgctttgggactcggtctcccgcatggatcgcgccggtcggcaagcgggcctctggaaaggccagacgaggacgcgccctagcaacctggaaggcctcgctccgcacctcaacaggatggcctgggtcctcgaacgactccccgtggagctcgacaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgtccgggatgctgccgaccatatcgtcgacggcttcgaggggtcggcccctctgctcgcgttcgcccccagctccgacgaggagggcgacgccagcgatgaggatgacggcggcgacgaggccggcgacccgggcgcattggaatgagcccccaggcccccgccaatcttaacttttttcttgttctttcttctaaggccttcatgcctcttttttgtataaattaactcaatctgcaatgagaaatgatgaaaaaaaatttttgtgttagttttattttgctatatatgagatgaggatgatctgtgccatggtccttttgcgccttagcttgaaataagggctcgtgcccaagtccgcatgtcgagactggccaggccgggaacgtggtgaccgaggggtatgggtgacccgattgtgggtttttgccggttcccccccggagttcaccacgtcccggggcacggctcggttctgggccccgtttggcgattttagctgaccgaaccgagcccccgagggtaaggttgagcacgagtgaccttatttcaagttaagattcttcagaaggaaaaacggcacagacacaacctttaggaaattgaaacttcttttattgaaatgctgaaatacgaaaagtaaagctgtgcatgtgtggtagcccccggctaacccggcacacccgaggggggtgcggggttagcccgagccaaaacctgacacccgacccccccccccttcaagggtagaagcgacgaaggtgttcaatgttccacgggtttggcagctccgtgccgtcgcccgtggccagccgtaccgagcccggccgggggacaccgaccactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaataaatttaagagcagagtgcttatcaatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccagtaaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccaacacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaagggatcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcggatcagagcaccggtactccttacagacttggttaacaaccaactgagagtcgcctaacaccaggaggcggcggatccccaacccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgtgctagcctcgggcattgagacggtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagataggccgctgcacccttcggtggggccgatcttctttgctaggggccgtatccccggggcgttcttcgtccaagtggccccttggggcgcactcgtcttctgtgccgatgacctcggggtcggaggacgacaggagcggccttcccacagtggccccggagccgtcctgggggtcgggggctcctggtgtcatcggacaagcgggcaaagggccagctccggtcgtcaggggcctctggcctccgttcggctcgggggcctcttctccctgctttctcccgggtcgagtcagcacagggttagcctcggggccaaagggcgataggtgcggccttcccgcagtggcctcggggccttcctgtgggtcgggggcacccagcaccgtctgacaagcgggcagagggccgactccggtcgtcaggggccgtaggccaccgtccgactcgggggcttctcctccctgcctgctcccgggccaagtcggcacagagtgggggtgcgcagaatgaggattgtcctcatcgcgctccacaaccaacgctgcactaactacttggggggtcgccgctaagtaaagtagcaggggttcatttggctccggggcgactagaaccggaggagagctgagatacgccttcaactgggcgagggcattgtcagcttcctccgtccaagtgaacggccccgagcgcttgaggagcttaaacaaaggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagaggccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattttttaagccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgtcggaccggccttgcgcccggccgcacggcgagacggtgctcaatcacctccctggggaccccgggcatgtccgctggtctccatgcgaagacatcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcgagcgcgactttaaggtcgccacggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccatgtgtgccccggcgtcacaccgatgattggttgagacggctggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacgcgctcctccatcgacggtggcaatggtggccccaggttcttggaaacctaggtcatcttcaccatcatcgatgtcaacagcgggggccttctgcttggcctcacttcgccgtttgccagaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcaagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaaattcgccatgaccctgtcgtcacccccagcggcctcgatcccggtcatatagacctggagaaactcggtggggttgacgctcccatcgtacttctcagtgatggtgggccggaaccttgggggccaacggacattccgaagactcgccacaaaggctctacagccaacaccaccagccgggggcacggagggctggtcctcacgtccatgtcgaggtgacactctggacgaggaggcaccctccgttgcacggggggtacgccggctattacgccggcgctcgatgttgaggcgggcatccggctccccatgctgatccttccgagtcgaaggtgtcgacgagggagtagcagccgaatgacgtgcagccgccgccgctcgccgcgccctccgccttgacgacacggagccggtggtagcggcgccggaggtcttggtggtggcggaccgtccaccagcacccaagcgctgctgagccgtcatgaccaagttggccacgtcttccagccatcgttgggctggagactccgggtcatggacgacaggcgggtgtcgtaggagcgcgccagcaacctgaagcgcgccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggatttggttccccgtcgtcgccgctcacactcggagagagatcgtgcgcctttgcttgctcggccattaggcagaacaagggaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgagatctcaagctctttctatatgtggaaagatcgcttgctcggagaaaacgcgagacacggcggcgatctatacaggttcgggccgctgctcagcgtaataccctactcctgtgtttttgtggatttgtgtatggacaagttacaaaggattaactccctttcccctcagccttccaaaagggaaaaagtcccttctctaaatgggcaaggtcctccttttatatctcaaggggataccacatgcccctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccgccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctacagacttttgtcttgacgggatggggcaaggcgtgcgtcagaccgccagtcgccacctaacccgtgatctgaccggtctgtgactggtcacagaccggataaaggaacgcgctgtactgcgttgcatgcagcatgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaaggtgacacagcgtcggggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatactgcagggcgtacgtgctgtacatcttcggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggacctactgtcttgtcctacgtccggcttggacactagccgacatagcggatgaccccgaggatgttgaggagcagaacgagtacgatactcgtacccgtctaggtaccacggtcgagacgggacctgttcgcgacagagtggttcgtttctagcattaatgttgtatattatttcaatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggcttattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgtatagacgaggatcgatgggatgtttttatttcttatatgtatggacttcatatatggatgtattgatggattctatggatgtatggaatgatgttgggattgatggatggatgtatgttttgtatggttctctggatatattactgcctgtaaatttctgtcatttgatgtttgcctgtgttgtgtgcaaagttttgctgaagttttagcagggatgggacgtcagcgccatgctaactggcgctgacatgcccaaactcagcgccattatggctggcgctgaggtcctagcccgcaagccatccagaaggcttgctgggctgggccaaggccgaaacggccaagttccacctcagcgccaggttggctggcgctgagtttcccacagtcagcgccattatggctggcgctgaggtcctagcccgcaagccatccagaaggcttgctgggctgggccacggccgaaacggccaagtcccacctcagcgccagatggactggcgctgagtttcccacagtcagcgccattatggctggcgctgaggtcctagcccgcaagccatccagaaggcttgctgggctgggccacggccgaaacggccaagtcccacctcagcgccaggtggactggcgctgagtttcccacagtcagcgccattatggctggcgctgagatcccagcccgcaagccatccaggaggcttgctggtctgggcctgggggttgcggccaagtcccacctcagcgccagtccggttggcgctgaggttgggcacctccgcgccgaagcggttggcgctgatgtagctgccacgtcagctaggggatcggcccggccgccacggtggcacaatgtcagcgccagtcccgttggcgctgacacgaccaacgtcagcgccaatgtgtttggcgctgaggcgacggcctatttttggttgaagtttttggcaggggttagtttcgaagtaagttttccaaaagggtcaatttgtcaaaaaaacggtcgctaccaactaccaagccaggaatgccactgcaaacaaattaaagcacacgttgcaacgagaccaaccctttcagcatcaagtactgagttcagtttcaaaaaaaaaagtgcttcctccgtttcacaatgtaagtcattctagcatttcccgcata

SEQ ID NO: 22932 - DNA, 4762 bp, Oryza sativa
tcctgcagcccgtctagattcattaacatcaatataaatgtgggaaatgctagaatgacttacattgtgaaacggagggagtactgagcaatagtaaattcatggagctgatagtaaatactactcactctgtcctaaaatataagtatttttgaactttgacacggtcattgagatattactttgactaaaaatatttacaaaaataagatggtttaaataaaaagagttacatattatgatagtttgtttaatgataaatctagtcatattattcttacatcattgatatttttattttttagctattaatagtcaaagttaaaaatattttgactctgtactattctaaaagtgtttatattttgggatggagggagtagaaattaaccaccctatgagaaccgtgcatgactgcaagctgacgtacatagctatagtaaaacttttaaccaggtaaaaacagcggtaccataccatgagcctgctgaactgcagcaagcaagcatgaatcgatggtactcgaggatgaacaaaatgtgtgcacaacaactgaaatgctgaatgatatcaactatcgaagcctgggatgacaggggcggtaaccaaattcagttcatagtgggcatagtacaccatctctaattttctcagaggaagtaggtacctggaagaaaaggattggttggttcccgccggtggagaagagcccccctctcctttttgcaagtataaatagcccatgagcgtcctgctatatttcatcaagccgagctcagtgagcaacaagacagtgaagctagtgttctcagagcatacacagccagcgacaatggccgggaacttgctagccaactatgttcaagtcaatgtcatgctccccgtaagctctagttctatttggataatcaaattttagtcacagcactggcaacattaacattaacataggcacaaactttctgtaacaagctcaagaagagcgaatttgtggtacactgacctgaattctgttgcgagatatgtagctggatgtggtgactgtggacaacaagttcgagaaggtcgatgagacccgggcacagctgaagaagctgacggaggccggcgtcgatggcgtcatggtggacgtgtggtgggggctggtggaggggaagggccccgggtcctacgactgggaggcctacaagcagctgttcaggctggtgcaggaggccgggctgaagctgcaggccatcatgtcgttccaccagtgcggtggtaacgtcggcgacatcgtcaacatcccgatcccgcagtgggtgcgggatgtcggcgcgagcgaccccgacatcttctacaccaaccgtggtggggcgaggaacatcgagtacctcacccttggagtggatgaccagcctctcttccatggaagaactgccatccaggttttagctgataagcaagccccaccaccacctgcacatatggagtccgatgaattttagaaaaaaaaaagagataaaaatgaggttttgatttcgttatatgtattacattcttctcttgtctgtggctgtgacagatgtatgctgactacatgaagagcttcagggagaacatggcagagttcttggatactggtgtcattgtggacattgaggtggggcttggtccagctggtgagatgagatacccttcctacccccagagccagggatgggtgttcccaggcataggagaattcatagtgagtgttctttagtctttaccagagtaaagattcttatggctgccctcattttataaataagttgttgataaaaatattctcctccatgtgatggctgatgaccaaagacaacaatcatggtccaattgcagatctcctttaggaaaaaaaatctttggaaaatgagcacaaatattaaagtggttctggttcacaaagatgtttggaccaaaaacagtactaacagaaaaaaaaaaaacagtagaagcaagcctgagactgaaattaagcaacaaaagaagaggaaatcaaattctaaatatgctgaacagatatgaaatgggacaaaatgcatgacaaatggtagtaattcactgctctaacagttattacaataaaaaaaatactgcagtgctatgataaatacctggaggcagatttcaaagcagaagcagcaaaggctgggcatcctgaatgggaattgcccgacgatgctggagagtacaatgacactcccgagaagacccggttcttcgcggataatggaacatatgtcactgagaaggggaagttcttcctcacatggtactcaaacaagctgataaaacatggagacaagatcttggatgaagcaaacaaggtcttcttgggatgcagagtgcagctggcaatcaaagtaagtatcatgctaaagatctcggcgaattatagtacataattttgaagacttcaatgatttcaaattagactacaggctagatgaataggcaacagatatatatatataatgttccattaattgttgaatctagaacataaatgacacatgctccaatgtttgctggcagatctccggcattcattggtggtatagggttccaaaccatgcagctgagctcactgctggatactacaacttggacaacagagatggctacagaaccatcgcacgcatgctcacaaggcaccgtgcctgcgttaacttcacatgtgctgagatgagggattctgaacaaagctcagaggcaaagagtgcaccagaagaactagtccaacaggtaaataacggactattacatactagtacttactggtctataagttagaacttctgcattgctcttcttctagaatagcacaagagcacttatcaaaatattctggctatgaactatgaaatggcaggtcctgagtgctggatggagagagggcttacatgtggcatgcgaaaacgcactcggtcgatacgatgcaacagcttacaacacaatactaaggaattcaaggccgacaggcatcaacaagaatggacctcctgagcacaagctatttggattcacctacctccgattatcagacgagctgctggagggacagaactacagcacattcaaaactttcgtcaagaggatgcatgctaacctggtgagtgccaccctacaaaaccaaaaacatgcaaaatagaattcatgtattgtttgcaactgagatgtttttttaaataaaattatgaatgttgcttcaggattataattcaaatgttgacccattggagcctttgcaagatcaaatgccagaaatgccaattggaaagatcttacaagcagcacacccaaaattggcgccatttccctttgatgagaataccgacctgccggtttaaagatctcgctgatgcagtctgcagccactttgtgaggaacaagggaaatagtaaataagcctattgggtacgatacgccagatgataaataagctgctatactagctggttataatcatatgatgtgacaataatgtacagccggtcatgaaactatatgcttttataataagctgtaatatgttagcccttgcccgtcccgatcccatgttgttgtatgtatttgaggtaatgaataaaagtttgtgtgtcttattaattttgtgatttaactatacaactggaattgcagaaagcagagcaaagagtattgtactgaaaatgatttggacaatgactactttctagtttttgttatacaaatacagggctccataattgcaatacatatgacagtacattattaacagagcatgatgaaaaacatttagttagctgacaaaataagttacttcatatcagcacgaaaacatgtccaaataggacaagatgcatattatgttctgggagcattgtgcgctctctatcaagatgctagtgatgaaaacctcatcataaatatcacatccaattatcctaaacgactacagctacaagcttgagatgtccctaagtagatagcagagttggccgtatatatctggttggatgtagaggccgggtaaaaaatacccttctctaaaataaaaaataaaaaaaagtagatagcagagtgcagagtgcagacatacaaacagagacagtcttccatatggccagatggtccttacatgtttagtgataaatattcagttgcacaagccacagcaaccaattttacaagttctttagcctggaagggtagctaacaaaatgggaaagtgtcaatatgactgttactagtgaattagctcgggaaataattcaattccttgggggtcagaaaatttctggcaagaactagtagactaactaaattgctacaagctgaattttgtgagtcaaggatgctattttgattgatccaaacaaggatgctattttgactgatccaaacaagtgtacttgccaaacttgttcatgtgtgtctatactgaattccatattgctaggatcattatattttgcgttacgagtcattttgcagcacaggcagcaggtaacctgcaattttgcacacatgccaggggccagggcacaggcacacccgggagtcagggtgttgcaaagtgagtagcatctgtccatatagtaacacaagaggaactcacaaaacatatcctagaaactagtaaggtgcccgtgagttgcaacagagtttaaatcttatgatattccttcttttgcttaagagaagcaactatagttaaaaaagaaacagagaagtatatagtttcaggaaaagggtc

SEQ ID NO: 22933 - DNA, 7655 bp, Oryza sativa
agcccatgacaaataagcatgtcaaatgtaacatttcattacactttcagcttaaaatggaatgaaaataatccaaggcaggaatgtctagcttgacagttgctcatgagtttcaagggaagatggaaagagaacatgacaaatagcattatatcagtcctagaatagtcttgtgcactataatggaaaagttgcataaaaatatggaaggtttctttagaaccactggactgaaccatttgaatccattagaaatacattgattttatttatttctatgttattttcatcatcatttgcagcatctaggcacccagaattagcagagcttctggacacagcgccacacatgtatgcatcaaaaacaagaaaaagaattgcagagtgcagatatacaaacagagacagttattccatatgaccagatggtccttacaagtacatacttgtagaaacacttcagttttctataatgattcatttatttgtaattttggagctatcttataaagaaaaattggatgcatagcgatattacggatggagactcaccctttctgtacagctacatcagatactctcttgcaatagtgtgtacacgacattacgacagtacctgaaatgaaaaaaaaaagttgggataagtatgtcttaatttaatttgattctgagaaaagaatcacgtttaagtcccttctggaaattatttacagttcacttaaacaggacgctctggatcaacccaccagctatacttcttccaattgaaaccaaaaaggtatatacagattttacacatagcgtgagcaactcaagacaaagttggttcatgacacattcatacacaaaccagcaacatagtatcattcaaatcaatcagtcatccacaattccacataaattagcgatctgattggagctaccataatctgcaatctgctgaattgatggagatgtaccaagcaactactgcattgattagccatcattttctgtatcatcaaaacccaccatggtagggagtctaccctctaacgaagaactaacgaagaacaacccgaaattcacagatcgggatgtatactctactatatatatatgaactgtacacctacaaatgcggccacacacaaaaaatgtaccataataagctgaagaaattgcagcagttagttcatcaaaagctcaccaaatttgacaggcaactacccctcctcccttaccccctgccgggacgtcgtcgtcatcatcgcctccgccctcctctgccagcagcgatctcgaggaacgccaccgcgcaggggggctcgatccggtgggctccgcgctgcatgcagggcacgctcccgccgccgtacagggtggcggttctggaagccatcgctgcctccagcagcggccggcggagggtctcggcctctcgggagagggggtactggatcgagaactgaccggaggttttcggcggcgcagcgtggacaattcggcctccccgcgaatccggcagccaccggagcggcagccgagggtcgccgccccggcgaacttctccgcggctgcctgtcagtgtccgccgctgtcttctgcagcgccgccagcgtaagattagttgggccgacgtaattagcagcccatctaacaacatggggcctaattcggttatcgacgtaaaattagcccttgtcatatcccggttactccgtaacctgattaggccgttaacatagattcggctcagattgaaaaatcttcagtacattaaaaaagaaaagcaagtagtcgattttacttctcaactattgggcgaaacaatttttttttaacaagcagaaaattttttattcgcccgaaaaagtaaagaccatgtgttagaaaaaatagtggttatgcactgtagtgtactcccaaaaccacgtgtcaaccagacagaaacaagcctctcggagggaaacctagcacccaatcgatcgttgctaagattggtcgatggtcacagacatacaacaacactatagtgtagagtctccaaacacgacgtgtctccataaaggttatggcatcaaggacacagttgttgtgcatccaaagactgacatgttttcacccattgtttctcaccaaaagaagagaagggaggtagatgacaccccaagggggtcacgcccgcgggcgtcgccgctgctagcttaatgaatcataagactagacttacacttgcaagctctacaggctacaaccttgatcacggtctatcaggctacaaccctgatcacagtctatcgtgcaccatctcagtgcgacttcctgccttccagcgtgagagaaggaatgggaagagaaaaggtaaggatggctcatgcctggtctttggaagggaggtggccaagcaggtcggaactttctacaccgagctggtcctgctcaccgtcggagctcgtactcacactctcgtccactccggtgcggtgccactagctaggaataagttcactttaggtttcttgatttatcgttgagttcaaattaaatccgtccctaaaccgtaatactaggtataacgtgtccctcaatttacaaaagcaatgtacttgaggtcccaaggtagtatagtgcctggtttcggctgatgtggcggctgagtcagaatgggatccacatgttaggacaattcagtataaattaaaaaaaaattggtggctccctctctccttttcttggcagcatcggtgtgggagcaggcactacatgtggcgagcaaggccacaggtcacgggcgacggtgaccggcgatacgtggaggagggtgttaacagcgacggcaaaggagggatggggatcgaacgatgcctccagtggcccagccaaccgattttcccttatctgctctaggccacagctgcagccgaggtaggggaggtagcctaggtcggatgcatcagcggcaccgccgagcttgaggggagaggtggtggcatcgttggagttagtcaccgacgccgagatgctcccaaatccccacgtgacgccaacgagaacgaaatggcaagcgaagagggtggggcaccgttgcaagggagtagaaggcctcgccaatggaggaagggtgggaggatagcgcctcgccatcaagttagggagaggatgggggtggagtaaaggcctctgccgtcgagttagttcctccatggcgatctcgtcctcgcgtgccgcacctactccgcctcgtagcggacgccacgcacataaccctatgttggcaatcgtacctcctaccgctactggagctcgaggcggcgatgtcctcccatgcatagatctcgtcggctcgggcggtctcgtcccctgcgtcgtcgggagcactgccatctgggagtaggcccgcgaggagtgcgctctaagaccaaatgttgagctgcacttgtggcgcggcagagtttagggagatcaagggtgcccccgacggcttgctcctggagctactcctctttctctccccacacgctctcccactgggccatgacactcgcacggagatcaccacgccagcctccgcagtggctacagtgggggtagggatgctacaagaggctgcacatggtggtgcccatcctcgccaccgacgttgccctccaagttgccaatgtcctcgtcatcgtgttagtggagttcctctacccctaattgttgtctagccgggctagacattcgagcacgcctgcatcgatgcgtgcgccgtgctcgccttgtctccgccagtcgtcgtcgctaaaggcgccacgctcaccttctccctgccacctagctatcagatgcagggaaggagaagaagcaagaaaagagaaaagagaaataaagaaaataaggtggggacccactacaattttttatttgtaaccagacactcactaacatgtgggtcccatcaatttttttatattataagtgccacatcaacaccagctaaaacaccatccaaaccgtcttaagacattatttgtactggttttgggagttgcgagagacgtgtcaaatctgatattgtgattcaggaacgaaatttagacgcgccgttgagggacctatagtgaacgcattccccactggctatgctactacccgcagcgatttttttacattttttattaaaatatttacaaacataattttttgtttcaaaaatttacaaatctaattgcctctcaccctctaggagggcgatttttaaaaatcgcccttccaaagggcgataagggacctaaatgcaaattttccagcacagcttgtttgctctatgattttataatttaaaattatattatataaagtcagatgaaataaaaatttatatcaaaattgtagagctcaaggagatctacaactttgtagttaacattttttcatttaagatgttttagatatccaaatattcattataaaataaaaaacctattttaaaaaatctcagatctacatctcaaacgacatcggatggagataaactttatataaaagttgtagatctcgatgagatctataactttgtagtttatcacttttccatttaaaatcatttagagtatcgaatacgtattattagtttttaagcaattaaaaacggtggaaagggtttaaacacaaataaaaaaattgcatttaggtcccttatcgccctctggatccagagcaagagacgactagattgtaaattttctagaaaaaaaagtattttcgtaaatattttaataaaaaaaatgtaaaaataaaaaaaattccaggctcgtttgccaggtgccatcgcctacaggtccgctatatcacgtaaggcccatatcgcgctcctcgtcttgccgtccaagacgtctatagcatcgtgggcccaacccgttgtcgcctactcgcctcctttggatgacggaagacttaccaatccttctcaaagacctttgacccaagcgagccgcgagccgcgacacgcgatgacaaaatggacaaacaacagtgctcacttataaactagcggttaaaaaaggtgaaaccaagtaaccaacatctgcatttgagcagctagctagcaacaaggatagaagaaacgggagctgatggcggacaccgtcaccgtcggcggcggaggagagcaccgggtgcaggtagcagcagccaagccctgcggcgggcagcaacagcaaggcaagaaggcagccgcgccggagaagtggctgaatggcttcgttagcttggtggcgctggtcgagagggtgggcaacgcgctcggcacgctggccttcacctgggctaccgtcgtcctgctcggcggatacccgacgtccctgacggcactcggctcgtacaacgatttttggttcgcgacagccataatcttcctagaatccgccaggttagggcctatttgttctgtttccattgtgttgatttccaatggattggggattttttttctttttttagagaatagtatttttacccggcctatacatctaacatgatacatgtatccttttaaatcgggaacttagtccctcaaacaactcaatctgaattcgctcttatggggatttaaagttggagtgtttctcaggtcactgcaatcggccaatcactagtctgcatacccttttgcaatcgattgggaatacatggcgatcgccgatcagctggaggcggctcctctgccgtcacaacagacaatatgcatcgccataagtttctggattactatatatgatttcatttgctccatacttctaaaaatactatttctcaaaaaaaacactttttatatattgattagaacatttatatctttttataagctatttattaggtttttaacgtatagtaagacttaatctttcctataagcaaattgataatccattaagttaagaaatggtaatccattatttttcattcacaaataatctaaaaggaactctgccttgcacattctttattgtttgaatgattttacagttcttgaggagatatcgggaggtatcacattttttaacgtaaaatttagtatctctcagttccttcaatgctaggaggtataaaaatttctctcaatgcttctcaaggactataaaatttatcttaatgtttacttacacatcctatatacttcaggatgtttagtggcagcaacaacaggtccgattaccaattgttcttccgaaccaaaggtgctttcagacctcttgactggaactggctgatcgccatcgtctgcattctggatgtttggaagctgttgattccccttccccataagaatgttatggcagctgtagtgctttatgctatgataattctgcttatacttggcaagagtatgactccaaagtttcagccatcactacgcaacccgttacgccgtgccatatcactatggagccccttagctgcgatactgttgatgactccagccatgcagcatgaccattcaagggactttgtcaggaacattacaggaaacggatcgataaccacaagaacgggtggcttcgctccaactaggtccacagtagttgccaaatggatagtatttctactattgctggtatccgtcctcgtggtgacaatcagcaggctaaagttcccaagaatcatcaaattgttagatagtgcttggggcagaaaactagtgtcttggcgtcgatctattcagaacatttgcatgcttgctgcgctagtgatggtagtactgactactgatggcttctttcggttcatgataatcgggatgctagtcattgttgctgtgatggtgtcgtcgggcaacttgcagataccagcagcagtcttgcgtgttgtgttcgcaggcctcgcactgtcacaccttatggcactacataagaacaacaaagaagacgaagagactaacctggtaccatctctcattgtcttctatgcgatggtgacggcccaaggaatactctacaccgtggcatgcaccctcgagatcttctcattcatcccccggagatccctcatccggcgtgctggattcagaggtcagctgggagtggaatatgtcaatctgtattatgcatatgccttggagaaatgcatggaaaaggctgtgtttgctccgaagaaaaccagcctgggcaactttgccatggattccctgaactcagactctcccaagaatcatctctatgggattcaactgatgcatagccttctggagaaggagacgacaagggcgcggctccttgaaaagctcatcacttctacaaagaccatggctaggataataagtatgttgggctggactagcccaaattatatgatggtcagattatatgccgcgaaagtaactgctgagcttgcgaaggacctccaagttatcgctgttcctagggcaatgcagcttgtgtctgcccttctggacaccgatggcaaacttaaaaagggaaatccacttctgcaggtagacgatgaacaagaggagaggcaggatcccattctcagcacagcaaatagccaagaggaaagaccgaatgcaattaggaatgcagatgatcccccaaagcaaagacaacaagagacacttcaaggcactgataacctgccggagacacaaactcgatcagcccacatccatgaacagaactgcataatcagaagct

SEQ ID NO: 22934 - DNA, 507 bp, Oryza sativa
atgtatagacaaggatcggatgggatgtttttatttcttatatgtatgggcttcatataaggatgtattgaggattctatggatgtaaggaatgatgttgggattgatggagggatgtatgttttgtatggttctcaggatatagcactgcctgtaatttctgtcatttgatgtttgcctgtgttgtgtgcaaagttttgctgaagttttagcagggctggcacgtcagcgccatgctaaatggcgctgacatgtccaaactcagcgccagtgcacctggcgctgaggtcccagcccagccatccagaaggcttgctgggctgggccacggccgaaacggccaagtcccacctcagcgccagatggactggcgctgagtttcccacagtcagcgccattatggctggcgctgaggtcctagcccgcaagccatccagaaggcttgatgggctgggccaaggccgaaacgcccaagttccacatcagcgccaggttgcctggcgctga

SEQ ID NO: 22935 - DNA, 759 bp, Oryza sativa
tccccttggggagccccagtgcttctggttaagaaaaaggatggctcggagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatctttatggaatacctagaccagtttgtcgtggtgttcatcgatgacatcctgatatactccaagaacgaggaagaacatgctgaacacctgaggctgataatggaaaagctcagagatcatcgactattcgctaaattctcgaaatgcgaattctggttggaccgagtagcatttcttggacacatgatttcctccaacggtgtcgaagtagatcccagcaaggttgaagctgtacttgcttggaacccgcccaagaacgtgtcagagatccgcagcttccttggcttagctggatattatcgaagattcattgaaggattctctaagctagctagacctatgaccgagctgttaaagaaggaaaagaaatttcaatggtctgcagcctgtgaagacagcttccaagaattgaccaaaccgttgaccactgccccagtt

SEQ ID NO: 22936 - DNA, 1312 bp, Oryza sativa
gtacggagtcgacagagaacatacccatcacagcgtctggagcatcctgagcggtttcagcttgaatgtgattcacacggcctcgaccaaagtggttggaagcacgagaaccttgtctacttgcctgagagctaggacgagactgagctgccgctggagtaggagttctggcggtgctgccattagcatgccctgagttggtgttggtaggattctgagggcactgtctagcatagtgacccatctggttgcaccggaaacactgaactgctgacggtccctgtggtgacttgaaagaggtaacactgtttggcgcagtgttgccactaggggcacactgctgtggcggaggtgccggacggttcatctgagggcgaggggtgtagcctggctggcggttagcctgggtgaccgactggtggtattgcatgggttgaccatagcgagggcgaggtgtgcctcgggaagaatttccctgatggttagacttgcgtttcttgtattcttcggtagcctcttttctggcatcctcaagcagaagtgccttgttgatcatatgttgaaaagtggggaagtcatgagcaagcaactggagtctcattccaactgcgattcccttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggcaggtcctcttagttggtgaaaggcgtagagcatcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgaggatggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgtgttgcgggaaacagt

SEQ ID NO: 22937 - DNA, 6256 bp, Oryza sativa
gcgtaattcttctgacggttctgtgctgtcttcaaacgttctcgtatcagcttaacttgttcttctgctaacttgagtatgtcaggaccgaataccagtgcttcgcccacctcattccagcataagggagtgcggcactttcttccgaacattgcctcgttcggcgacatctgaatgctggcctaatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagagcttcatgcaactgcttccagaaccttgaggtgaactgagtgcctcgatctgacacaattttcttgggacagccaaatctacatacgacatgggtcatgtagagttctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgctctgccttgactctttggcaaatgtcacacaaggctacgtattccgcgacatctcgcttcattccggcccaccagaagtatgccttgatatcttggtacatcttcgtacttcctgggtgaatggagtaggtggactcatgagcttcctttaggatgagatctcttaactccttcttggccggtacacagatgcgtggaccgcaccaaactgtgccttgatcgtctatggagaaattggtgtctttcttctcctgtattctttttatcaactcttttatcccttcgtcgtctttctgagcttcccggatttgcgactctagggtaggctgtactgtcaagctggcagggacacctgactgtaccacggtcagccttaacttctctaattctctgcacaagtgatcttggtcaggccgtatttgagctacattgcaataggccttgcgacttagcgcatcagcgaccacgttggctttaccaggatgatagtggattccaagatcgtaatccttaattagttccaaccatcttctctgtctcatatttaactcggtctgtgtgaaaatatacttaagacttttgtgatcggtgtatacttcacatctgttcccgattaaataatgcctccagatcttaagagcatgaaccacggctgccaactcaagatcatgggtgggataattgacttcatgaggcctgagctgcctggatgcataggccacaacctttcgttcctgcattacgacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaatccttcaatgaatcttcgataatatccagctaagccaaggaaactgcgaatctctgacacattcttgggcgggttccaagcaagtacagcttcaaccttgctgggatctacttcaacaccgttgggggagatcacgtgtccaagaaatgctactcggtctaaccagaattcgcatttcgagaattttgcgaatagttgatggtccctgagcttttccattatcaacctcaggtgttcagcatgttcttcctcgttcttagagtatatcagaatgtcatcgatgaataccacgacaaactggtccaggtattccatgaagattttgctcattaagttcatgaagaatgctggagcattggtgagtccgaaggacataactgtgaactcatatagaccataacgcgttgagaaagcggtcttcggaatatcttcagatctgattttcagttgatggtaacctgacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagtactggggctccccaaggggatgagctaggtcgcacataacctttactctccaactcttcgatttgtcttttaacttctgctaactcattagctgccattcggtagggtctttttgcaattggagctgtgcctggtgccagttctatggcgaactcgatctctcggtctggtggcattcttgttaattcttccagaaatacgtcgggatattcatagactatgggcaccgactccaaggaggtgacttgtaaacaggttaggatagaccgacttgcggtaggggtgttaggggtaaagcggacttgctttcctgcaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattcctcccaggggaatgtactatcattggtacacgcaatttttgggttttccaaccatttcttttcacaaaagcttgcgatatgaaagaatgggaagctcccgaatcgaacagaactattgcgggtacggagtcgacagagaacatacccatcacagcgtctggagcatcctgagcggtttcagcttgaatgtgattcacacggcctcgaccaaagtggttggaagcacgagaaccttgtctacttgcctgagagctaggacgagactgagctgccgctggagtaggagttctggcagtgctgccattagcatgccctgagttggtgttggtaggattctgaggacactgtctagcatagtgacccatctggttgcaccggaaacactgaactgctgacggtccctgcggtgacttgaaagaggtaacactgttaggcgcagtatcgctactaggggcacgctgctgtggctgaggtgccggacggtttatctgaggacgaggggcgtagcctggctggcggttagcctgggtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgatttctttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcgaactcatcccaagcaatgttagtgggttcagggtgtgcattgcagtaattctcccaccaatctgcggtaggtcctcttagttggtgagaggcgtagagcgtcttctcaacaggagtacactgcactaagttgagttttctatcaacatctttcaaccaatcgtcagcctcgacgggctcgacggtctgagagaactctagcggacgagacctcaaaaagtctgtcagcttggatctgttgttgcccatgtgagggtggccatttccatgcgcattatgctgaaaactggctatggctgtggttagtccttgcaagatttgtgtctgaactgccattaagtgttgcatgttggtttccacatgaggtggggaagggaggcgttcttctccagaattgtgactggcagtgcggtgagagcggtgagactgttccatctctgcatcacgggaaactgtgcgatgcgagcggctgctgcggcggggttgctcaacctctgtgttgcgggaaacagtacgatgcgaacggttgctgtggtgagactgctcattagctgattcatgattttcttctggctcaactctaccatcctcaaaaccaaagcgggctggtgcacgagctgcacggcggggacggctagccatctaaactcccagaagagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcggtaagcctcaaggagtaggtcgtgctgagtggcctgagcctccgaaagctcgaccatgcgagtcagcactggctgagactcgctgtacggacaagggtacctggcgtctgagtggccagagggaaggtgtggaagctgccggaaggcggaacctccgagacggtggctgtagtcgtgggccaggcgacgaagcgcagtccaggagaggtcctggtacgcgatctggagagtgggcctggccacagtgaagtggtgggggcaaaggccagctccgtgtatacctccacgggggtaaaggtacaccgagagctcacagtgagggggaacacggtccacggagtaccccgtgtactcgggacatgagaagccaaggaaacgggcgaggtcacgaagctgggcgacgtggtgaccctcaccaaaaccgtgggaactgaagctggcgttcactgccatctacaattttgaaagagggagaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagtcccgaccggaactagcccgtgacgctccaatttaacctgttaatcgataccagtcccaggaaacagtgctggtatcacagggagacagaatatcacagcaacagaggtctctttattatagagtagaggtacagtcatgttgggctgcggacagatcccgagcttacaactgcattacaaaaggaaaacggaagccaggacttggaccaatcaacacaggcgcgacttgggaactaggccgaaaccctaaaactcatcgtagccgacttgctcctagaagaactcctcatcagcaggatccacttcatcttcttcagcaactgggggggattatttatatagagcaagggtgagtacgggagtactcagcaagccaggggaaataagtgtttaatgcaggcttcaagggaaggctgctgtttttgcaattgattttatttgaactcttttctgaaaacaactaagtgcttctcaaacgacacgaatgagacagtgcatctcgtccggtcggagtatgtgcaatgtatcaatctttaggaatgaacaccgttgg

SEQ ID NO: 22938 - DNA, 10505 bp, Oryza sativa
tataataatccgcaaatctccatataacagcattaaacttcggatgatcatatcttggtcatacccgctccgaaccgacccgttcaagtctcttaatgtttgttataacctaaagaaccatgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatccttgaacatattgagtcccagtttataaaattatgttgatttaaattattgcattatcgctttatttaaattcccgcgttatcactgttttatctagccatgcctatttacctttgttatgaccttattattgctattgttattattaccttgttcaccctaggaaaacaaaaccccaactagtgggtactctattcatggttccactagtatgaatttaggtagatgcttcgctgattaataggacaacactaggtggtttttataactttagactttgggaattctcatatcatttgaacactatggaatggttggcttatggtggaattggacatacacctctcttcctctttcaaaacccctaaaacctgttttccggtggggtttgggtgcatgctagttgtgggaagtagcaccccggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgtgacagcgcggacgttgtcgcggcggcggggcggcgcagcaccgagagggcgtggccggggaagaagagaggggggcgtggttgagacggcccggtgacggtgaggcgacgttccagatcgcggcagtggcggccaacgacaaaggagacatccgtgcgccgtggttggccgcgcgacggcgatgcgactttgtggtggtgcggcggcggagagtggaggcgtgggttttataggcggcggggagctttgagaggaagggactaagcacgggcggtcggttcaaaccgaccttggggcggtcggttcacgggaggcgcgagaacgagcgacggcgtggatgcgaaggaccatggaggcggtggatcggatggtggaaatcgaaccgcgagcacgggctggcatggctcggcgtggtcaaggtgggggcgtcgagctgctgcagcggcgttagcggctctgcctccgagcgcaagcggccaaggggtggagacagggcgccattgcccgggaggggaaaaggaagggaggacggtggaaagggggacttgccccttccgtttttgggcgaggaagctggtgtggcgcggtttcttggtcggccacgaccgtttcgtgcgcgggaatcgaaggcggtggccgatttttgggcagcgtcggcgggagtcaacgagagagagagagaacgaccgagaaagaaaaggggagagacggcgctctctctgtggggatcacgtgcagcacacgcggagatggagtgggacgaagggagagttgggccggggagggtgaaaacggcccaaagatcaacggaggaagattagactttttcagggaagtcgatattgagggatttttgtatttaaaatcgaatggggatttgaattcaaattcaacatttgaactcagcaaaatacggaggagccaaggaatggattcaaggtggactcagttatttctggattcgggagaagtatttggcgaggattcaagagaggcgattgacctttggaataattaaattggaattagaatcttgaggcgggggattttgatatcgatgagagggaacgacgggaatttgaattgagatcttggcacaacttagactcgcacacaaagaacgaaaactttcgcatataggattttgccgaattagtttttaacgtctcgcgaaaagtggagcgttacactcgtcccgcccggatccggcagcggcgtgcctcgtcttgcccggatccggcggcggcctcgggcgcagagtgccacggcgacctcgggcggcggcgccaccaccatctcctcctcaccgccgccgccgacgacgtggaggaagcgacgggccatattcggcggcgccggtcctcgtcccactcggatacggaggcggtaggactcgtcccatccggatccggcggcggccttgggcgaagagtgtcgcgatgacctcgggaggcgggagcggccagcggtgggagcggcagcggcaccggggtgggtggcggtgggagcggggccgggtggcggcggtgggagtggggacgggcggcggctggagcggccagcgagctcgggtggcggctagggtttcttgtttttttgaattttttttgaattttttttggtgatttttctctttgcatgtggtcggcttaaccatctgcatacgaaaatcagatttttcgcatgcgggtgccctggccgcatgcaaagatgacgatctttgcagacaatttggcgcatgtggctggcccagccgcatgcgaaaatcgttgccggccgtatgaaaaaacgaattcttgtagtagtacagtgttactaaatttcactgttaacatcaggatctagatctcgagcatagccggggaagtggtgtgggaatgatatcctccaagatcattctgctcctgccaccaccgccttcctcgtttgcaaccgtcacaactttgccgctgcggacgcagtggtggggcacgaccaggcctatatatgacatcggtgatcagctttagcattctcaaattaattagaaacacagtctttttagggaaaaaatttaaatgatagaaaaatatataatgtttttcgatggaggtagtacaaacgttaaatttcgagtgtttggttgtcggtgaatgaacaccggtagtgagaatccggtgaaatttcgtttgggtttggctaagggatgaacacattgtgttaccttgggtgcctcgatcggaatgaaaaggtagatggagaattaagtacgtgttgcacgtgcagcttcagcaccaagattcggcggcggaataacctgctctactctgtacgtagcagcaagagatttgaaggagtgtaacttgcttgctcagtggtagcaaagcaggccaaccgctggagacgcctgtcaccgtacgtgtaccgaccgcgtgaacccgagcctctgagcagagtacaccgcgcgggcggtcgtagctcgtctcgccacgccacgcccgcaccacgagcaacgcaaaccgctttgcatgcatggctcaatcccgtttcccgtacgtacgtgcatcgccttgatcataagttgataacacacaccgtacgttcctatataccaaaaggtctcgtccgtcgaccataaccgatcgaggtccaagctggtggagaaaggggctttactctcggttgggaaccccctatagtcccagttatataaccggaactacgaatccgggactaaagatagtctcggttgattctttttttttttgttgttgtttctttgctcaaatcgatctgctccctaaatatctcaaatcatccacaagcatcacagatttgggaagaaatacatcacatattgcaaagaaatgcatcacagatcacaaatacatcacatcacaaaatctcaaacaaaaaatacatcacaaatactaaaagaactgcatcataactcaaatacatcccagatcacatccaatatcacatgcatcacagatcaaatctaatgaaacacaaaataaaaaaaaaatcggcagagcagatggggatggcgccgccggcctcccggtccccgccctctcggcgtccgcgccagctgtcacgccccgaactagtcccgaccggaactagcccgtgacgctccaaattaacctgttaatcgataccagtcccaggaaacagtgctggtatcacagggagacagagtatcacagcaacagaggtttctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactccttgtcagcaggatccacttcatcttcttcagcaactgggggggattatttatatagagcaagggtgagtacgggagtactcagcaagccaggggaaataagtgtttgatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtgtcagtctttaggattgcaacaaggttggcacccggccaacagcttttcaaacggccacccgggccaacaacttttcaaacggccacccgggcctagctgatcccatcagctgcagatttttcaaacatcgaaccccttttcacaacagcaatttcacaagcagtggttagacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggcgcaactgggtggttacaaggggacatggtataacaattaacaaaggaaggatccaatgcaacaaattaggtaggtttgccaatctgccttgcagacgggacaacagattaagtgtgatcctatcaatgcataatatttcgcaagcaatataattaaatttcaaatataggctcaagatgttcaaaggtggcttgccttgctcgagatctggagcttgatcctcgaaatcctcgcacagcgggtcttcgggctctgaaactatacgcgaaacagaacaactcaacaaacggcgaaaataaagccctattaaagacctctaagcgtgccattagatagatctcgagatttgaggaattttggaagttgaacggagtcaatcggatttacggttgggaagatattgaatttctaagattattggatttttggtctaaaggaaaaaggatttaattaaatcctttttgaaaaagaaaagaaaagaaagaacagagggatggaaattagacttttcctcgggcggctagggcgcggtccaaggtaaatggagcggcttggccgagcttaacgggccggccggcccaagacggcccaagcgcgcatgcgcgcgggagggaggagagagaatccggtggaccgggctcaccacgcgcggtcccgggtgggacccgcttgtcagcggctcggctcaccgtgcggagggagtacgtggctcatgcgcgcgggcggggaaaggacgcggtgcacgcgcgcggtccgtggtggacgcaggtgcggcgggcccacgcgcagcctcacggctcgcggtggaacacgcgcacggagagggactgaccggggtcggctcgatccggtctaggctaagctggcgccgatgtggcgcctacgtggcggccacgtgggctggcgggaggtagacgacgacccggccgcgaatggacggcgggcggcggcggcgagcggcggagcgaaccacggcgatacgggcaaaagcgtgcacaccgggcggttgctcgtgacaaggggagacgagccaacagctcggattcgccggaggttgctcgacggcagcggattgcggcggcggcaaccggcggcgggagaaaagggaaacggcgacgaggtcacgagaggtcgattcccggcggtgagagcatctatgcggcttcgggaactcgacgctagcgtcggattgggcggaactacgccgagcgaggccggcgacgagcgggtgctacggagctcgagcggcgacggtggcgaacacacggcgagcgacggcaacggtccgggcggcgccggctaactacggggaggctactcaagctactaccgaaatctagggggggagatggagcgaggaggaagaacggagagaggcactaccgtgcgggtcggggcgctgtgacgagaggccgacggcgcgggagtaatctctccggcctcgggccgaggaagaggaagaagagggcgcggccgaagtccccttccgcgtcctcgaacgcaccggctatcccggcgcttggcgaaggacggcggaggcgagacagagcacgggggcggcggcaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaagtgacgccggcgagaggggaaaaaggggagaaaaagaggaaaaggagggagagaaagggggctcgcccctttgccgattcgggaaaaggaggagggagcggggcgactcggcagagggagaggggctctctgcctccgccccttggaggctagcgcgcggagtggcgggggccgggcgatgacgacggcgatgacggcggggcggtttggagcggcgcgacgacacgggcgacaggcgcgggctggcgcggcagagggtgacggcggcggcgaccgggcggtcggccactcggcacgcgcgcgcgggaaacaacgggtggcacggctgggcagcgggaccgggcgacgcggacggcgtagacgacgcggctcgggcgggaaaccacgcgggcgcgcgcgcgagcgacggcgcgcggggccggttttgcgagcggggagctcgcgcgagaggagggggcgctcggcgtggctctcgcacgcgcgagcagcgagcgggggggagaaacgcgccggggaaagcgagagagagagagagagagagccggggaagagatgggccgagcggaattcggcccatcgaacccgggggaagcaaactagacttttgcggagggattcgatttggaaggaattggattcggaattgaactcgacgatagatcggggattgagatcttgagatggcacggacactagacaacaagcaaaaaaaacaaatttcgcaattagggtttttaagagatgattttcccgctaggcgccacgacggaacgggcgctacagaccaacccccctaacaagaatctcgaccccgagattcagcacctaagggagcaggtccgggaactcggcgcggagaagatcttctcgctcccaggttgtctcgtcttcggaatgattgctccattggactttgtagaacttgatggtcttccttcgagtctgacgttctgtctcttcaagaaccttgatcggtctttccttgtaggtcagattcttttctagctcgatattacccaggggaacttgctcttctggaactcgaagacatttctttaactgggatacgtggaacacgttgtgcatatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcatgccttcgattgtcagcgtaattcttctgacggttctgtgctgtcttcaaacgttctcgtatcagcttaacttgtacttctgctgacttgagtatgtcaggaccgaatatcagcgcttcgcccacctcattccagcataagggagtgcggcactttcttccgaacattgcctcgttcggcgacatctgaatgctggcctaatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagggcttcatgcaactggttccagaaccttgaggtgaactgagtgcctcggtctgacacaattttcttgggacagccaaatctacatacgacgtgggtcatgtagagatctgctagtttctttccatcataggtggttttcactggcacgaaatgagctgatttcgtgagtcggtccacgattacccaaatggagtcgtacccgttgggggttcttggcaaaccggtgatgaaatccattccgatctcttcccatttccactcgggaatcggtaggggttgcagcagaccagctggcctctgatgttccggcttgactctttggcaaatgtcacacagggctacgtattctgcgacgtctcgcttcattccagcccaccagaagtatgccttgatatcttggtacatctttgtacttcctgggtgaatggagtaggcggactcatgagcttcctttaggatgagatctcttaactccttcttggccggtacacagatgcgtggtccgcaccaaactgtgccttgatcgtctgtggagaaatttgtgtctttcttctcctgtattctttttattaattcttttatcccttcgtcgtctttctgagcctcccggatttgcgactctagggtaggctgtactgtcaagctggcagggacacctgactgtaccatggtcagtcttaacttcaccaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaaaaagtgcctcca

SEQ ID NO: 22939 - DNA, 7189 bp, Oryza sativa
agaggggaggagatcgagaggagatggcgcgcggctctcggggtagtctttactcccgttggtataaacaaccgggacactaagaagtcccggttgtttataccaaccgggagtaaaaataatcgtgatctgtcttgaacccgacaactttttgaaccgggactaaaaatgatttttagttccggttggtattatcaaccgggactaaagatcaaaagtacccctcaacttttcaacgggactaaagatgctttttagtcccggtttttattagaaccagaactattgtagaatttggctgaccgaccaaagatggtttctccaccagtgtaaccaaccctgtacatatgtgtgccacgtacgtactgcaccgagttagccatcatggacagctcaaccacccaggcaagttcctgtgcacggatcgagttggccgccatcgccacgatttaattactccaatttgtaactgttaaaatacatttttagatacgtaccacaaagtatttcattattcggatcctaaattgccatgacacccctccaagattctacgtgacgtttatgtgacatatataccatatgaacgataaagtaacatgccacgtaaacatcctagtcctaaattttctttttcttctatttcctcccctctgcattttccttgtcttgttttttttttctctggccgagctgtcgacgaggaggggggcccgccacgcggtgagacgcgagggacgaagcagtgcgagcgtaccggaagtggatcgcttgcagaggagaagcgacgaggacaaggttggcggctgatctcgtgaacggggaatctcgacgtacgacacaacggcgggagatcgggaggctagcttagctgtggcagcgcgggagacgcgggagcttgacgaggcaacgccgccgccatgcgtggagctcggcctccatatatatatatatatgccgctcgattcgggcgtcacgtacgtacgccgatgacgccgcggagaggaacgcgaatgcatgcgcatgctgcaggagcaaattaacgttgcgtacgctcgcgtacatgcatgcgccgcccgcgcccgcccggccggatcggaccgcgtctgccaagagggactgagggagtgcgccgctcagaaagattacaagtagcaagttgaatatatgccttgattctccaagatttctcttggagatttcttgtccgccaaactttttcttctttacttctttgtcgccgatgccagcgcaagcaatccaaattggcgcatgattgcgatcgattgttgccgcgcggaaatatacatttccattaatttttatcgtaaaatatattgaaggcgcttctccatctgtctattagccaatcacgggcgttccccggccttttcctaggtttgaagaaagaagaaatgagaaagctcattaccatataattaattaagtattaactattataaaattagaaaatggattttttttaaaaaacaacttttatatataaaaaagcttcgcaaaagacacaccatttaatatttaaaaaaacatgctaacagagaaaagagcatgttaaagaaaataacaggaccacaattatctatcatttaatttatctgcctacttctcatataaatcaataacactaattttatttcagttctttaatttactttatagaaaaactccagaaaatgcttatattttggtttagtactcctatatttttgtttatgttcatgtgcaaccaatttttgtatatcggtaaaattcagacatggaaccaatatttccactcttccttcttcttcatctcctctaacttccatagaggtgaggaagaaattatggaggaaaacaatggcagatgggatccataagttgatttggccagccaatggggtcaaagctgcattaaaagtaagacggaatcgcctcccaaaccactaaaggaggaacaaacgtacaatggtcaaagctgcacttaattagacgtatggctaattaagtacggacaaacgtacaatgctcgctggttgtgtctctgcttacctggatcgaccgatcgagctaacatcgccgatggacactggttaagaatgataccaggtgaaacggtaaatgcgtcaatccgatccagcagacatggtcaacgtcaacccagcacagacagacagacttggtatatatcctcgaccatcttgaaatccctatagagaactcgtcatcgtcctcacataaaccgatctgttggcgagttcgatcatccgagatcttcatctcactttttggaaaagaccgaaatttcatgattcttagagctttcttgcaggaattatttaaacttataactgaatctgaataaataattttgaccaaattcacagaaaattagaaaaattcgagaacttcttttaacacttaacttgagatagtggctagattgcccggggtgggttttgatactgatctcaccttcttttatcacttaacttgtgacaaatttaactatcatatattctatgaaaggtttatcaaattattatcatatatcatctattctgtggaatctattctatggaaggtttactaaattattgtcatatataatctgtagcacggctgcctacctacttttactttttttttccctccaattattctaggacgtcacgactatagttggccataaggcccgaggcccgacggcctagcccagggcatgagattttgacccagcccacgcaccgcatggcccaatccctgttgggcccgtgtcagcacgacccggctattgggtcgtgccgaggcctatgccttggcacagtgggtcggcccggcacagcacaaagtttagggaggtgaaatagacttattttcagccatatgtatagagggcacacagaatagggaggacaaatagatgtattatatgcatggcacagcccaaagagtagggacgtaaaatagacatattttagctatatatatgtcacaacccaaagatgagggaggggaaatagacttatttcaaagaaagcacgatgagctgcctgtgccttggccgtgcctgggccataggtggagcacgtgggccggcacggcacggcacggctcggcgtgtaggtcgggccgtgccgcgcggcctgacaaatcttggcccgagcatgatcaggcctaggccgtgttgggccgggcagcccatttggccatttatagtcacgactcacaaccagacattttcaatcctgaactttcttaaccggacgaattaccctctcgtttaacaacaaggttgttttagtccttggtgacgcagatgaggcaatgtattaaccatgtgaaaatcagtcaacaacttaataacataaatattcttaaaattagggtggcctagctgtcatactcacagccccgtttcttccgcctctctctctctctcaacctcaacctcaacagaagtaggtaggatgtaacgataacctccacgagatacggaaggaatgtcgcaacgccctccagagttggccaaggaaggtggcagccatgtcctctaggagtcggaacagaaaggtggcagtaccactaccacccgtgacgcgccgcattgagttaggggaggagaggatatcgatggggtagaaggggcggcgctatgtgagatggtggcaggagggggttgaggtggtggtctataggaggaaggcgaaggcggcaacgaggggctaccaacgccgtggtgttggcgataaaaattatgtagaagcaaggtggtggggggaggcgcgcgccgatggggaggaagcgcatgatagtgctattgacctaccaaccggtgttgtttgtctacgggctcccattttctcactatttttccgttcgatgcaaattcaacgctacagaatgggctgaaaaattcaaatttattatttataaaaaaatgatacgcttacacactactggatacgtttacacactagctagacagtacaatactacatctttattttagatatataatagatagggcatcatgacatgcagatatctatcgcgttagtagggcctttcgttcttcatgttaccacgcgggaagtagttgcaagcgatgatggtgccgatgccgttggtattgcaggcgacgcgggcgcagccgacgtacgccgtgcgcctccacaccacctgcgtgtagtgcgtgcagccgagctcgcccgccgagcagtagttgctgtcgtagtagtactttgccttctcggcgagccagtagctcatggcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccacccgcccgacgcccaccgccgcgcgggcgctgttgtggaggttgacgaaggccgccttctcgtcttccgagaattgttgcgccgtcgtggtcgtggccatgataatcatggcgaaagccgccatgaccaccaccatcatctttgctgatgctgatctctccattcagtttttcagctcctcgctgattcacgaattgttgctgcaacaagctattaagctatatacctctcgctagctagctagactccagtatgagattaacgcatgcaattaggcagtatttataggcggatcgatatgatacacagggtgatctcaacacgtacggctaataattaagtactataacatatgatgctctctggtacgtagtctctcagcaaaaatacctcgagctgacatggaccgatgcacactggttaggaatatgatgatataccaggtgaaacggtaaacgcgcgcgtcaatccgatccagccagcagacaaggtaattaaacgtcaattctcagcagacagacttggtatatatcctcggccattttgaaatccctatgtgtagaactcgtcatcgtcctcacatacaccgatccgtgttgccgacttggatcatccgatcggatgatcgttggtcacccacggtttacacgtacttttcagagaaagaacgaaatttggtcagcaaaatttcgtaattttcgggattttcataacatttttcacgaaattctttcctttaattgaatttaaataaattttgatcaaattaaaaaaaatagtgatttctgcagaccttttcgtgcatgcgggcccgccaaccgcatggtaaaactggttctagccgtatgcaaaaaccttctattgtatgaaagttttattaaattattaccatatatcatctattctgtggaatatattctatgaaaggattaataaattatttatatatataatcgatagcacggctgcctacctatttttgcttttttttccctccaattattctgggacgtcacaactcacaaccaaacgttttcaaccatgaactttcttaactagacgaattacctccacgttcaacaacaaggttgttttagtccttgttgacacagatgtgatgatgtattaaccatgtgaaaatcggtcaacaacttaattacataaatatttctaaaattagggtggcctagctgtcatactcatagccccgtttcttccgtctctctctctctctcaacaacagtaggtaggatggggaaactattctaatccctcgaggggatgttcctcatttgcttaaaaaccatctaaacggttatgaaaaattctgaaaaaatttgacaacattcatacaacacatatagacaactacacaaaatcttaagtgcaaacttaactcacacgtcgagatataaaaaaattcaaattcagcgtatgaatagtagcatactgtttatatctaaatttgtcttttttgtttctcgatgtgtagatcaaatttgaacttgaattttgatggactaataggtatcattatactctacattgtcatttttctttcagaatttttcacaactatttgcattgaatttagaagaaaaatgtatacgaggggatatccccctcgagggattagaatccacttctggtaggatgtgacggtaacctccacgagctaggggaggaatgccacagcgccctccagagttggttgaggaaggcggcggccatgtcctctaggagtcggtacaggaaggtggtagcaccactaccacccgtgatacgccgcattgagctagggaaggagagtaaatcgatagggttagaggggtggcgccttgtgaggtgggggaggagtgggtggtcgagtgcggcagcagcgacggcaagaggggtttgaggtggtggtctgggaggtaggcgaggggtgcaatgaggggctacaaccgtccacctctgtggtgtcggcgacagcggattctgcatgagcaagagggacgcgccgatggggaggaagcggatcgatgatagtgctacgggtccatcaattggtgctatttgtctacgggctcccattttcccatcattttgtcgtttgatgcaaaataaacgctccacagaatggaccgaaggattcaaaattttcaagcaattacttttaacttcaacatgcacttttcctgggcaattaatttagcaaatccgtacttatttatttattatttatgtaaaaaaatacatacgtttacacactactggatacacacacgtagagaatactacatcattattttacataatagatagggcaacatgacatgtgcagatatctatctatctagtagggcctctcgttgtatatgttgccacccgggtagtagttgcaagcgatgatggtgccgatgccgttgttggtgttgcaggcgacgcgggcgcagccgacgtacgccgtgcgcctccacaccacctgcgtgtagtggcggcactcgcggccgccgcagctgttgctgctgtagtcgtagtacggcttctcccccacccagtagctcatcgcgtcggccggcgtcccggtggtgccggcgccgtagctccaccacaggttctcgccgtagggccccgggatgtgctgcgtctggcagtagcgcgcgtgctgcagggcctgcgccgccagcgcgtcgttccacgccaccggcccgacgcccaccgccgcccgggcgttgttgtggagctggacgaagaccgccttctcgtttgccgagaattcttgggccgtcgtggtg

SEQ ID NO: 22940 - DNA, 17908 bp, Oryza sativa
ctaataattaagtactatacaaacatatgatgctctctggtagtctctccatctgcaaaaacctcgagctgacatcgaccgatgcacactggttaggaatatgatgataccaggtgaaacggtcaatccgatccagcagacaaggtaaactaacgtcaattcagcagacagacttgcatggtatatatcctcggccattttgaaatctctatgtatcgtacgtacgtcatcgtcctgacataaaccaatctgcttatgttgccaagttggatatgatcatcgattcgatcggatgatcaccgaatttcggtggtcacccacggtttacacttttcatgaaagaccgcattttggtggtcaccaaaagttcatgatttttgggattttcataacatctttcacgaaattctttgaaattttaactgaatttcaattaattttgaccaaattcacaagaaaatccaataaattcaggctagatagttgcttgccgagcgattcgaaattacaaaaggtctgaaccgaaacctaaataactgaaatcaccctgttttaacacttgtggcaaatttaattactatcatcgatgaaaggtttatttttgtacaagattacaaatctctttagttttcagtataacagatatctggtaaccttgagctcgtaagtgccagatctagacaccgagagggcttatactggtctgcaacaggttttggcaaaatgtggggtagtgatggcaacgggtactgcccaatattctgttcaggtgaagataactatcgatttttaacttgacacacacgatccgagccctgcaatcgctgcaccaagtatcatttggttatcaaccgtaccgaaactcgattaacctcgccgagaaggctaatccctgcacgcgaatcgaataacacaagtaaaaacaagaaagacaatagttcaattgcagataaatgattaatcaagaactcgaagttgaggttccacaaaccgatgaacggcgaaattgtaatggccgaaataatctaagcaaaaccacactctaaactatgattgtgttaacaccaaaatttgatacggttctttagagaattcagttaaggaaagaaatcgattggtagatggaagtttctcaagatcaagctgaattcgagaaatcatgaagaccatggtaaggcagtttcatatagttaatatatctcttaaataggcaaaattagttattttccttttcttgttaggagtcttgtctcatgtctgatctcttgtatcaactcaagggtataaatatatacacccgggtctttgtaaattatccacaaaacaatacaattatatttcgctgcatcgtcaaccattcgatgagttcttttttccgagtagggctgcattggttaaattcgatctccagcgagaaagtaaatttcgcttgtataataagcgaggaagaaaaaaatgcacctttgtttgatgaatatatgttgtaaccatggtcatattcctggtggtgatgatgacctcatcaggtagtacaacattgacggacacaatgcataagcgaactctccaaacaaaaacctttttgatcagactccagtagaaacacttcagaaaatcaggcatcccacatatggaatccaaactatgtatgaagtggtccatgtatatatatggcacgtgattttaattacgtattaacttttaaagttaatttgtttacggctggatggattgtcaaacccaatacactgtctagctaattaatctcttgtaagacaaactgcctagctagttaattactatgggcaccaggactatataactgtaatcttcaatgtttccgatgaatgacgttggaggttgaaattatcaaatgggatacacacgttctcttttggaacctgcagtggttagcaggttatatgatctgctatttttctttctgaaagtgatgtatcaatcaagttgcaattactttcgggttattcaactactctgatatatatataaaacaataaagtacacatcgatcggtgggcggtaattaatcaaaagaatgtgaaaatcaaatctgaagtcatggtgtattgcgtgtgagtagataaagggatgcgttgcattgttcaaatttgagacttcagattgatccaccgaatgacgattttaggtggccggcccattttatcatagaaagtgagtcgatcggtacaagagaagagataaaaaggagatggatttttatctctcgagaatatttcctcgtttcttacatccataaaaaccacaaaacatttttaaaaaactggcaatacatgctagctcgttcaaattcttagaagttgaatttgaacatgttttttctaagagttatatatctcatattaatatatcttgttatttttttaatcttttatgactattgaggtgacatgcaataatcccctcgagggatcaacaaattaagctggaagcggtattgttctataaagcctctacgaaaataggattgtcctcggtgatttcttaagacgtctatctgagataatttatcaaagctttattcgtttctcgattgtggttccttgaaaggaccacatatatgttagaatgattttctctaggctgcccatagacacatgtggaaatccggccctaagtaacaagtgggtttcgtacgattgtgtaaatagggcaccattcacatgcaaaaatagttgtgtacaattgcaagtagggtagagaaggaagatacaaaataatctattaagaaggtatataatgtctcgatacaaaacaatgttgtattataattttatctaccatatactctaacacggtgtttaacactgtataacttgcttgatatattattgcatggcttgagttcgaaaataaaaatcatgcaaagcagtagaaggaaattccaatatcataaatactattgcccgggatacagtctagggacaggataccttaatagtgaaccattatattccatcgatgtagatccgtttatccaccgtctttctctcaaccaatcgttctgtccttctccttcctccctcctcatactcccccattcacatcgatcctttctccgatcgccggaggaccaatcactcttcctacaccagatcgagaggccctagtgagagtatggatgccgacgaggtcacacggatcaatcagaattggtgaggtcaataaagtgtgaggctattgcggtggtgaggtcactgttgtcatcgttgaggagaaagaagagggaagacacggggcggagggggacaaggtctgaggcaccggtgatacggcggaggcggtcattctaggcatggagttgacaaagcggacagggggtggtcacaaggtacttctcatcacctctttgatgctcatctgtattgtctaccggtatgccatcctcggctgatgccatgtattgggcatgatatctcggggtatcacggatgttacctgctggtattaggcttggtttctaggtaccagggtttggtacccaagtatcagctagtacacataggtaccaggtaccaaggctaccaagtttcatgtatcagttagagcaagtataatagtacttcctcaatcggtgataacaacagccacatcatccttgtattacatggagggagaaaacatgaaaacaaacggagcgagtgcttgttgaagcgtcgggtgatagcacgataatttaggcggtatgaaatattttgtatgctttgtgggcatttggttcaattcgtttcatttaattaattatgatatgcatatcgctgacactaatgtcagtctatgatataatgtttccaaccgtgtctgcacgcacgtataaagccaagttggtcatttatcaaacatattagattggtttattaaaatgcttatattttaggacagacgaaatagtaacaaaatcctttatttatcatagtaagtacgaataatttacaatatatattttacagcgacgtcgtttattccatatacatatctgatgatgcgtacatgcatatatgtagacatatataggcgcgcgcacacacacaatccggctacatagatatatatctgactaaattaagtactcacttaattatatatagttactagaaaatatatatatagtctgctagtaagggcgctgatcgggccagttgccgggcggggaatagttgcagctgatgatgacgccgccgccgttgctgcaggcggcgctcgcgcagccgatcgacgtcgtgctccgccacaccacctgcgtgtagtggccgcactccagcagcgcccccctcgtgcacgtgttgctgctgtacacgtagtccgccttctcctccatccatttgctgaccgcggccgccgccgtcgccgcgctgctgccggcggcggccgggccgtacaggttctcgccgtagcccaggtcctcgctgttggagtgcgcgaggctgcaggtggtggcggcggcgagctgcgccacgtagctctccgcgaacgcctgcagcgtcgtgctccacgccacgtcggggaggccggcgccctcgccgcgccgggcggcgttgtgggcgtcgaggaagtcctgcggcgagctctgcgccgccgccgtgctggccgccatggccagcgtcgccgccgccagcagcacgagggcaaaggctttctgcgccatgctaattaagctaagcgctatatgagtagctgctaatgtgtgtgttgtacttcgatgtgtgttgcttgctgagggtatttatagctgaatcaggagagctagcttagctcatcgattgcatcaattgcatgcaataccatggctgattgcactaccaatatactccctctgtttcaaaatatttgacaccgttgactttttagtatgtgtttgacaattcgtcttattcaaaaaaatttaggtcatatcatttgattcattgttaaatatactttcatgtacacatatagttttacacatttcatattttttttaataaggtgaacggtcaaacacgtgctaaaaagtcaacggtgtcaaacattttgaaacgggggaagagagtatatatttgggacgtggcaatgaactttccaattattttcctgatcgatctttacttttagagtagcagtgtgcccaacgtactactcacgaacatacgacgacgatatgatgctaatacgacaggggttagaaagactttgacttggtcttgcactctcacgttttgctttgattataattaattggtcaattctagcaaactggtggccatggatggatccaaattactttaataccatggcgcgcgttacctccatatactttctttagctgggcaggtgaatcaacttgatgtttacttttctgtacgtcatacatatcgatatcacactatctggaaaaaaaatcttgcatgtcaagtattgttgataatgatgggtagcaaagcacagcctttttctacacatgattccactgggaaaaaaaatcaggcaacctatgtaaatttattgaatttagtggtatatttatatagtatatacctccaatcataagttaaagaatataagttgttcaagacttcttaagatcaaaatgagaaacatctagaggtcttctggctagctccacaaggtggtgagctagctaactgacggagcgtggggctcctcaccggaagaccgcgcaggcccccctttgccggttcggccgggggcgctaagtgaagttcttaaccctcgatctgtggaatgttcgcgagagagcaaatgcacaagacacgggcgatgtagacaggttcgggccgctgagaagcgtaataccctactcctgtgttctggtggatctgtgtgtgaaggggttacagagaaccggagagcaagagagttcgaactctagaactcctcttcctttttctctcctctacgtctcaggtacattcagagtcgtctcccagtccccccctcctttggtgggcaaggtcctccttttatatctcaaggggataccacatgcaccacttctacctactcttcttttgggtggggacccaccctatcttgaccaaaacttggctcgcgccttcgcctagaagctaaatcacagcttgtccttgagtgaggcccagcgccgtcacttgcctgacacaggggataaccctgtcattccttcattaatgggtggagatttgcaatggccgctgtccgaatgaccctccgatgggatgggtcatacctacctccactccgccggaagcagatgcaacgtgggagcacggttgtctgccgatgacgtgactggcgtcagaccagtcacagaccggtcattcttgtccaccgcgtgtcagtttagcatgccgcacgtctgcccttcttcatacaatgacttccttgccatggttgcgatgaagcctggaatgaatctggctgggactgacgtgctaactccaggagttagcacgccggctccggctagggacgagtgcctggaggctctcatcattccgacgggacggggcgaggcgtgtgacaggccgcctgttgccacctaacccgcgatctgaccggtctgtgaccggtcacacaccgcgactggtcacggaccggataaatgcgcgctgcgccgcattaaatgcggcgtgatgcgctcgtccaacccgctataaatgcggttaggtgagcgccgctgtgctcacctaacccacacacgtgacgccaacaccacagggggtcggggcgccgcagccctcggggccgaaacgggagcggcccgacccctcggggagacagtgggaggggtggccacgtcaccctcgggcccgacccccccgagggggtcaggccacgtgggtgaccgcggctgcccaagcctctagtcacgatacccccggtcccatgtcaccgacactaacctatgttcgaagcctcaccccttctaattatttgatattaggtcattccctaatatttgtggtttttttgttaagatcaaaatgtcatccaaatagtcatatacacttttgacaaatttaacagcatatgtatgagtatcatttcacaaatatacaagtctaaattcaacacatattgtatgttgaaaacataacagattaaactctaaatagtataaactccaaatagtatagttgtatttcaagctagctaggtactccctccgtttcgaaatgtttgacgccgttgactttttagcacatgtttgaccgttcgtcttatttaaaaaatttaagtaattattaattctttcatatcatttgattcattgttaaatatatttttatgtacgcatataattttacatatttcacaaaagtttttataattaaaagctttcgacgccattaattaacagagaagctcgatccagcagatgagtttctcaagctaatatgtggtgtgctgagtacttgttgcttgctgaggtatttatagcagctaaatcatgagagctagtatagcttagctcgattacgagagaggatggaaagactttagacttggtcctgcactgtcacgttgcttctagtagatgttaattaattccactaaatataattaagtggtcaattgtcgcaaacttgccatgcttgtattcacactgtgccttatagtctttggcacacagctgcatactttcttcatctgggcaggtagtgaatgcaacttgatgtttatttttcttgcttatttatgtatcctatagccaatagctcaacatacaaaaaataaaggagctattggatcatttctatgcttaatcacaaccatccattttgtagcttctttcaagattaaaattagagtaaatttcacaaaactacaggtattttgcataatttatcacaaaactacggatttaagagcttgtttcacaaaactacagatttagtgtcttcgtttatcaaaaaactacaggtattttgtacaatctatcacaaaactacagatttaagaacctgtttcacacaaatatagatttagtgtattcgtttatcacagtgctacacatttaatgtcttcgtttatcacaaaactacagatttagtgtccccattctcacaaaactacacgttttaacaatgctaaaaggtgtagttttgtgagaatggggacactagatttgtagttttgtgataaataaagatattaaacctgtagttttgtgaaacaagttcttaaatctgtagttttgtgatatattattcaaagtacctgtagttttgtgataaacaaagacattaaatctgtagttttgtgaaactagttctaaaatatatagttttgtgatagattgtgcaaagtatctgtagttttatgaaatttactcttaaaattaagatcatatatcctatatatatatgcccagctgggggcacaagacatatcgttgaggacagaggcaatattaatatttggcacgttgcaatatgaactttccaatgattttcctgatctttttctctcgtgtagccgcattacctaactcacgaagacgtacgtacggtattatagtacgtacagcatgcgagagagaggttggaaagactttgacttggtcttgtactgttttatacctcttgtagttcttaatcctaactactaaatataactagagttaattataagtggtcaattgtagcaaactagccatatatgcatgcatggatccacactactttagtctagcttggcacacgttactttagtcaattagtctttagcaacttgatgtttaattttctggcctatgcatgtatccatgtcacaatattatctggaaaaagaacatcgggcatgtcaagtattgataaataatactagtaggtagcaaagcatgcacaacccttttacacacgagtgtgtccgcaagctaggacaaaaatcaggaaaattatgtattttcccatgcagcgcgtctagctctccgcatgggaaaatgatcttttcaggcggaccgcccgcgcgcccgtctgtgaagatcgctgttggggtgcaagcgaagccgtcgtcgttcgtctgggaactggaaaaatatgtttttaagtagtaatagttattgtagttacttatgtacggtgttatagtacgtacacctctgatcataaaagaatataatagtactattcgtaattctttaacagtagtatacaaaacgtttgtaagtatggtccgtaacttgttttcgcggcatttattccaaccacctgtgactatgtacaaccaagggcatgtaaaaatcaaggatttgcgcggatgaatttcgaactgcacataaaagttgattttcatagacgtctcatttaaagaacacaccgtgaaaatgaattttcagtttttattttaaaaaacccaaaaaaatattttgtattcttattgcttgtgcttggactataggaaatgttacaatatatggataggatcgtatagtacatcccatgaattttttttaacactggtggagaaggggtttttactctcagttcgtaaccccctgtagtctcggttttccaaccaggactacaaatctgaaactaaagatcgctatctttagtccgggtgaaaaaattgggagtaaaaatccatttttagtccctgttgataacaccaaccgggactaaaaagactaatctggttgctctttattattttattttcttcattgtttttaatatatattgatttcacccccatcccgtcgccaaaatcccaaatcaataattctcaaattgcctccaaatccacaatcgatcatctcaaatactcaaatacatcacaaaatctcaaaaaaaaattacatcacaacttctacaaaattatcaaatattcacatcacacacaaatcaaatacatcacacaacaatctcagatccaatcaaatacatcatacaacaatcttagattctaaaaaaaaaagaaaaaaatccgccgcctcgccggccggccggcccgctgtgccccgccgccctcgtgccggctgccgccgcctcaccgcgcgccgcgccagccgggcctccgcgcccgaccgccctcagcctgttagagagaagaaggagaggaagataaggttgtggagagaagttaaaaggagaggaggagataaggttgaggagaggagataaggttgaagagaggaggagagaggagttaaaggagagaaggagatacctcgatccgatcgcgcatgcctctccgatctccgcgtcgatcttttttcccggttggtgctatctttagtcccgattggtaacaccaaccaggagtaaagcatatgggaatcttttttcccgattggtgttaccaaccgggactaaagatagattttagtccggttggtaacatcaaccgatactaaagattgaaaagtacctggagttttcaaaccgggactaaagatgtttttaatcctggtttttaatacaaccgggactattgtgaaatctggtcgactgaccaaagataatttctccatcagtgtaagaacaatagtatcccatgtataaatatgattatttccatataatatatttataccagtccgtaagacttcatataatcgaatcaaatatatgcagtaaccttaggtgatgaaaatcaaacacccctttatttagtactccctccgttcctaaatatttgacgctattaatttttttaaacatgtttaaccattcgttttattcaaaaacttttgtgaaatatgtaaaactatatgtatacataaaagtatatttagtaatgaatcaaatgataggaaaagaattaacaattacttgatttttttaataagatgaacggttaaaaatgtttaaaaaaagtcaacggcatcaaatatttagagacggtgggagtaatttgtaataaaaatacacaccggatacatatatttgtatctgtatagatatactcaatacgcttgcatcatgatgtacttattccatccgacacacacttatatacgcatgcagatatgcatacatacatacgaacatacatatataatatagttcgcacatatatgcgcatatatatctatagatcgattacgtacaaacaatatataagtatagtagcaaaatatatataccatagcatatacgtaatacgttacgtacgtatacgtatacggtagctagtacggcctctggttttggacgttgccggcggggaagtaggtgcagatgaagaagacgcctcggttggcgttgcaggcgacggcggcgcatccgacggcggtggtgtcgcgccacacgacctgcgtgtagtggccgcacatggcgccgccgacgcagctgttgctggcgtagtcgtaggagcccttctccgccacccactggtcgacggagctcgccgccgtccacgcctgcacggaggggttccacgacaggttctcgccgtactgatagttgttgcgatcggagtgccgcagcgcgcagtcgccggcgcgctggttcgcgtagccctgcgcgtacgccgccaggttgtcgtcccacgacagcgccgggacgccgacggcgctccgggcggcgttgtggatgttgacgatgtcggtcgccgtggtctgggcctgcgccgtcgatgtggtggccagaaccaccgccatggccgccatcaccactgcaaagctcgctcctctctccattgcaagctcgcagttgatttgattggcagtgtacgttcgatcgactgcgcaattagagtagaactagagctatagctagctagtagaggtgatgattaatacatgcaatttcggcagtatttatagacgggctggctctcgatcgagccatggacttaattaagcacatggcaaagaagaaacggtaaacgttgatacggcggactggtccctaattattaagagaaagaaatgggagaagagctgaagaggtgataagaccagaaagtcatgaacaaagcactcatgggaaagtggataatatgcgtggcaaaacttgttactacagaccaaattctcttacccagaatgtctgaaaattcttcaaatcgggtgcccgcgcctccgcgccgaaaaaaatggggcaccgcgcctccgtccaccacgcgccccaccacacgcactgttgcaataaatctgccacatattacggaaacactctattaacaggaatccgtttcatttttttttcaccaataatgtttcaacaagtatattcgtattgttacactatgtatagatcaaatgttgcagagaattgaaacatcctttcgctatttgctgaaacattatttttatatgcggtgaaatagcttcaaaaaccgttgtttcatgcgctgtagcaaaatgttttatgaggtgatttggttgtatttaagctttttaaacgattggaccattttcaatcaacgtagtgaaacaattccgatcgactgcgcaattagagtacaactagagctatagctagctagcagaggtgatgattaatacatgcaatttcagcagtatttatagacggactggctctcgatcgagccatggacttaattaattaagcacatggcaaagaagaaacggtaaacgccgatacggcggactggtccctaattattaagagaaagagatgggagaagaggtgagagaagacctgaaagtcatgaacaaagcactcatgggaaacaaagtggataatgtggcaaaacttgttagtgcctctgtttcagattataagtcatttgcttcaagtttaactaagtttatgaataaaatagtaatattttcaacccaatacaaatatattatgaaaataaatttaattatcaatttaataaaactaattaatttagtgttgcacatattactatatttatctacaacttaatcaaacttaaattagtttgattttcaccaaagtcaaaacgacttataaaacggatggagtactacagaccaaatacttacatgagaaaactcttacccaaaaagtctaaaaataggagtgggatgatggagaagtttatactccgtatatctttggtggagtcgatcagctaggaaaggatgtgtcgggtgctggatacttttggcgcttcctttggacgcttttcttgttgttttgctctttgtcgttccataaacagtactatcttcgttttctctagttaaaattgtctaagtttgattaagcttatagaaaaatataataatatttttaacacaaaataaacatattatcaaaacatattcaatgatagatttaatgaacctaatttggtgttttagacgttgatgaattttacaaatttgtgattgaactctaaaaaaatttctatctttgatcactatttttttttcataaaaagtaaagttacacgtgcactggctagtagatgggtggaaccattcaaatttccaatgcatatgcgtccattggaatatgggtaaccatgctttcctgccgcgttttcttcctttctagctaccctgtgacgttcatcagcaagtacatggccggatcgacttaatttgatccgcttgattattttgattagaaatcgatttcccactgaccaattcttacacgtacgtctatctagttgagaaatcatagcatgtcgatattattttatcaaaattgcggggaaatattactttgtctcttataagggaatatgtccccaagcttgttgcttaaataataaatgtcaatccaaataataatcatatattttgttgaaaaataattaacaatatagatcaatatctggtatcacttcacaaactttcacgtttacatttgatgtatgcatactagtcaaacaaacaaattaaactctaaattgtacgtatgtactactacctccgtcctaaaataattgtaattttaggttgtttggcatatattaaggtttgagaagaaagactataatgtccatctttaaaaggtgtatagataaaagtgaaagggtggttgagggtataatagggagaaatttaaatgggaagtgattaatgagacaattactactctattgtgacaactattttaggacaaatttgaatcctagaaatacaattattataggacagaggtagtagctagtagttatttttcaaggtatatggtaatatcaagcagtaaattagtaatgagcactctaatattttacccctcggccatatagctaaagctttttttttcttagctataaaattaggttttcacttaggccccgtttaaatctgcttaaaaggatggattaaattttggattaaagtggcatacttttcaaactaataaacggtgtgtttcgtgcgaaaactttatatatgaaagttcttctaaaatatcagattaatccatttttcaagtttgtaataattaaaacttaattattacaaacttgaataccatccattttatagctactattcatcattatacctccatatactttctttagctgggcaggtgattcaacttgatgtttaattttttttctggcatatatatcgatatcacactatctggaaaaaaaaatctggcatgccaagtattgatgataataatgggtagcaaagcacacccctttcttacacatgattccactaggaaaaaaatcaaccaacctatgtacgtaaatttattgaagttagtggtatatttatatagtatacctccaatcataagttaaaagaatataatgttgttcaggacttcttaagatcaaaatatcatccaaatagtcatacacttttgaaaaatttaacaatatatgtatgatatcacttcacagagatatacaagtctaaattcatcgcatattgtatgttgaaacataataggtagattaaactccaaatagtgtagttgtatttcaagctagctaggtgtatgttaacggttttgctagagtagtgtcaacagaaattagaggaggaagctttcaaattttcaaccgccaccggatatgcatcaaagattcgtaacatgagaggagaaaaatcgtgtgttttttctctgtgcgcgtggtatgaattaatctcgagacgctcgacttgaacgatagctatgctaaccacttgtacctatgcgcttttatgataggtatatactagtataagttataatgtaattacattataattatactattgttacatttgaaaatttttcactaaaaaactttttaatggtatataagtactcccatatgttaatatcatcaaataataaattcatttccacatgtcgtagctcaagagagtggtatatatcaaaatgaatttttcaacttttgatatttgtaaagcccctgcgaacaaaatgggattatcctcaggcagatccttaagagtccgcctatgataatgtttatttggtaagccttttccccattttcacatacggtttaaatatctaaccctatgtatatgacgacgtttcttgatacattaattattgcatagctagtgatcgaggtcgagaataaaatccatacaaaagtactccctctgtttcataacgtaattaagactttttagtattctccatattcatatagatatgtctagatttattaacatctatatgaattaatgtgagtaatgccagaaagttttatatattataaaacagaggaagtagtagaaaggaatttcaacataacaaatcctttatttatcatgtactccttaagtacgaataacgtactgtattctgtatgttttacatatagatatctgatgcgcgcctaacgtacatgcatctactccagtattaattctactagctagtacgggcgctcgttggggacgttgccgggcgggaaatagttgcagctgatgaggacatcgccgttgttgcagacggcgcggccgcagccgatcgacgtcgtgctccgccacacgatctgcgtgtagtggccgcagtcgagcagcgcccctttggtgcaggtgttgctgctgtacacgtaggacgccttctcctccatccacaagccaaccgcgtccgccgccgaccacgccttcccggcggggccccagtagaggttctcgccgtagccgctgcccgacgtgtgccggagatcgcacgcgccgccggcggcggcgctcgccaccacgctctccgcgaacgcctccagggtcgcgttccacgccacgtcggggaggtccacgccctcgccgcgccgggcggcgttgtgggcgtcgaggaagtcctgcggcgagctctgcgccgccgccgttccggcctccatggcgagcgtcgccgccgccagtagcaccaggacaaagcctactttccgcgccattattgcagatcgatccaatgcagaagagtttctcaaggtagctaaagcgattgtgctgtgctagctgatcgatatgtgttgctcgctgatcaggtatttatagtcgttatatcacaagtagctcatctattagctcgaagattgcatgcaataccatggctaattaattgcactgtttgtatttggcacgtggcccaaatgaactttccaattaatttccacatctttttcaagtagcacgtacgtacgatattcgatgctactaattactccatccgtcccataatataagagattttgagtttttgtttacactgtttgactactcgtcttatttaaaaaaatttagaattatttttttacttactttattatccaaagtactttaaacataacttttcgttttttatatttgcacaaattttttgaataagacgagtggtgaaacggtgcaagaaaaactcaaaatcctatatattatgggacgaagggagtatatatctagattatgcttatgttaaacttgatcatattatagtagtataatcctgtccgtacgttttacaacgtacgcgcagcatgcgagcgagctagggaggttgaaaagactttagacttggtcttgcagtgtcacgttgcttctagtagtttttccttccaccaattgtatgtggtcaattaattgtagcaaactggccatatgcatggatccacactagtttaatattatctcccacgttacctggatatactttccttagcagctgggacaggtgaaccaacttgtttaattattctctgtcatatatatctttttttaaaaaacttctgtcatatatataccaagttttagtgaaactagttttgcatatacaccaaactagtttcgttaaaactaaactttaatctattttgataatttgtctgttatgtattgaatttttttctatatttttatataaacgtagtcaaaattaaaagaaatttgactagaatcaaaacgacttgtaatataaaacgcaggggatagctagctatgctagagacaaataaatcttcataatattgctagcttgctctccctctagatctggcaaagggagggcaccacggccaggccgcgccatgcgaccgagccgccgcctcctacctctagcacctccgccaaaccgctgagagagaggggggggggggagggagagctgagagagcggtgtgagagacgaggagataagatcgaggaagaggaggtgttggccttatcacctcgtgggttgtggggccggccaactatctgcctgaggaccggctcggtttgatttttaggtgccggttcttgactatgaactggcatctattctttttaccacaaagatgccgggtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgcaaaagtccattttgcctcccccaaggtcgatgggccgattttccctcggcccatcttc

SEQ ID NO: 22941 - DNA, 1484 bp, Oryza sativa
ccgtagagcacctccggggaatccgagccgttggctgttctcccctggtcccgggcaaccgcccggtgtgctcgctttgcctgtatcaccgtggttcgttccgccgcttgccggccgccacccgccgtccattcgcggccgggtcgtcgtctacctcccaccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcagaccgcgcgcatgcaccgcgtcccttccccgcccgcgcgtgtgcgtcgcgtgctctctccgcacggtgagccgagccgctgacaagcaggtcccacccgggaccgcgcggggtgagcccggtccaccggctctctctctcctccctcccgcgcgcgcgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagataaaaaattcaataatcttagaaattcaatatcttcccaaccgtaaatccgtttgactccgttcaacttccaaaattcctcacatctcgagatctaatctcgagatctatctaatagggcttaattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgccctcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaaatttcatccgaacataagacaagtacgaccacatgggtggaatgggacgcccctggctgagtaaattgctaatcgggggagccttgatgccgagagacatgtggatttcccggggtggggtcggggaggacccctaggtttcctggcacagtatggcctgggacctaacctgttgttggtctgggacccctctcgtcggcatatggtaaacctg

SEQ ID NO: 22942 - DNA, 943 bp, Oryza sativa
ggctcaccgtgcggagggagtacttggctcatgcacgcgggcggggaaaggacgcggtgcacgcgcgcggtccgtggtgaacgcaggtgcggtgggcccacgcgcagcctcacggctcgcggtggaacgcgcgcacggagagggactgaccggggtcggctcgatccggtctaggttgagctggcgccgacgtggcgcctacgtggcggccacgtgggctggcgggaggtagacggattcgccggaggttgctcgacggcagcggattgcggcggcggcaaccggcggcgggagaagagggaaacggcgacgaggtcacgagaggtcgattcccggcggtgagagcatctatgcggcttcgggaactcgacgctagcgtcggattgggcggaactacgccgagcgaggccggcgacgagcgggtgctacggagctcgagcggcgacggtggcgaacacacggcgagcgacggcaacggtccgggcagcgccggctaactacggggaggctactcaagctactaccgaaagctaggggggggagatggagcgaggaggaagaacggagagaggcactaccgtgcgggtcggggcgctgtgacgagaggccgacggcgcgggagtaatctctccggcctcgggccgaggaagaggaagaagagggcgcggccgaagtccccttccgcgtcctcgaacgcaccggctctcccggcgcttggcgaaggacggcggaggcgagacagagcacgggggcggcggcaacggtgaggaggcgaatgggagaggaaaggaagggagggggaagacgggtttaaaagggcggcaatgtcggtttgagagaggggaaccgacatgggcggtcaagccggcgagctggcgctccggctagcgtccaaagcggcgacaggaagtgacgccggcgagaggggaaaaaggggagaaaa

SEQ ID NO: 22943 - DNA, 5230 bp, Oryza sativa
tcagcacatattacatgtcctttgatgcatgtaagagagggtttctgagtggatgtaggcctttgatatgtttggatggttgccacatcaagactaaatttggtggacaaatcctaacagcagtaggcattgaccctaatgattgcatatatccaattgcaatagctgtggttgagaaagagtcattgaggtcttggacatggtttctatataccctaaaggaagacctgggcattgacaatacctacccatggacaataatgactgataagcaaaaggtatacttgttctttatttttgtcttataagttttgttcttataatctgacatatttcaaattccatgtttgtttttacatgatacagggtcttataccagctgtccaacagattttccctgattcagaacatagattttgtgttagacatctgtactccaattttcaggtacatttcaaaggtgagaatctgaaaaaccagttatgggcatgtgctagatcaagttcagaggttgagtggaatgccaacatggaagaaatgaaatctcttaatcaggatgcatatgagtggcttcaaaagatgcctcctaaaacttgggtcagagcttatttcagtgaattccctaagtgtgatatcttgttgaacaataattgtgaagtattcaacaagtacatcttagaagctagggaattgccaatcctgagtatgtttgaaaagatcaaaagccaagtaatgagtaggcattacagtaagcagaaagaagtggcagagcaatggcatgggcctatatgccccaagatcaggaagaaagtactgaaaaatgcagatatggcaaacacatgttatgttttgccagccgggaaagggatttttcaggtggaagataggaatttcaagtacattgttgaccttagtgctaaacattttgactgcaggagatgggatctaacaggcatcccttgtaaccatgctatctcatgcttaaggagtgagagaattagtgccgagtcagttcttccaccctgctatagtttagaagcattctccagagcatatgcatttaacatttggccctgcaatgatatgactaagtgggctcaggtgaatgggccagaagtgaagcctccaatatatgagaaaaaggttggcagaccacataagtctaggaggaaagcaccacatgaggtacagggaaaaaatgggcctaaaatgtccaagcatggtgtggagatgcactgctcttactgcaaagagcctggacataacaagaaagggtgcccactgagaaaggctggactcaaacccaaactgaagacaagtaggaccccagctgcaagttctacagaagagttgcatgaatctgagcaagaaccagtagaggtaatgaaacaatactctatcttatcactctattatcagtaccctattaattataactctatcttaattacctttgtaaacttgtaggtgctgacccaatctcagtctgcatatgaccaattactatcacaagttcctaatcctatggttgcacagatgtttgaggaatcatcacaagtgagtcaaatggaaactacacatggtcctctcccagataaccagtacattctttcaaaccagccagctgtagtatctacccctatgaccacagcaacaaaagagggaaaatctagggccaacaaaaggaagtgtacaactgaaggagtttcaggagttgctgctactacttcaaagaacagagctcccaggaagaaagctactgctacaaacaagtgatatgtgttagaccatatgtttgatggtcctttagtgttagtagtactttgttatgcaaaaatttcaaccttgtatggatttcatgggcatgcttgcttgattttgtgctgccaaacttgtggctattttgtgatagaacatgggatttttgtgatgccagacatgtgttcactaaatgtagtactggaaatactactaaatgccagaaatttggtattgtgatgaatatgcgaaattactgcctgtaatgcatgatgcatgtttgctatttccatatgacagttttacaggacatttcatatgctagaacaaaataacagttgtctgctgaaaaaaattagagatgtcgattttcagaacaaaatctcagatttcagcttcacataatagcatttagcatacattttccatacatggttcagattcagcatacacaaaaggtcactcaagtgccttatttcagctgacacaaaacacaccagcaccaatacatccatatccatcaaactttggtatctacctaagaagcaatagtgcaaatatgactactacaaaaccaacaataactgacaacatagatcttctactctcttctaacatcttgattctataggccattttagtaactgagccacattcctctttttgtcccctgctctttgcttcatagacattgcgttcagtgacaagtccatcaatcatagctcttgagttggcaagggatgctctaatttcagagttctctgtcttcacttcacgaacagtgctgactaaatcattcaaaacctgcttcaaatacgacgttgtccctggttcataccactgccgtaatttgcatccaccattctgcacattcaaaatgaataaaccaactgacttcaacaaagtactctccaggtaccgaatgggagatggaaaggttttaccttgcctggatatttctgtcgcccaccgtgttgtgctccaactggagctcgagcctgccatcgccttcaacccagccgctccgccgccgaagcccgccgagacctgctccgccaaagaaccctgccacgacatactccgtcgccgaaccctgccgagacctgctccgccgacgaacctgccgcaacctgctccgccgccgaaacttgccctcaatcgcaaccctagtcggcgcttagattttgggcgcttcagggaagaagaagcagtggtggaaaccaaatgagaaaaagagaggggcctggatgaaaaacgacaaggcgtgggcggtgtgtcacgcacggtgtggtccagctcagctgtgcacgtggcatgccacgtcggcgcgaccgcggtcaaatggcattttggaccggcgatggtacatttagcaagtttagtggtctaattacacgatttgcaagttaatggacctggatgacatccgccctcaagtttaagggccgctactgtattttactctagtttttttaatcctaactactcctactaatgtaactaaagttaattataagtggtcaattaattgtagcaaactagccatatatgcatggatccacacttctttagtcttggcacacatacttacgttaccttcctcatactttctttagcaacttgatgtttaattttctggcctacatatccatgtcacattatctagaaaaaagcatatgtctgggattacctccgtcccaaaataaaaatatttatagactagtctaacatttttaactttaactattaataaaataataaaaaaatacatcatttaaaattgatgttactagatttatcattaaacgaactatcataatatacaactctttttagatattattaatcaaaatagcatatcgaaaactatgtcgaaataaaaaatagttatattttgggacggaggaagtagctagcaaagcatatcctttttacacacgagtgtgtccactaggaaaaaaaatcaggcaacttgtgtgcgtacaggtgatgacgctctctctcgtggcacgatcttctggtgagggggataactctcgctttgatcgagtgcgacgtttgcgatgtggctaccaaccagaacaaatccaggacgccgtgcaatcgctacaccacaaacgatgtcgtaccaaccgtgacgcgcggttgatgatccctacaatgcaaacgagagaacactgcaagaacaagataagatgcaatctaaatattgcgaatagggaattaagcacaaaggaatagttgcgattgaagtggtagatctaatcgacccggcaaatcaacacactaactattgggggctctgaatctatagtcgccgactaatcgagcaaggactagagacaaggtgaatggcacttggcaaaattcaactaaacaaaacccaattgtttttgaggatgtacaaagttatttatagaggaaaataaagctagggttaagtgctaattcgtggaggtggatgggtagtcaagccaagcttcttgaccatctcttcacttgctaaattgttgcaactcccgctatcaataatcattttgacggtatggtctttcacaagaactttgctttggaacaaattgtgacattggttttgctcttcacacttctctttagcactaagtgctagcttgacaattaggctaggatactgatctagcgactctggatgcaaatggacttcctcgatgtcatcattatcttgtcctcctgcgtggtcagtggcagctaaagcatattcatcatcacaatcactagtagaagtatactcaccatcatcattcacaaatagagctcgccgatttggacagtcacgtgcaatgtgtccaatgccatggcacttatgacatgtaatatcacgggtacgtccagtggaagctactgaagttgcactcttggctggagtctgaactgaagcgtttttgcttttttcttgagcattggatggcgtagaagtaggtgaacgaacggcagtagtagcttgacgtggtgttgactgtcgtgtggaagtagcacctgcaaaagaacttctatgcttgttgcgtccctgcacttctctttcagctttgcatgcaaaatggaataatctattcatggtattgtattctttatattcaagaatatcccgaatctctctattaagacttccatagaacctagaaattctagcatcctcagtttcttgcaaatcacatcgtgacaaagcaatcatcatctcttgatagtatgtttctacagaattggaacattgtcttaaaagttgcagtttatttaacatgtcacgagcatagtaagaaggaacaaatctagacctcattgtacgtttcatatcatcccatgttctaggtctaagtcctctaccacatatattattccaccatagagatgcaaaggaggtaaattcactactggcagctttaactttcttattatcaggaaaatcatagcaagagaatttttgctcaacagctaa

SEQ ID NO: 22944 - DNA, 3050 bp, Oryza sativa
cctgcggccctatgatttactattacgcatcaactcttcataccaattttccatacccttcagtttatgcgctagattctccagtgttggttcgtcggaacttgtacctgacatcgttagcaagcaaaagaaactcacaagaaagtgtcagttcctaacaatctatatatatgtggagcttttgaaggcactcaacactcaagcatataccaaattcttataatattctcaaagaatgcaaaacaggtcaatcaccgtggctggttcgtggcacaatgacacgcttgatgagtggagcaattgcaaggccggacctgtaaaggttaggagtatgtggatcttggtaggcttaactatatcacaaggaatagcaaaaatcaaacagatttgcgaaattgaataatagtccaaagtactagtcaaaattgctggcgtagcctagactcaatcctagcttaagcaagcaaatgatcacactcggacaatccacaactcgctatagtaagcaactctctccaagattccaacaaaaaaaattccactctttctttttctgattttttttctctttttttctgttttttctttggtgcggctctttttttctttttttttctttttttttttgcaccttctgccttttctttatttcttttttttttggcaagcggtatctaccaaatggaatagctggtaaataagattacaaaggactcaagcctagaagaaaaaaaaatcaaatgaccaaagaccaaccaaccaggtgcttgtgcgtgtgaatgtgtagttacagagaaaactacgtacctcctatttgggtggtgccaggaatatggaaaccgatccttggcacatgcacttcggatagacacagaaactaactaggaaataaccaagattagtccctgatttgaggcgctatttatttggtaaccacgtaccgcgattccatgcatgcatgcactggaaagaaatctcacccaacagaaactctggattttttttctctcaaaccgatctactgctcaaccgagacgacgacgaccaaatgcaaagctcaaaactcagactgagctacgactaaaaccagcactttcgacacgacaatggaccaaaactcaagaacacaatactgaatgaaatttgaaaggctcaaactaaagtttggtgatggaaaaaaatattgcggctgtatggtagacgatgggaaaaaaattacaaaactaaaatcctcaccaagcaactgaagctctgataccaactgatgacgctctctctcgtggcccgatcttctggtgagggggataactctcgctttgatcgagtgcgacgtttgcgatgtggctaccaaccagaacaaatccaggacgccgtgcaatcgctacaccacaaacgatgtcgtaccaaccgtgacgcgcggttgatgatccctgcaatgcaaacgagagaacactgcaagaacaagataagatgcaatctaaatattgcaaatagggaattaagcacaaaggaatagttgcgattgaagtggtagatctaatcgacccggcaaatcaacacaccaactattgggggctctgaatctatagtcgccgactaatcgagcgaggactagagacaaggtgaatggcacttggcaaaattcaactaaacaaaacccaattgtttttgaggatatacaaagttatttatagaggaaaataaagctagggttaagtgctaatttgtggaggtggagggagacacttccgggatgggcctagtctattacaaggcccaaggcccaagttcggtttcagcaacagcactgtcttattttggtgattcccgttgactcgagatgaatttggacatgaaaccggatgcgtttgaaaggtagcgagataagatttccacgaagtccaagatcacccaaatcggagatagcatgaaggcgctaggtccgtttgaagtcagtgctgtctccggaggccgaactggtcttggacttgaaattattattggagcgtgtgaagttacgagcgtatccgacgaagtgatgtcctcatcaacaggtggtgtttacatactacacctccgattttaataaaagagtagaatattactgctactttgatcactcaattacttaactctggtaaagaaaacgtaacctattttcggcagcatttatttgaatcgatcaactgtactaccaagggcctataaaaattaaggatttgcatggggtacgaatttcatgaccccgcgtacaagttaattttcacatacggctctttcgagaaatcatccatcaaaataagttctagttgcccaaaaaaatattttgtattttaataggcatagagtattgttctttgggaagcgctaaaagtttccagcatctgacacatcctttcctagctgatcgactccatcccactcctgtttttacacattttggcgaggcgtatataaatcggacacccgtttttttaaaaaaatcggggttgttccaccaaatagatcggaattgtttcactacgttgattgaaaatggtccaatcgtttaaaaagcttaaatacaaccaaatcacctcataaaacattttgctacagcgcatgaaacaacggtttttgaagctatttcaccgcatataaaaataatgtttcagcaaatagcgaaaggatgtttcaattctctgcaacatttgatctatacatagtgtaacaatacgaatatacttgttgaaacattattggtgaaaaaaaaatgaaacggattcctgttaatagagtgtttccgtaatatgtggcagatttattgcaacagtgcgtgtggtggggcgcgtggtggacggaggcgcggtgccccatttttttcggcgcggaggcgcgggcacccgatttgaagaattttcagacattctgggtaagagaatttggtctgtagtaacaagttttgccacgcatattatccactttcccatgagtgctttgttcatgactttctggtcttatcacctcttcagctcttctcccatttctttctcttaataattagggaccaa

SEQ ID NO: 22945 - DNA, 12256 bp, Oryza sativa
acatcatagcatgtcgatattaatttatcaaattgcggagaaatattaataactttgtctcttataggaatatgtccccagcttgttgcttaactaaatgtcaatccaaataataatcatatattttgttgaaaaataattaacaatatagatcaatatctagtatcacttcacaaactttcaaacaaacaaattgaactctaaatagtacgtacgtactagtagttatttttcaaggtatatggtaatgtcaagaagtaaattagtaatgagcactctaatattttacccctcggccatatagctaaagctatttttttcttagctacaaaattaggttttcccttactttgcatacactatgagcttccttgatgcttttattgggatcgatttacatggacaccctatagtttttttttcaccacttttctttttttttcaccatatagtttttttaagtttatatacctaaagtttatacttatagggtttacacatcttttataggtcaaaagtttatataccgattcaaatttgaatttaaatttaaatacatttaaagatgaacttgaatctgatatataaacttttgacttacaaattttaggtcaacaaactttaagtatgtaaactttagatgtgtaaacttaataggtataaacttcgggggtataaacttagtaaaacagaaaagtaaagtggtgccaaaaaaaaaataccgcgtagggcagaggaaccgatcgccccaagcaatcaatcgtgccataggagtttcgcaccctatcctcacgggcttcaagtctagcctgatgaaggcattagatgggcgtcatcgccagcccatctatgtaggcttgaaatattagctcatacatgcatgtttgtgggctgtaattcgttggaccagatgaagcctattcaaacttagccccaattggtagtttcccaccataggtcagcccagatgttcaattctttttggtagagcttaaaattgtgagaattaacagatttgttctcagttcatgagaatatgaaaaagttagttttccaaatttttgttatagttcattttctgaattatatatctactacaaattcttataatgtgaatgacaatctaaattgtttagggagagttaaagattctgagagaagttgcagctgctaaaagcttttcccaaatagacacctagggcctgtttgggggagcttccagctgctgcagcttttcccagaatcagaaactcccccccaaacagtatagcttttggtacagattctgagaagctatagttgcatggtagagctccaacttctaaatttaactccagtagttgggtctgaagtggagttgtggagctgactaaacacagctccacatctctagttcattttatgagagcgctccacccagcttcgctgctattaggtggagctgaaactgtttggctgagctccagttttaggagaggtggagctggtgatggaactatgccaaataggcccagaattcagaaaatgaacaagaaattagaagctgggaaaccaacttttacagatcctcaaaagttgtctactaaccagctgcttctaagaatcaattcttaattagtttcccctggacaggccactaggactgttccaccacagcaccacccagtctctgattgtatggtcgtcctttcaaattacatgcagacaatggaattaattttctcatttattttcttcttttattcgaacgacaacgtacatatatatataataagatccccgtaattattatttcgcacatttatatcatactccatacatagttaaagtaaatactgtattaataacttattaagcagagagagtgaggccacgctcgaaggggcgctctccctggaagttgccggcggggttgtagttgcaggtgatgaagacgccgccgttgtcgcagtccacgcgggcgcagccgatcgccgtcgtgcggctccacatcacctgcgtgtagtggaggcacgagtcccacgaccccaggcagctgttgctgtcgtagtcgtacagatccttctcccccacccagctgttgacggcgtccgctgccgtccactcgctgccggagcctccgaagaggttctcgccgtagccggccttctcccagctgccggagtggatgagcgcgcagtcgccggcgcgctccgccgcgtagttctccgcgtacgccgccacggcgtcgtcccagaccacctcgccgacgccctccacgcgtcgcgccgcgttgtggaggtccacgaagtcctgcggcgagttctgcgccaccgccggcgtggtcgccatggccagaacgacggcaatggctgccgcaagtgctactcccgatatctttggtgtctccatatgcaacactactacacaatttgctctcttaatcgattccgattgtgtgtgtgttcgttgaatgctgatgcgatattactcgcgatcgatcaaggtatatatttatagccagatgagctcccaagatgtcagcaaaataaatcgattattaatcctacaatttgcatggcaacttggcaagtagccatgatgcttggctctgctcggcgagagcggattaattaggataaaataaaactctcctggcctcactctcatttctttttattaattgattaattgttaatgattttgtgtttggtacatgcatgaatgcatgcgacgtgttctttttcttttctcctattttttttgggggttgccgtcgttgaatcgtagtcattggaggacgcagcacgttgctcatgtgctcgacggctaaggcgattatatcgatccgacgaggcatgtcttatctttgattggtggactagttccttaattgattgatcaactgatcagtttggcatataggctgtattattagtattttatatacatacaatattatttggtgcaacttgttgtgaagatatatataatttcagtgtttcaacaactaaattttaaatatttaatcagttgtaaatgatgatttttatgccatcagaaaacccaaccttaatttagtttatggaacaaaccacaatggttactgaataacatttctacatttagaaacaaagtccacctaagcattcgtgatcggatcaagggatccatccaaatcatgtggggtatgggtcaatatttggtgggaaatttctccatctccatgctgtctgaaagaattctataaggccaagtagccaactttaaataattcatgcataccagcaggtgcagagtttttcgattcctagtgggtgtgggtcaccctaggaaagaaaaacgaaagatcaatattcaagaacggaagagatatgtcagcaaattaagcacatcctcgttgcgtgtttgctaagccttcattattccaaacaaccactaggatcaatataataagagtaaattgcatattggaccacctttcctcagtatttttttataatatatattaaacctagcctttacttcaatcacagctacaacctcttattatatggttcttgacacaaagtccaaatagaatagaatgaaattttagtacggcctaccatccgcagaccgatggtcagacagaaagggtaaaccaaatcctagaagacatgctacgtgcgtgtgccctggatttcgaaggcacttgggatcgttgtttgccgtatgctgagttctcatacaacaacagctatcaggccagcattcagatgtcgccgaacgaggcaatgttcggaagaaagtgccgcactcccttatgctggaatgaggtgggcgaagcgctgatattcggtcctgacatactcaagtcagcagaagaacaagttaagctgatacgagaacgtttgaagacagcacagaaccgtcagaagaattacgctgacaatcgaaggcatgaccttgagttcgaaaaaggagatcatgtatacctgcgggtatcacccctccgtggtatgaggaggtttgggatgtccggcaagttagcaccccgctacatcggcccctacctcataaccgccagacgtggcgaagtggcttatcagcttgagttacctgaaggtctcgcagatgtgcacaacgtgttccacgtatcccagctaaagaaatgtcttcgagttccagaagagcaagtccccctgggtaatatcgagctggaaaagaatctgacgtacaaggaaagaccgatcaaggttcttgaagaggcaaaacgtcagactcgaaggaagaccatcaagttctacaaggtccaatggagcaatcattctgaagatgaggcaacctgggagcgagaagatcttctccgcgccgagttcccggagctgctcccttaggtgctgaatctcggggtcgagattcttgttaggggagttggtctgtagcgcccgttccgtcgtggcgcctagcgggaaaattatctcctaaaaaccctaattgcgaaagttgtttctttgattgttgtctagtgcccgtgccatctcatgatctcaatccccgctctatcgtcgagttcaattccgaatccaatccctccaaatcaaattcctccgtaaaagtccattttgcctcccccagggtcgatgggccgattttccctcggcccatcttcccctctcccccggcccatcttcccctctcccccggcccatctccatctctcccccggccccctctctcccgggcgctctctctctctctctctcctttcctccgctccgcccgcgcgccgcgcgcgcgtgcgcgagggtcgtgccgagcgcccctccccctccgctctgcctgcgcgcgtgagccgcccgcgccgagccgagtcttccctctctgctccctcgctgccgcttcccgcgcgccgtgttcacgtgcgcgcgcccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcaccgcccggcccccgccactccgcgcgcaagccgccaaggaaaggaggccgcgcccctcctctctctgccgcgtcgcccccgctcccctccccctttttcccgaatcggcaaaggggcaagccccctttctccccctccttttcctcttttcctcctctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcggtccgaggccggagagatcactcccgcgccgtcggcctctcgtcactgcgccccgtcccgcacggtagtgtctctctccgttcttcctcctcgctccatctccttcccctagctttcggtagtagcttgagtagactccccgtagttagccggtgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcctctcgtgacctcgttgccgttttcctcctctcccgccgccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcgccgccgccacccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccgcagaccgcgcgcatgcaccgcgtcccttccccgcccgcgcgtgtgcgtcgcgtgctctctccgcacggtgagccgagccgctgacaagcgggtcccacccgggaccgcgcgtggtaagcccggtccaccggctctctctctcctccctcccgcgcgcgtgcgagtttgggccgccttgggccggccggcccatttagctcggccggaccgctccatttctcttgggccgcgccctagccgtccgagaaaagtctatattccctccctcccttcttttctttttcttttccaaaaaggatttaattaaatccttttcctttagatcaaaaattcaataatcttagaaattcaatatcttcccaaccgtaaatccgtttgactccgttcaacttccaaaattccgcaaatctcgagatctatctaatggcccgcttagaggtcattaatagggcttaattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcacacttaatctgtttgtcccgtctgcaaggcagattggcggacctacctaatttgtcgcatttgatccttcctttgttaattgctataccatgtccccttgtaaccacccagttgcgcctcgatactcgtgcactctgtgcaagtatcgacggtcgccctcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaaatttcatccgaacataagacaagtacgaccacatgggtggaatgggacgcccctggctgagtaaattgctaatcgggggagccttgatgccgagagacatgtggattcgccggggtggtgtcggagaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggtcattaaactgttcgaacacccgtgcccacggtcatgggcggatgtgaggtgattcctagcgtagttttgtttgactactgcttgtgaaattgctgttgtgaaaaggggttcgatgtttgaaaaatctgcagctgatgggatcagctagcccgggtggccgtttgaaaagttgttggcccgggtggccgtttgaaaagctgttggccgggtgccaaccgtgttgcaatcctaaagattgatacattgcacatactccgaccggacgagacgcattgtctcatccgtgtcgtttgagaagcacttagttgttttcagaaaagagttcaaataaaatcaattgcaaaaacagcagccttcccttgaagcctgcattaaacacttatttcccctggcttgctgagtactcccgtactcacccttgctctatataaataatctccccccagttgctgaagaagatgaagtggatcctgctgacgaggagttcttccaggagcaagtcggctacgatgagttttagggtttcggcctagttcccaagtcgtgcctgtgttgattggtccaagtcctggcttccgttttccttttgtaatgcagttgtgagctcgggatctgtccgcagcccaacatgactatacctctactctataataaagagacctctgttgctgtgatattctgtctccctatgataccagcactgttttctgggactggtatcgattaacaggttaaattggagcgtcacgggctagttccggtcgggactagttcggggcgtgacatccggttcttacaaagattctgtgtcaactactccgatgggatgggtactaaaaggtgctggatattcaataaaaactagcacctatttgaggaaaaaggtgccggtcttttgaaatttggcatgtggacggacgcgtgggtgggcacgtgagtaggaaagacgctatagctaggtgtcgattttaccacttccggtggcctttagcgccgacatctatttaatgttttgtagtagtgttcatcgaaaagaatccttctgttgaggtatctttcccttttcgtggtgtcctagatttgttggagcagggattggtcgcatggtttgtggtgattaatttgttcttttctaggtgctgtctgcgtaatgtactctctgctgatttttttttctctttcggtttggtttgttcttcgtgttgttgtttgcagcaagaatcggcggttgcacacactggtggagaaaccgtttggagtcccgattagtaaccccgtctccttgcaagaagtcggggtttctgatcctcgccccgaacatctctctactgttggagctcatttccatgtaccgttcatggaatttgtacatctgtgtcggtagggactccagctgttcaggtttgacaagcggtttaccgagttcaaacttgtatgccacttccgccttcgggattggtgcgcctccaaccaactgatccacagatagactagtgtctgcaatgaaatccgttatgccaaaatcttcgccggtcaccaacggctcgacctcttggtttggttgttctccaagctgagggactggtttggacttcttgtgataggctctctgaagtgttcggtcatagtccgatatctgtaacgcctccttgtttgttttggacattcccttgaagaagttcttcacgctcgggtcaataggtatcttcttttcagtactccgaggcttgagttgcctcttcacctccctgccgcataagcatcaagctcctcttgactgcaatcgtatggtggctccttgtttttggtggcgtcgactttcgccttcttcgttgcccttgtgcgggcaggcggtggagcttggcaagaccttgtcttgggaggtgcaggcggacacggtggaggcggaggagccggaggagatggtgcagcaggaggtggcggaggagccggaggagatggtgcaggaggacgtggcggaggaaccggaggagatggtgcaggaggagatggcggagccggaggagatggtgcacaagacgccgcttgtcgcccaggaaggatgatgtaccgcttgcgccatagtatgatggcgtggcttgtgtctcgtagatgcgtctcaccgtcccctcctgggtagtccaactcgaggtcctcgtacgcggcttccaccagctcaacttcgaccctcgagtatcctgctggaatcggcctgcagtggtaagtcccggaagggtccgttgggatggccattcccgacgccaccttcacgtgatgagaggttatctattagtaatcaacctaagcagcaacttgcggaatgtacaagtcaaaaatcatcaaactacgagcataccttgattgataagttcttgaagggaatatgcaactcacatggtgtccgctgcgtgatctcatcaacagggcaggtggttgcgtcctaggtttgcacggcgtccatgctctgtgatccgacctgccccgttgaggcgcagctgctacgattgcctgatgtgctgaccattacaggatgaatgtacggctggggatcctgggaccgatgtgcggccatacgttcatccaccttccttgccacctcctcttgcatgctgagctcgtagctcaataccctgtactcaagatctgcaatcttcgcctcggtatctctcttgctcctcatccgactcctgtacgtgtggatgtcctccttaaatccaatcttctagggaatcacgcctttccctcgtgtttgtcctggatgctcgggagtctgtagggcgagtgacagctcatccttctctctgtcgggtcggaatgtgccctgagaagaggccaccactgcgtccgttagtcgactggcagcctcgcatatctgatcgctgaagacaagggagccatcaactgggttaagcgttccaccgtgagcatagtaccagaacttcgatcgatccggccatttagcggtggccggttcgatacccccctcaagcaagctagcctccatctcctcccacttcggcttcgcgacgctatatccgcctgaccccaagtggtgatggtacttcttcttggcggcattttccttgtttctggccatcatctcttgcccttgttgccctgtcttgtaagcaacgaactcgtcccaatgatcccttagctttgggaatacgtcgaagttcggtgttagtcccttcaggatgtatttcttgtagagatctcccttgaagctctagaactgttctgccattttcttcagagtccactatttcactaagttatccgtacccgcgggtagcgtgaacgtctcgagcaatgtggtccacaacatctctttctctgagtccgggacaaagctgtcatcatccccgcgtgcccttgttctgcgccagtacaccgtgctgacaggcacgttgtccctcacaacccaaccgctgtggcgtacaaaattcctggctgcttctgccggggcactaggtcggccgtcttcgtccacctcagttatgatgtgccgaccctctatcttcttcgcggcacctcgttgtccgcgtgccctcttctgtccagcagagggttgacttccattagcctcctccgcatcgttcccctctgcatccctctccacgttaccctcctcgttccaatactggctgcttccctctgcgattgtttcgtatagtatctgttcctcatcgcgatcagccatctgtgcatacaaaaaatatttgttaggtatataggatgtatttgctaaccgtaatattgaaactctgctaattttatattaaatctctaataatcttatattaaatggctactaatctcatattaaaattgtaataatcatttatatatgctaagtctaacaatcttatattaaatctctaacaatcttatatttaatctctaataatcttatattaaaattgtaagtcatatatatatatatatgctaagtctaataatcttatattaaattgctactaatctcatattaaaattgtaataatcatttatatatgctaagtctaacaatcttatattaaatctctaacaatcttatatttaatctctaataatcttatatttgaattgtaatagtcatatatgctaagtataacaatctcatattaaatcgctactaatcttaattatattaaatcgataacaatcttatattaaaagtgtaataatcatgtatgctaagtgtaacaatcttatattaaatatctaacaatcacttaattacatcacttgcctgcgcgaattccttcgatggctagctaccacttcggcttgagggacgacgccgacgtcttctctgcaacattaccaggaaaatgtattagtctaaacgtcttctctgcaacattaccagtaaatcgtattagtagaaacgcgttcgttctcacacatttagtacaagtgcattcatgttcgtaagcgtttcgtgcacgttcgttcgcgttttgtaatcgtattgttcacgttcgttcgcgttcgttaacgtttcgttacgttcgtccgcgttcgttaacgtttcgtgcacgttcgttcgcgttcgttaacgtttcgttcacgttcgttaacgtttcgttcacgttcgttcgcgttcgttaacgtttcgttacgtttgttcgcgttcgttaacgtttcgtccacgttcgttcagcgcccgttcaaaggtcgtccacgtatcgttcacgt

SEQ ID NO: 22946 - DNA, 9089 bp, Oryza sativa
ggccgcgtcgatcgaagtcggtcgtcggccggccgtggagatcgatcagagagagagatcgagatcgagatcaagagagagagagaggcagcggcggctctcacccaagagatgcggcggcggcgtctgcggcggaggcggcgaggaccaccaagcgacggcgagaaacgacggcggtgtcggcgcggggttgccctaggcacggtggcggcgaaggagaggccgatcaagatcgaaaaacggctaagtgttggtggagaagacgagggcgcaccgggaatatatatacccccggatctttagtcccggttgttctcaggaaccgggactaaagatcttttcccgctatttccaaattctttttaaacccggttagggttaggaaccgggaataaagataatagcagttgtgtcttcaatttcattgcatatgtgtttctaaaatagtaaataatgcattacaattatttaaagtcgaacaattaatgataaaaccttcgaaaaattattgttgtacgtagtagaatacgtggataatatataataagcacatgaatgatttaaaattgttaaaaattctaattaacataatagcacatgcatgatttaaaattaatacaaaatctaatatcatatataactagcatatcatgatattaaattgataaaaattctaattaacatatgtaaataccacatgcatgatttaaaacctttagaaattctaataatcatatatatgtagcatatggatgattttaatttgattaaaattctaataatcatacataattaacaaaaaatctaataatcatatataactagcatatggatgatttcaatttgataaaaattctaataatcatacgtattttacatatgccatacaacaattgattagtatagatattcggtacatccaacatagtttacatcgtgtacagaacaattacggcaatacatcggcggtgacggttgaccggacgtactttctcctcactattgttcattccttgtgatcgctacgtgagtaaggggtgtcttcatttgataggaggatgctagggtcaattgtcatcgtgaaaggggttgcccatcaaactgatcgtaatcctcgtcagtcttgtcctctaatccgacgatttttctttttcctgggagaaccacgtggcgcttcggctcgtcagtcactttgccctttttttctttgctagacatgtccttgacgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacaaagggaccttgagaggtccatagtcaagttcccatatgtcctcgatggcaccgtaatacgtgccagttgtaccatcgtgtcccatggcatcgatacgaacagcactgttctggttcgtgctcttcatgtcttgggccctcgtgtagaatgtgtacccattgatttcatatacctggaatgtcgcgatcgagccagatggtcccctcgccaggaaggccagttgttggttaatcgtctcattacccatgagatgttgtcgcagccatgtggagaaagtatcaatgtgatgccttgtaatccatgcatcggacttaccgatgtttttggtgcaaactagagccaagtgctcctcgatgtagagagccaccaatgaagattgttgcagaaccgtgaaatgggctttacggaataaattgttgtctaacgtcattattgctttctttccgagagtcccctttccccgtagtctcccttcatggcgtgattcaggtatcccgattgggcgaaggtcttcgataaattctacgcagaattcgatgacctcctctgttccataccccttggcgatgcttgcctctggacgagcacggttacgaacatacttcttcagaacgcccatgtacctctcgaaaggaaacatgttgtgtaggtacacaggaccgagaataccgatctctttgacaaggtgacaaagcagatgcgtcattatattgaaaaatgaaggtggaaatatcaactcaaagctgacaagacattgcaccacatcattttgcagggcttctaatctatgaggatcgatgaccttctgcgaaattgcgttcatgaaagcacatagctttgttattattgcccggacattgtctgggaggataccccttattacaactggtagcagctgtgtcatcaacacgtgacagtcatgagactttaggtttgtgaacttcttctccttcgtgcttattattcgctttatattcgtggagtatccagacggtaccttgatgctctccaagcattcaaacgtactttccttctctgccttgctaagagtgtagctggctagactcaagtaatggcttcctttctcctttggttctgggtgaaggtcaccgcgttgttccatatgctttagatcattacgtgcttccagtgtatctttcgactttccatatacacctaggaagccaagaaggtttacgcaaagattgttagtgaggtgcatcacgtcgattgcgtggcggacgtccaagaattcccaataggataactcccaaaatatagagttctttttccacatcgccgcgtgaccatcttcgctctctataggctggctgccacgcccctttccaaacactactttaagatctttaaccatagcaaacactgtttttccgctgcgatgtttaggcttcgtacggtggtccgccttatgttcaaagtgcttgcctttcttccgaaccggatggtttgctgcaaggaatcgacgatgacccatgtacacaaccttcctacagtacttaagatacgtactttctgtttcatccatacagtgagtgcaagccttgtaccccttgttggactgcccggataggttgctaagtgcaggccaatcgttgatggttacgaacagcagcgctcgtaggttaaactccttctgtttgtcctcatcccacacggggacaccttccttcttccacaacagtttaagatcttcgaccagtggtcttaggtacacatcgatgtcgttaccaggttgcttgggcccttgaattataatcggcatcattatgtacttcctcttcatgcatagccacggggggaggttgtagatacatatcgtaacgggccaagtgctgtggccgctgctcatctctccaaaaggattcatgccatccgtacttaaaccaaactgtatgtttcgtgcgtcctttccaaagtctttaaattttctatcgatgtttcgccactgcaaaccatcggcggggtgtctcagcatcccgtcctgttgacgctcttcagcgtgccaccgcatcattctagcgttccccttgttcctgaacaaacgccttagccgtgatattatagggaaataccacatcaccttagcaggaattctcttcttcgttagctgcccgtcaacttctcctggatcatctcgtctaatcttttatcgtagtgctttgcaaacagggcatgcttctaggttctcgtactcctcaccgcgatatagaatacaatcattcggacatgcgtgaatcttctgaactttcagtcctagagggcacactatcttcttagcctcgtacgttgtctcgggcaacttgtttccctccggaagaatgttcttaacgagtttcaataaatcgccaaatgccttgtcactaacaccattttttgccttccattgcaagaactccagagtggtatccaactttttgtgcccctgctcgcaacctgggtacaacgacgttctatggtcctctaacatcttgtccaatttatgggcccccttttcactttcgcaatcctccatggcgtcctgcaacatctgaccaagatcatccgcaatgttgttaccatcagcatccctttcctcctcgcccgtttgatttcattcaaatccagcgtactgagcaaagtccggaatattgtcgtcttccacttcatcttcttccatttcaacaccttgctctccgtgggatgtccaacaattatagcttggcatgaaccccgactcaaacaagtggaaatgaatagtcctgcatgcagaatactccttctgattcttacacttattgcatggacaacaaataaaacccttttgcatgttagcttcggccactctcaaaaaataatgcacgccgtcaataaactctttggaccaccggtcagcgtacatccattgccgatccatctacataacatgaaaaaaaatcgtacacacataattattcgtacaataatgacagtcatacaataattataaaataattacaaactctttcaacagtcacacaataatgacatatcattattcctacaaatattatgaaatattacaccgaataattatatatttactatttataaagttttaaactaatattaatgtgttgtacttattttaatttgtcattttactttgttttctattattcaagattaactttcactatattttccttctcaacttttttataaaaccttctttagcaaataaactaaatttctatatattctttattctccacacaaattttctctctcatcaaataacaacaaaattttggtcacaaaaatgtgtgcaaaacatagctccaaatgtaatatgaaaaaaaaaacattggaggatgaagttgctaaccttttaggcacctctgatttgtatataatcaccaaaataaatttactagaaattttggcatgacctcccctcttttttgaagaaattttgaagcttgctcgggctgaaggaggaagaagacatttatataggggtgagactttagtcccggttggtgttatgaaccggggctaaagatcgctgtgatctttagttacgatctttagtcccggttggtgttattaaccgggactaaagatcccgggggacctgacaggcccttacagcatttgaaccgggactaaagttacgatctttagtcccggttggtgtagatcaaatatgcccgttaccctttttaaccgggactaaagatgatctttagtcccggtttttgttgcaaccgggactattgtggaattagcccgaccgacgaaagatggtttctccaccagtggcagttgcactgccaagattgttacacctttgctgataatagccgaggacaatctcgtcggcatccatggcggccagcagctcgaaggagatagtggacgcggtggagaagtggatggcgttccccatctccaccgccgccggcttggagatcgttgccgaggagggctctagcggaagcagcgcccagcagcagcaggcttggcgtccggtggcggcggcgtggtgcgacaacggcggcacgtcggggacgggagcggcatgcaagtcgtcagtggacggcggcgcgcggcggcggccgcgcgtcgtaagactggctgccgcgtgggtgtcgctggaggtcaaggacgcgctgtccagcctgcagcagacgttcgtcgtctccgacgcgacgcgcccggactgccccatcatctacgccaccgaggggttcttcaccatgaccggctactccctcaagggagataaggcgcaagggcatttcggtccaaccacattaaaaaagggctcctgaaccgccacgtcagcatggcaagtttcatttagacggcacggtgctcatcgataaatatctatggttatgtagtgtctttcccccaaagctttgtttttcggtgtccctaggctaaaaccacacaactgcgatgccgcgtagaaaaatttgccttacttattatagtaagtacgaatatggtactgtatatgttatacatacatgaacgtgattaatttattcatataaatatatatctgatgcgtacattcatgtagtagtaagtatagtgtactagtaagggcgctgatcggggaagttgccgggcgggaaatagttgcagctgatgatgacaccgccgccgttgctgcaggcggcgcgcgcgcagccgatcgacgtcgtgctccgccacaccacctgcgtgtagtggccgcagtcgagcagcgcccccctcgtgcacgtgttgctgctgtacacgtagtccgccttctcctccatccacaagccgaccgcgtccgccgccgtcgacgcgctgccggcgccgcccatgtacaggttctcgccgtagcccagctgcacgctgttcgagtggtcgaggctgcaggtggcggcgagcaccgccacgtagctctccgcgaacgcctgcagcgtcgtgttccacaccacgtcggggaggccgacgccctcgccgcggcgggcgtcgttgtgggcgtcgacgaagtcctgcggcgagctctgcgccgccgccgtgctggccgccatggccagcgtcgccgccgccagcagcacgagtgcaaaggctttcgacgccattaattaacagagaagctcgatccagcagatgagtttctcaagctaattaattaatgtcttgtgctgagacttgttgcttgctgaggtatttatagcagttaaatcatgagagctatagctaagctcgattacgagagatcgaggttggaaagacactttagacttggtcctgcactgtcacgttgcttctagtagatgttaattacttccactaaatataattaagtggtcaattgtcgcaaactttccatgcatgtattcacactgtactttaatagtctttggcacacagctcagctgcatactttcttcatctgggcaggtagtgaatgcaacttgatgtttatttttctggcttatttatatatcctatagccaatagctcaacatgcattaaaccacataattttaaaaaaagagagccatatattggatcattcctatgcttaatccattttgtagctactattcatcactaattagtaaataacttagcattcagtgatttacttagctagcgtagaacgttattactgtaaagaagttacaccatcacttgacaacacattggatgacacttctatagttcatatcagcgtgtatatataatctttctcgtatgtacgtattgaaattttacaactgcattgcacacaccaatattccgtctgcactgcacggggtatcatctagtattctagtgtgtgtgcatatgtatccatatcacattatccgaaaatgtgtctttcaaagttgtgatggctcccaaccaatgatggatcataaccgggctacctcggccatagctcaaggcctaagtacaggctcatataaagctatgcacactacgccgaatcaggtcatctctgacggtattcaaaccgtcacctttgacgtgttttggtcctagtcagagattagtggtcgctgatgactttactcacatttgacggaggacgttcgtcagaggtaaccgtcaccatttttttccacaacactccacgaaccggttgagggcttaacccaaagctaggttcatcccttttctaactctaatgcaatacttaaagttacaacaacaatagtgggccctattcataacctggttgagaaatatcaatatacacacacacatagagtaaagatacccttaattagaaataaagcttcgagtaacactgacatagccgatgacaaggtggataccgtgacagatatggtttctagagaatatttttctttttcttatctaaagaattaaagaaatggtaaaaaggtagtttctttcaagattaaaattaaggatcataccataatatatgcccagctggaggcacaagatataacgttgagcatgcacagaggcaatattaatatttggcacgttgcaatgaactttccaatgattttccttggccttttcctctcgtgtagccgcatattaattacctaactcacgaagacgtacgtacggttctactactacgtgttatagtacgtacgtacagcatgcgagagacgttggaaagactttgactggtcttgtactgtcacacgtttacctctagtatagttttttgagtaaaatacagtagcggcccttaaacttgcgggcggatatcatctaggtccattaacttgtaaatcgtgtaattaggccactaaacttgctaaatgtaccatcgccggtccaaaatgtcatttgaccgtggtcgcgccgacgtggcatgccatgtgcacagctgagctggcccgcaccgtgccttttctcacgcgcaccgtgtgtgtcaccggccacacttgtttttttttcatcgaggcccctctgtttttctcattttctttcgtcatccactgctgcttcgtcttccccggagtgccctagcgcagagtgcagcggagatcgtgaggggggtgatcgccggagaaatagggttccaacggaagcgcaaagaggcgagatcgattggctgttgcggcctcccgccgaccataatcgcggggaggaggcatgattttccgcctggaaggggaagggcctccgttgtacagtgagtataacttcaaaatttcgttcgtccattaatctgcagggttagcatgcactgattgatgttggtagatagatacaaaggaataaggcgtttgttatgcaaaaaagatgttatttttccctgtaggatgattatcctgacattgttctcgagtaggctagaacatgagagtaatacagctaattaggattgcaatgcaggtcctgatgatggtaaattcaccgctgaggtacaccatggtggtttttttgttggtcaaagtagcaacagggcatatgtagatcaaacaataaattggattgaccactgtgaagcaggaacatgggatattgtttgtttggatgaatttttagctatgcttgggtatgatatgactccagattttaaggcttattggttgctccctggaaggactcttgaagatggccttagggttatatctactagggctgactttgaagtgatgaaatcagttgtgcacaaggttaagaattttattatctactttgatcagggtgacacaattgcaggtgtagattgggatgatgtagtagctaatccta

SEQ ID NO: 22947 - DNA, 968 bp, Oryza sativa
taaaatcagacagctctttatttattactacctccatattttaatgtatgacgccgttaactttttgtctaacattagactattcgtcttattcgaaacaattatgtaattatcatttattttattgtgacttgattcatcaccaaatattctttaagcatggcataaatattttatatttggataaaaattttgaataaaacgaatagtcaaacgttggttgaaaaatcaatggcgtcatacattaaaatacggagggagtaatttgtaataaaaatacacaccggatacatatatatctgtatttgtagatactcaatacgtctgcatcatgacgtacttattgcatccaacacactgatcatgcatacgcatgcagatcgatgtgcgtacatatatacatacgaacatacatagtagttcgtacatatatgcgcatatatatctactgagagcagaaagatttatacgtacaatatatactagagtagtagcaaaatatattccatagcatatacgttacgtacgtacgtatacgtatacgtatacggtagctagtacggcctctggttttggacgttgccggcggggaagtaggtgcagatgaagaagacgcctcggttggcgttgcaggcgacggcggcgcatccgacggcggtggtgtcgcgccacacgacctgcgtgtagtggccgcacatggcgccgccgacgcagctgttgctggcgtagtcgtaggagcccttctccgccacccactggtcgacggagctcgccgccgtccacgcctgcacggaggggttccacgacaggttctcgccgtactgatagttgttgcgatcggagtgccgcagcgcgcagtcgccggcgcgctggttcgcgtagccctgcgcgtacgccgccaggttgtcgtcccacgacagcgccgggacgccgacggcgctccgggcggcgttgtggatgttgacgat

SEQ ID NO: 22948 - DNA, 885 bp, Oryza sativa
gtaccccgtgtactcgggccacgagaagccaaggaaacgggagaggtcacgaagctgagcgacgtggtgaccctcaccaaaaccgtgggaactgaagctggcgttcactgccatctacaattttgaaagagggagaaagatcagtaaccgttttagaaacaaactattgaaaataaagaaaaccaaagaaaccttagcttttcgcaagtagttttgaacttagtatccttagggtcgtcctaagcgtcgggtttcgccctagggccaagcctgtgctctgataccatctcttgtcacgccccgaactagtcccgaccgggactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactccttgtcagcaggatccacttcatcttcttcagcaactgggggggattatttatatagagcaagggtgagtacgggagtactcagcaagccaggggaaataagtgtttgatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtgtcagtctttaggattgcaacaaggttggcacccggccaacaacttt

SEQ ID NO: 22949 - DNA, 689 bp, Oryza sativa
  unsure (1)..(689): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgactacccatccacctccacgaattagcacttaaccctagctttattttcctctataaataactttgtacatcctcaaaaacaattgggttttgtttagttgaattttgccaagtgccattcaccttgtctctagtccttgctcgattagtcggcgactatagattcagagcccccaatagttagtgtgttgatttgccgggtcgattagatctaccacttcaatcgcaactattcctttgtgcttaattccctattcgcaatatttagattgcatcttatcttgttcttgcagtgttctctcgtttgcattgtagggatcatcaaccgcgcgtcacggttggtacgacatcgtttgtggtgtagcgattgcacggcgtcctggatttgttctggttggtagccacatcgaaacgtcgcactcgatcaaaagcgagagttatccccctcaccagaaga

SEQ ID NO: 22950 - DNA, 2507 bp, Oryza sativa
caatcaaatcagaccatgttcttgagcgttattgattagggtactttttatatccttgataaaggggccgggtgtttacataggggtgtaaagttttcgcgtgtcatatcgggtattatacagggtgtcgcatgaggtgttcgggcactaataataaaaaactaattgcaggatctgtcagtaaaccgcgagacgaatttattaagcctaattagtccatcattagcaaatatttactgtagcaccacattatcaaatcatgaagcaattaggcttaaaagattcatctcgcaaattagtcgcaatctgtgcaattagttattttttagcctatatttaatatttcatgcaggtgttcaaacgttcgatgtgacatggtgaaaaattttagggtaggatctaaacaggtccaaagtactggaaggtatcatattttttagtgtaaaatttggtacttccagatacttaaataccttgagataaaaaaaattagtgtaaaaatttaggtacctcaggatacttttttaaggatcgtaaaattttgcaacttgttttaattttttttctaacccaaaattttcaattacatttgaccaagctaatagcaatatttacaacacaagagtagtttcattaaatctaatattgaatatattttgatattttctttgttcagcattataagatgttttggtttaaatagattcatgcatgaatgtatgcatgtgtccaaatttatatggatgttaattagtcactctagacaagggttggagatgccaaaaaatcttatatataatgtgtaacaaagggagtagaatgtttgttttgtgtcaaaaatatttttatgttttttttaaaaaaataattatttttttaaaaaaaataaagaaaaacaacttataatatgaaataggaggagtaatttaaattgttaattctccccattatttttggcagccccacatatataatatgtaatatgtatgcatgtatattttttttaagtagctgtatacaactatacaagctggccttgttgaaaggggttatacgatttctcaatcatggacgacgtgcttgaccatcatcaatcacatgatagtttctcgttatctgtttgcctagttgcctgtgctagctttaagtcaagctcacacttgaatttatagtatactggtattacacttcttcctcctgatcccatgttaaaattaatgttctttatccggtttgctcctattaactgttttgtgcaagcagcagaatccatgagagcatcctactcgtgataacaaggtgatgagaggaatttattatatatatattctccccggcaaatctgaacactgaagtaagccaacagtgtattatgctaagccctggctgttgggttgggcttaattatcaaattagttggcccaacaaccatgcatgcatagacttgtgtacttccttatcacctagactttgccatatatagatttgatattttttttactaaattccaaactgaactttcaagttaacttttaatattttcaaaaatcagaatatagaagtgcaaatttacattttcaaaattggatgggatggagtttcaaaaataaaaaaaaaatggatgagatggtacacaatacaattaagtaatggtgccaattaaaaacaattaatactgccaacaaaagcacagtaaaaaaaactatggatgtataccttttgccttgatctccctatgatggtgcttctaccactcatgaaaatttttaaaatatttaataagacaaggtatggcatcttgcaagatgtcaaaacataacttaattcaatcacgagaagtaacccaaaaataaaaggaaacaatttagtatatttgtgtttcttctaaaacaagtctatgagatgttgaaaattttgatgatgaacaagagaatttgtttggagctagttatatatagatgcgtgcgatatatatgtagtcatcaagactcttcaagatctggtgcaaattaatctatcgattggctttatttactagcagagtcaatggaacagtacttgtcttcaacagagtgggtgaagattgatggtgcttccttaattaacttaggctttaattatttgttttgttctgctgcttccatgcattatgttagcccataatgcatggaaaaaaaacttacccttttaatatgaaatggatcacattttttgacctatatatgttgttaggcacccggttagcttagagatgaaaattattgtagtttgttttaaaacttgaattaatcttaaatcaaaatatgttgctaggccttttatatataaaaaaaaggaaatatgttacccaaatgccatttctttgatcgtgttgattcatacttttgaaacataatagtattatcggttgcgacgaagattacgagagaaacattgctccgaacacataaataccatattccaccgaaatacaaagaaaaccgtgacatgggtggcttgtcacactc

SEQ ID NO: 22951 - DNA, 14190 bp, Oryza sativa
atctacatgatccgatccaattgactacatgatccaaatgtactgctaattcccgaatacctgaacaaaaaaattctaatccagacaagtgaatttttgtctgtcactctatactggcgcaccccagtctcgatcgagtaggccgagagcagctgagagctcatgaaagtagacgagttcatccatgccaaacaagctctcgccgtcaaggaggcacccatccatgggcttcagatccgcaagaagctccggcgccggcggcgttgactccatgatcggttcgtcagacacgccggcggctgtgcacggccgcagacgttcttcctcgccggccggcgcctccggcgggctcgattcatgcgatgtctcgctgttgttctgggcgtcgtcgccggagcacggccaggacacagaagcatcgccgccgttgctggaagcgaagctgatgaccatctgcgccggcgagagctgatcctcctcctcgccgccgtcgacgaccatggcggcggcgtcgtccccatggcggcaggtgtgctcgccgaagtaggtgatgatgtagacgggcgaggcagtgtcgtcgtccgccgtctccgactgctggacttgcttcgtcgccgtgcagccatggtcgtccttgtagctgcaccggtagtaaaacctcgggtgcttgctgttcttgatctccttctgcccgtacttcctccacagaaatttgtcatccattgtcgctttcctctcaatccttgctccatttcctccagcattgctcaccctgcacgatcaaattacattggttaattctcaattattccagattagtctcaaatgtacacaaattatattaaccaactaatcgtgtgaacttaatcaagtactcggttaattactcacctcatccttttggagctcgctgcagctgaagcggcagtcaagccacgaccacgccccggcttgcgcttcctgccgttgccgttgccggcagcgtcgtcgtcgtcctcagctccggcgaggttgacgccgtgcagcttggcgagcgcgcggtcgaagcagaggaggatctgctcggcgaggcccacagggccgtggagcgccgacgagccgaccagcagggcatacaggcgggccgccgactccctcccctcggcgacgagctgagccgacgccgcggtgggcttcccggcgatggcggcgagactaaccatagtgagcgccattgttaattctcagctggacagttggtagcttagcttcagtcttagcttgtcacagttttggattggcgactgcggtacttatagatggccataaggcccgcccggcacggcccggcccaggcacggataggcacggcccgagagcgatcgggccggcacggcccgattggaatttcgtgccgtgccgtgcctgcccatgggccgcacgtcaggcccaggcacggcccagtagcaatcgggccgtgctgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttagttgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcactaagtcaaaaattacccaaaatcataaactttcacccaaaaacttgacacaagtatttcaatgaataaagtagctgtgtagtgcaatggctgcctcgttaaaaacctttctaggtaaaaactcacacctcgtgagaaaaccctagaaaggaaaaaagagtgcaacccacagcattaatcaaatgttcataataaagtccaagtccaatacaatcatccagtcccagtggcagtggttacttcatcaagaaacaaattgtcaaaagagtttataagctctaaattctccatggtatgttgcatctttgcatctgcttgctcccaatctttgattagtgccaaagcttgcaccatgtcaggagctagacgccgtcgtcgctcctcgatgatcctgccagttaagctaaaagcagattccgatgatatagtagaaacaggaacagtcaaaacatccctagctaatatggaaagaataggataggtgtggttgtgctcatgccaccagttaaggatattgaagtcatcatcgtattggttgacagtgtcactgtcaagataggcaaacaactcagatgcattcatgttagcagtagaagaaacagcctgaatcaaagcggtagcagaagttctcctagaaaatgcaccagcaccaagtccagatcctgcactggcaccagcatcaccaagtccagaacctggactggcaccagcaccaaatccagaacctggactggcaccagcaccaaatccagaacctggactggcaccagcaccaaatccagaacctggactggcactagcaccagcattaccagcaccaagtccagcaccaagactggaaccacaagcagcagcaccaaaaattttcccccaagctgtctttttcttaccagaagaagagcttggggtttccctttgtaatctcacagcaccaaatttactttcatacttagcatacatgtcagacaatgcagccctaacctcatttaaatatgcagagtaatcaccactaataagttgtcccataatttggagaacattgctaaaacccctgatcttggccctaggatccaagataaaagcaaatgaatacagaaatggaatctcagaccagtatgacaagaacttatttttcatgggaacaacaacatttctaaggttccaatcattctcataagtatttagatgtccagcaatctcaagaatgtgatgcataattaatggagatgttggataataaacaccagacaaaataacagttgaatcataaaattgttcaaggaataaaagaacagtttcagcaattgtccagtgtaaatcagtcagtaatggctgaccatcagccattggatggtgagatgcaataaacactgaaaaaatgaccctatgtggcaagagatgcttaagcattagataagttgcattccatctaacatccatgtccaaaccaaatttacgaggacgaatacctttagcaatgcagaagtttttgtataaagcaatgcgctgattagatgcatttataaatgaaatagcagttctaaaatcttgaagcatgggtttgaagatttctagaccagccttaacaattaaattgatgatatgacatgcacaacgctgatgcaaatataaatcaccaatataaccagacagagcaggtttaagactatccattgctttagaattagcagaggcattgtccagggtaatagagaagatcttattagtcaaaccatattcttgaacaacagaaagcacacgttcagaaatattttcagcattgtgtgacacatcaattagcaccagtcccaaaatcctcttctctaattgccaattagaattaacaaaatgggcaacaacactcaaataatcctccttagcattaccagaccatatatcagatgtcaaagcaacagagctaacagacttcaaagtatcaataagcatagcacgtctcttgtcgaagaccttaaaaacgtccctactgatagtttgcctagagacaacactaaatctagggttgtgagcattctgaatatactcctcaaaagcagcagattgaccaaaagtaagtggaagatcctctctagcaatcaacctaaccaactcagttctagccacatccggtttatattcccattgactaacagaaccatcagcattaaacctaagcatggactgacacaaagcaccaacatttctaggtttgcacgatttaatatgcctaagcaaatgtccagtaccaccagttgaacgagcagacaatgttttatgacagtaattgcatttagcagaaacgcgaacctgagcgccattgcgctcttcaaagagttcttcaaagtcgtcccatacctcagacctggacctcttgttgctagcacttgagccagacggagcaccgttgccatcggcaccggtaccatcatcgtgtggctccggctgcgacagatctctcagaggtgaagcagtgttgccaaacacctcgatgcgttcctcctccaagtcatcttcgtcatcaccctgcgtccccatcaccctcgcctcgtagttgcatgaggttggatcaccatccatcgcaggcactccggttcctcaacggtggctgccgcctgccgctcagcgacctgcaagaacaaatgaaacaacgacgagagcagagagtagttacggatctgatcgaatagagaaaataaactaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaagtacagaatggagaggaaatcgacaatgcgaccgtcgatccggtgaccggagaggcggagacgaagagctcacggtcacagatcagccaaagagatgaaagaaaaggatagagaagagacgaccctcaagcccccagcgggagcccgctgaccctcggtgctagatccggcgaggcatccatcggagacgccgacgaagagggatggaggcgtggagggctgaggggtcggagcctggaggtggaggcggagcgggcgagcggcggatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgccgggccgtgccggcccaccgtgctgagggagcggcccaagcacggcccggctgttgggccgggccggcacgggcacgaccccagtcgggccgtgccgtgcctgggccgggccaatttgtcgtgccttgggccgggctgtcgggccccgggccttatggccatctatagcggtacttatataggacaagctccaagatggaatttgtttttagtttgagatttggacagtaataattaacaagtttttttttctacgaacacaacacaaatacttttttcacaaacgcgcaaaaatattacacgtcaatatattagaagagaaaatagttttttttgttacgtaacgcaatcagtccgatcggcttttgttttgctaggggaatgaaaaaacaaaactaaaactaaaactaggaaaagactactacaacggctaaacacaacacaaatacatacgcttataatatgcgcacactcatccctataatacgagcacctccgaaagattgtatcgatatactttgagattaatgaaatcactaatgaaatcactaagaatatctcgctatcagttatattgtttattattattgaaaaaataattaaccataaatacaagtattcatatcaaatcttggacacaacattaattagtaatgaggtgctatatagctggactgcgcacactgacacaagttaaattaatgaacacaaccacagaaatatggtgatggtgatgtttcactgaaccaacagttagcaccagtctagtaaaggcttccactgcgagttgaccaaaacaaaataaggatgccaaatcgcatgaacgatcgatttgacaatttaaaattctagttagggcttgttttatttccaaatcaagctagaaattaaggagggtatatgatgactagaatttgtctccatgcaccagttgagaggagccgttcatgtggatctggatgctggggattatatatcaacaactagcaaggttaattccagtgaaatggggccaaaaatagggaatgtcaactctaacctactaacctacctaattatagtttccttagctaaatatcaaatacttcatctgttccaaaataaacttgcctaaactagatatgatattttataatataataaatctagatatgtttattgtactagaaaatattgtaagatccacgtgtgttttgattcttattctgtgatgaataattggcatctgtgattattggttttgatatttggagattactgttgaagtggttttggagatgattgattttcagatgatgaacagggtttgctgttttgtcgggaccgatcagactgggcagtggttgccggtcagaccggcttgtgttgcacggtcagaccggccggcccgcaatctgaccggccgacgctatgtcggtttcagttttgggttgtttctttggatatccgtgattatttcatggttatggcttctagatggatactatacgtatgtaatactgttgtttgctaacaatgagtcaagttggtgatagcttggtctcggaatatggtttctttgtttgtttcatgtgtaggtggctcgatgcctcgggagagtatttgcagtgatggaccaggagtcggcttggtggtaagacgatgtccgtggtggtcagatatcatgcgggatactaaggctagagttgatgcacgtggttgatggagattccatatggcatacgatagaagtattgtgtgcgtatgggatacggagtcgaatttggaaggagtccaaatttggtatgattggttatgtagagtttgtttcttgtactaggaggtttcctatggggattaggactcttagtatgagtttggttcgtggctttaggttgcctacctcatgtataaatagaaggggagcgtgaggcttcccggtatcgcttttgtgtcgcttttcataacgttgtgttttagggtttcgagtttagtcgagatttttgtaaggagtactgttgttgcactttataaacacagagagaagtaataaagttgtcatctactttgagagttcttcgatttgtgtttcatcgggtgtggcggtctaaccggcgactcaacggcggtccgaccggcgacaagcggcggtcagaccggcggcatacgggcggtcagaccggcggcggcgacagcaagcggcagctgatctcggcggtcagaccggagattgaatctcggtcagaccgacggcaaccaggcggtcagaccggtgcatctacttcggtcagaccgcgatccatcgatttcgagggcaacttttatttccgctaaaagttttcggtttttgggtataccaaccattcacctcctctggtgggcttagttcttgtgattcgatcctacaaatataacatcttgttctagatttgtttattttggtatgaagaaagtatatacttaaggacagcatggaaatatatttataaacataaggaatcgagcctagatttgtgtaaaattctggcgcttcactccagctcacaacagcaagatgtggccatgatcagttagtctactacactgaaatttgacatgtgcactgaacactacagtaatatatacacattacatttggataatacttccacactttctcaatgtaattttgtaatactttcacactttctgaatagtacgtaacgtggccagctgtctacttgtatatacaaagatgattaaacttctgcttgcttccaaattagccccctttcctcgataaaaaaaaaatagcttcagccgcgtgcaagcatttttaaaacttctccaactttgcatgcagatgtgtgtcatgtgaacgcacgctgcagcttaactaccggtcatgccagtgtgtcaatgtgtgcacacatgagctgatgcttgtcaacgatcgagctgattcctgggaaagacaattaagatagatggctaggctacatatatcgcctatgcaacctaaacactcatacgacgaagtgtttagttaattagtagccctgatgacagagacattagattatctgtcgccaagtttgttgggataattaactcatagagtgtctgtttgactgaccgcatgtgactagcattcagatggagatctaaccatggatgcagtcagaccgtgtttcggtttgctacccctgtggaccaaacctgcccctggatcatgtacataagcttgtgcatatcactgcatttagtttggttgatcatgtatatatatttttttgttgtaaacatcgctgagatcaccaattaatcaaattaacagaggccgggcgccccttagtcagcagcttcttttctctttccatacatcttcctttatgcctttaatttaaaattaattttcaaaaagaaaaagaaacaataagcgtgtatgcttgacatctgacgaatccttaactaatgaagcccacttaagtcttaattagggtattttgatcatacttaaaaagttagcgcgagtgtaaaatttacctccagttattgaacatctcaaactatcttttagtgtaaaattaggtatatatatctcgaagtcctaaaattaaatatggtagcctagctgcaaaatacaagaagatgcgtgtgcatatggctggttaatttggccatgtaatcaattaacgcaagcaatattagttgcatgatatgatgcgagctgcgacgtcgggtggtgtggcgtaagcagaagcgtcgtcagcaaatgatgcgagatatgcagataactattctattcggacgacggccatatatatatattgatacgatgagatcgaaggcgtaatccgaatgcaatgcaatgttaatgaaaaaaaaataaaaggtcaatgcatgccgtgatgctctagctagctcacatggtctctgatgctctcctttgcttacttagtttggttgctgatcgattaagcatttgatgatggatatatacagggccggggaatcttggtcttgggatagatgcatgcgccggccggcgccgtcgatgcctcgatctcccatggcagcggggcagggtgcagtgggtttgccggatgcacatgcagtgatgcaggcagggcgtcctggaggaggagggggccgatgcaatttcagattcggccatgaagctcctggcatcaaggcccatctaacgatattcctaaatccaagggccgtattggttatatatgggcctcattagcccctcggattcaataattcttgtgtcatgggatgtgttatatatgaaactagaaaattaccccgcacgttgctgcgaaaacttatttaaataaatgtatgacagtaaagaaatgtaaggtgatttgttgactaattgaaagaagaaatgctatgtgctaaaaagtatacaacccatattctgaagttagttactctctgtatctgtatttaataccacttatccgaataacacaacactctatagatctggtagataatatatacatagactaaagcaacaataccctacatacctaaatagttgataatcttttcggatatgattttacaaataattaaaatatattgactatataaaatataattctggtatcttctatcaagtcaatgaggtttagcattatcaatatctagagaaatgggatagagcctaacaaataggcatctgagagaacgtaaaatataggcaactttggataatcatttgtgaggagattatggataccccaatttgtgaggagaaatgtagttagctactgtagcttcctggcagtcacagcacacagcactcaccaatgacacagttttctcctctaatcttcgtgcagaaatttgggtttgaagaagttttgcatggtcacctggggggataaagtagccccttacttataggactttgctccaaatgaaaaggatttttaaattatacaagttgtgaaagttgacgttttttagctggagattcggaccgtacttaataagattagaagggaggtgttacttgactgtgttcagtacactggcacacttcgttttcgtcgcatgagagatgggtagtacgcacccacaatttatctttaatcatgaaagacgcaaacacacgtcatgttgtttgtcctattaagatctctcattgaatctaaattgtatagtaattagccacagataattaagattgttgtacagaactattatatttgattaaaaagtggcgtgactagataaaattatcactcccgctatgtgtaacgtgtcagtattgttttaccatatcagctagactggcgtgatcaaaagattcatattctggaaatgagttttgaaagagtctatttttaaaattgaaaaataaaaaaagttcaaaaataaaaaaaaaatcctagctgcccagctttcttgttcaagcttgggctgacagattcgcccttagtatcattccaattctgggttgaacgttccctcaaaaaaaaattctgggttcaactttcaaccttgtgggtatatcaaaaaaaaaagcaccccatactttattagtattttcttcctggagaaagattttgaaattccaagttgtaattaagtagtggttgctagagattaggatcgtactaattaacaagattagtaggattggcggagaagtgctagctggaaactgcacactgtgcccactaggccactacagtccaacacaaccccagaggtggcgatattcattggaccggccggagtacctagtaagcaccttgctcgagtaaaagctcactgtgggttagttgacaaaaataaggatctcatggccaattggttgacaatttaaaaatgcatctcttgcgttgttgtctaatcaaggctagaacaacgaggttcactatgaccagaactatttgttgcaaatgcaatgcatacaagtgttaagagggacactgtccatgtggatttggatgctaagggattaaatcaaccagcaacgttccagtgaaacgggacaaagagaatatttatgaagtctaacctaccatcctagtggtggtttccagtgctaaatatgtccttgaggacaggttgaacattttataaacccaagcaaacgatgaaacgaggcagctagatttgtaaggtggtttttgacttaactttagtctatatatttagacactaatttagagtattaaatatagactacttacaaaactaattacataaataaaagctaatttgctagataaattttttaatcctaattaatccataattagaaaatgtttactgtagcatcacataggctaatcatggattaattaggcacaatagattcgtttcacgaattagaccaagattatgtatgggttttattaatagtctatgtttaatatttataattagtgtctaaacatcctatgtgatagggacttaaaagttttagttccatctaaacagggtctaaatctatgatctatgcattaccttcttaaagtatgttcgaaggtagaatatattatagcctctagtttatttagagactatcctcttataatagttgagacaacaaaaactaacaatcaattcactaaaatattttttattatttttttcctttttatccatagtcaagcaataaagttttcttttataaacgctaagagtcgatgttagccattgtcatacataacaatgatgtttctctcactttctctctcttttccatgtcaacaaacttattacgtactttgttaacaattctaaaaggttcctattaattatctatgtacatgcccttaatatcaaggtttggtggatattcaggatgacgacccattaaaagtgttgcccataaattattgtcgattctttcgttcaattttttcaatggtcgtcatcctgaactcaaccaattagagctctatactatatactatgcataaattggcttgtgcactatacactatattatacattacattacatgaatacttcctcactttcttgtaattttgtagcagtgtaacgtggccagctagaaagttaaacttgcttccttaaaaatttgctctcctcatcgcaaaaattagcttcacccgcgtgtgagccacttcatgcacgctatagcttgtcaactaagatgagtacgtggagtaagataagactacgtcttatatgatatcgcctatgcaacggaaatactcacaagagtacatagcctgatgagagcgacattagtttacttgtctgtctccaagctgttagtaggctaattaatccacattctgtacgtagctatagctagggtgtcatcttttacatttgacgacctgctttcagatcgagatccaaccatgcatttagatcgtggttttggttgctggtaccctaaagtaattttaccgtacttaagaagatactctatctgtttcatattacaagactttctagcattactcacgttcatataaatgttaatgaatctatacacatatatgtctaaattcattaacatctatataaatatagacaatgttagaaagtcttataccctgaaacaaagagagtaccgtataaaaaaaagttttggtaccttaactgtaaaatatgaagaacaaaagcttagcttagacatgactgacaaaagcccttatccatcgaaatttcgagatggcccgtacatcgcagacggagaaatgcgatgcttaccatcttttgaaatgggcctttttttagcccggcctgcactacagttcaagtgcagcccgcagtggcgagttgcaggccaaaataccggcctttgtacaagacgggccagcgcatagtcccatatacaatttgggctgtcctggcggtggatacaagttggactgttagctctagttggaataagttcattttggatccctctatttctagtccagtccgatttcgtcccttgaccgcaaaatcgggtacgacccgtcccccaacttacgaaaaccgggcaaacgaggtccctcggcggttttgaaggcggttttggctgatgtggcgcctacgtggcttgtttgactaggtctctgtccgacgtggcattgatgtggtgcttacgtggcaattcaactcgaaaaataaataaatctcgtgggacccacatgtcagtttcacatagaaattataaaaaaggtagggcccacgtgggccccacatgtcattcttttttttaagatgaaaggccagaaggcccggcttttacttgaaagccaaaacggcgaaactcgctggggatgccagcatacaagaagttcttacagaaacgactgcgaagcacaactcacacagagacccagggacagaccccctgtgtcccctagacaggaaactgaaagagggactccagcatggggacagaaagaaaactactaaaaacagagaaacaactctaaacttccaaacgatctcatcctaaccaacaccaactcttggaggtcttagactcaacaccaccgatctcatcctttccaccagcgcgtccagcttgcattcttcctcagaacgaaagagttttctccactgcaaaagattagaaataatttgaaaaggaatagttagtggagagtaaaccagtttccctctaaacaccatggtatttcttgtaatccagagattccaacaaacagcagctaacagactaaaaatgattctaagtt

SEQ ID NO: 22952 - DNA, 558 bp, Oryza sativa
tttatgttgtccatgtcacattttctgacatcagggccttcgtctccttgtcgtcttcgtctgcaagcagcaagcctacgccggaggctagccagcgagctccgggaaggctagatggtggtcgtggatggcgacgactccacgcggtggtcgtggacggtcgaagagggagccaaaggagatgagcgcgaggagatcctcgacagacaaatcggcgctggagaaggagggcacagcgatagatgggggaggggcgggacaggaggagagctcctcagcgagggcagcggcgagcaggacgcgcatccgctcgagctcatcgatgagcgtgatgatgacaggttgggatctctgcctagatctggtgagagagaagccaccaccgagctaccgaggtcccgccatggctcatccgtcccgccgctcgctcgtcgcttgtcagtgcgggaagaggcggtgagggtggtggttgctcgtggagcatcgatgggctggagcatgggggcatggtagtggcgacgcgcgacgacgaggagctgctgtccaggcgcgacgacg

SEQ ID NO: 22953 - DNA, 6095 bp, Oryza sativa
  unsure (1)..(6095): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtccacagcttcacacacggcaaaaccgacaatgctcgtggctgcagaaaggcacgacaagcatgcccccacgaacatcgccggcccggtgcccatccatcccatgtgacgagaagatacgtacggccggggggattaagtacgcatcaattaaatccctcacaaaggaataagtacaccttaattgattactcctccattacacccaaacaatacaggaacagagaagctacagccgctagctacgacaaagtacaacatcaatagtccccttgataaataaaacacggcctcgcggtttttaattccgttgcaaggccatcactccggtacaagaaaacgctcaaaagtagaaatttaatcaatacaattattattgattttttcttcaagtagtactaagcttagtactcccctttactactaccactacacttgatgatggtggaccggtccagtcattattggacgaagtccagagaaggaaaacgtctaagcgggtgctaattagcagcctcagcatagcccaaaacctcttctccactataacgaagaggcttttctttctctcttgctcaaaataaataatctctcaaggaagaaagacgacgacgagaacgaagacgaagaaggacaccgtgctattatatgtgggtgtcggagacggcgatgtcggtggcggctagaactggccaccctcgaaggtctggccgaactgccagccggggtgggcgacgttgttgctggtgacggtgcggccgtcgctggcggtgacctggaaggagaggctctggccgtcgaggaacgcgttgctctgccagttctggccccagttccgcgacatgggctgccacccggtgcgcgaccccttgatggagacggagcggacgtcgccggcgccggccacgttggtcaccagcaccaggttgaagtaggagtgcccgttcacggtgaacctgaccccacccttcttcacgcacggcaccctgcagcaaaaaggaaaatcacacgagaccgcgcggttaatactggagtacatatgttttttttctttcttgctcgatctcgcggtgaggtgaatcccgcgaccgaatcggtgtgaggcagtacgtgacaatggcacgacgcagcatgcacatgcgtagccactgtacgtggcgcagttgctgctgcagcagcagcagcggcctatctgcatgcaacgtatcaaatccgcaggctggtcccagcggaaactaatggtcactcatggcacgcggccgagcctaatgtggggcccggcgtaaagttgaaaccgaccgacgtcgcgtgtttaattgatccggccgatcgtgccaggacgtggcggtagtacaggactaaagtcgcaagtcataactgaccactattggtacgttttaagttttaacgtgtttttttttctcaaggttgtttaaacttgttcgattctactactacggtagaaaccagctgagagtctgtgaaggcgaagagaatgtgacctgcggaaggagacggggacgatgccggcgcggtactgggcgatgtggaggaatgccggctcggccatgtcgaagtgagggcggggcgggttgcaccagccgccgtcgtcgctggggaggccgtagttgggcgggcagaagttggtggccgtcacggtgatggagcccggcaggcacgaactcccggcgttgtcgcaccgcagctcgtagcacgacccgcacgccgcgccgtcgttgaacagcgccgtgctcagcgccgcggtgttcgtgccatacccttggctgtacaggttgccgtaaccgcaagccccgcctgcaaattaaagaccatttcgatcgtcattctcgccgttgagctacagcaacacgctgcattcgccggctgcgcatgagattctactactcacccatggtgccggaagcatcgccgccgccgtagaacgtggcgtgggcgctctgccacccgccgtacccggcggcggaggcttgccgtgccaagaagaggaggaagagaacgccagcgatcgccattgctggtgatggtgtctaaacgctggctagactagctcacttgaagcggagcttggcagtgtgaagaggttggccctccaggcctaaggtatttatagccagcaagccaaaagccaagctagtgccggtggcggttggatactctcgtctcggagccgtgcacatcttttccttccccccgatttggtgagagaaagtaaaaaagctactcgtataactggtaggagtagtagccagccagctctgttgcgagtgaccacggccggccacggtggccaccggcagttaatacatacaaatcaggcgcacatgcgagtgtcctccccgcaccggcgcggccgcgggcgcgcgcgcgcgcgcgcgcatgtagtacgtaacagagccaccaactgcttggtgaagtggcgcgcgtgcgggggccccgcccacatggctctcgctagccgcagacgggaaccatgcgctgcaagcctgcaactggcgccgcggcgcgtgtggaccataagcagatgggcgcccgcgccgctgcgcggtgcgcggtgcgcttgggcgcgcggctcgaacgatcgatcggctcgggtggtgtcgcgcgcgcgcggggcgccgcacggccgcgcggcatggggtggtgtccggtgggcgagtactgctgctgctaccaccacgcccacgcgacgtgatatgctgttgccttgcctgataacgatgtgatcggcatccgctgggggcgcgtgcacgtgcatgtcgattccaactcggtggcatcgtttaatgctaactgcttgtgttgtagtgttactggtgcccatatgtggctgtgggtgacccggccatctctgataatctggttgccgtttctacttgctagattttgattttttttctttgtttgatcactcgtcttatttaaaaaaaattttaaaaaagttatgtttatagtactttagataataaagtaagtcacaaataataataataatttcaaaattttttgaataaaacgagtggtcaaacagtgcaagcaaaaactcaaaatttcttatattatgagacggagggagtatattttttcgaatatggtcgcgtgaggtgggtttagggtctgtttggcacaactccaactctatgtgaaatgagagcgaagcaaaggtgaaacgctctcacaaaataaactagagaggtaaaactaggtttaggcagcgccagaattctactccaaactcaacttctgaaactaaatttagcgttagctgatgacagaagctctcggtcccttggatggagcggacactggacggcctgaagccctgaatgctctgccagtgtcaacaaccgttaattcagatcggatgagtcgattagccctacaaagagcacactgggccgtcgaataatacacataacagattaaagcgtgttattgtcggggcacaaacgcacatcactacatcagatcgccagatgaaggttaagctaaccccacacacggaaggaataatccttctcaagctaaggggagatggtcagatggacaggtaaagcaattagtactaaggaggctagtattatataaactttagattactggcttcttcaggcgttcaatgattatcaggcgcaagttttaaggtggatagggtgtgaaatgggcaaaaccttgccctgtgggctcatgtccctctgaagcatatgcaactaggagaaagattggatggacggagacgccgcacatggacacacacgctcacatgcgtggaacatggctacgaccgtgtaggctgtatataaatccaacagcattcaaacaaagctgctccctagcttatgcatatccatgcacaagtccaagtttgtaaacttcaaaaaaacctcatctttaccgatcacgtagaggccgtgcgttttgttgacctttttttgtgcaatcgggaagttttgatttttcccttgcaaaaggccttatgctttgtgtcaagctggtaatactagctacgtacctgagctgctccctcctcttcggtttcagcgaaagcaacacttctccggactcagcatttggtgatggcccccatgccatgttagccgcacatggcgtggccaccccccctgccattacggttaatctcctgtcactaacctgatcacctccctcttggacccgtcctgagtgctctgaacagctctgagtttgatccatgctgaattgtggtgctcctgcaatccctacacaccccaacttgttgcctagcaccatcactgctacagaattattggttcagattagtataccatctctctcattattgatcatatgttaccacttgacatgttcagaagaatccgttagaattaagagcggagggagtactttacagccaaaacgactcaatgtaaaaaaacaaaactgcagtaactttcagttagcattggtatagtagtactactagtggagcagttttgtgaaagttcagaaaggttgcaggttgtcatgtgataatttgccacggcgagtaggaacagagcacgtaacagtgtcgtggatctgctcgctcctgttccccggtgaatgcagaccgcatgaacaagtgacaaggacgcctctggggagagccatgtgggggggacacacagaaatacgtagtagatcacacgatcttgctctgacgggactcgtaagcttgggggaaccctcggccgcaagctcgggcccctccaaaacggggccgatttctctgcaaaatcacgcaggaatgaaacgtcctctctgtccgggaaggggaatcttgtgcccgatcgcctgtgatgatctgatcaatcatctcccgaggtgtatacgctaccatacttccctggttaatctactcgtctcgctgatcgtcagacacacaatcatgcgttgattcgttgcacagtttagctttttacagagggtactgcctacctggtgaaggttctcgcatgattgccaagaatattctttgcttggacaagcaagaattaatggctagctagtaattggctattctgaatttttctgacccagcatttgtagatacagatgttcaattctcttcatgaagatcgacatggttgacagaggaagcaacactgtcctaactcccaagaactccaaaacttttggtgaattacagctgaacctctctcatgagatgcaatcaccaacgttgagtgtctgaaaacttcattagccgatcacgtataactctgggcttgcatttgatcattgtcttcaatggaaggatcgtgcgtcgctgtctccgatccattaatttctttatggcaatcaggacggcgcatgatgtgtacaggggagttggaatactcccatctgcatgaatggtcctgagcaagtgtacgtactctctcatccgggtgatggatcatatcactggcctgcatgaaccattgcacgccgtgtaatagttttgaatttttgcttccaacgtttaaccactcgtattatttatttttttttgcaatatagaaatcgaaaagttgtgcttaaagtactgtggataataaagtaagtcacaaataaaataaataataattttaaatttttttgaataagacgagtggttaaacgttgtaaaaaaaaaattaaaatatcttatatttactagtgtagtagtagtagtgtgtgctagctaagctagctggaactaagctagctggaactgagcacgccgcgtcaccgatcgcccaaaagctgtggaataatctgaagcccaagctacccttcttttttgcgttatccacctcagatctttgcgcatcatgatgaaaggcacgtt

SEQ ID NO: 22954 - DNA, 19876 bp, Oryza sativa
ttcctgcagccctcctacttgatgcatctcaacattatctaggcctaagcctgaaaaaaaaaatcgcaatacaggccctgttcgtttctccaactaggagagattaaattttgtattatcatggctgctaaacgatgcgtttcgtgcgaaaactttctatataaaagttgttctaaaatatcagattaatctattttgaagtttgtaataattaaaacttaattaatcatatgttattactacctcgttttgcgtgaaacacttaatcttcatcttcatcttcaggagattcaaacaccaccgtagccgtgtaagtttttttatttactctatcatccttgctgatccccccctaaaaaaactatattatataaggctcctgtagcctttggctacctagataatgaacataagcacattattaacaagacaccgacactccgacagcttgtctagcgcccatctcatagtttaagaaaatgatataaaaatgatgcactttattcatgaaaacgaaaacgaaaaatattcttcaagattgttctctttttatatatggaagactcatatgcgtataattctttacatggcagtatataatattaaactactttgtttatcttgttaaagagatagacaaagcatccccgcaaaaaaaaagtagtttaatgggaaacgattttgctatatatttgtcgacaaattttcttttaaaaatttgacagatgtaattacagtacaatcgtagtgtaattacactgtaacttgcatgtaatcacactgtaactatagtgtaacttgtatgtaactttcaaaaatctctttgtaatatgttatttcggtaaaatggaggttgtgggaacaaatccttacacatgtttgtgctgtgattttttttcttcctcaccaaaacaaatcttgtaatagatttaacgattcaaaattacgtgaaacttatatacaagttacaatgtagttacatgcaagttagaatgtaattacatataagttacagtgtaattatactacgattgtattataattacatctgtcaaatttttaggagaaaatttgtcgacaaatgtataggtggtcccaatgggaaaatacacgcagtgtttcttacatgagttgccaaccattccagcccagaatttaagttagtcgggccgctccaaatacacaatagacgggcctggtcagacaaagcctatcattccagcccaaaaaggaaaaagtacaccgaaggtccctcaacttgtcatccagttacaaaatcgtcccccaaccgcaaaaaccgttcacaacttgcaaaaaccgttcaatttaggttctttggtggttttgaccccggttttatcctacgtgtcagctgagtcaacgtgagacccacgtgggccccacatgttagcgtggccacatcatcatcctctctttcccctcccctctctctcgcacgcttttctcctctctccacgctgcgccgcgcctccctcccggtgctcgcgctcctcctccacttccgcgtcctagccgccgccgcgggtcccacttctcccccagcgatttcccgcctcgcgggccgcctccgcctctccccgtctatggccgccgtcacgctccgcgcgctcggcaatggcgtgcccgacgttgcaggagggatggcgaacgccgcggcgatgagcgcgacggccccgacgacgaacgcggagacgaacgtggagacttcctggtggtgaagtgcgtcatgccgaggaagcccttgagctgctgcagcacgatcacgaccgccgtgccacccatgaacccggtgattgctgaccgcgacatgaaatccatcaggatcctgcagccctgcagcaaacacggatcgatatatcagtcaggaaatctcaggaacacacataaagatcggagagatcggtcatatcgatctcgcgttacctgaggaatccaagagtagcctacatgacgccggtgaacaaggccgacacgaagacgagctgcgtgtacagccgcgggtcgtcggacgccctcaccttgccgccgacgatggacgccaccagcagcgacgacgtggccaccggccccaccccgaggttcctcgagctccccatcaccgcgtacaccagcggcggcacgaagcacaaatctgtgttcgcaacaatcaatcgacaaacgcatccatcaaaggtgttcgtccgcgacatgaacggttaatttggcgtgatctaacagaggctgatgaccggagggatgccggcgagggtggcgtagctgatgccctacgggatggagaggttggcgatggtgacaccggcgaggaggtcgtaccagaagcttgccgcggagtaccccgcacctcagtccagcgccggcacgaagtacctcgccacccaccacgcgcgctgcgcgggcggcatcccgccgagccgcggaacgggtcatcggggaagagcgtgtccttcagccccgcccgcaccgccacgctgaacggccgcgtcgccgccggctgctggttcaacctggccctgcagtggccccaacgacgaacgtggagacgaacgtgcgacggcggtcggtgacaggcgacgcggtgtgacggcggcgacgctggacaagggaggaggccggcgggtcgagaggaggtcagcggggcgacgagagagagagaaggtccggcggctggctcgcggccgctcgctcgcccgccgctccgccggccacgcgcttgcttgccaccatcggccctccgctccgccggccgcccgctcgctgcagtgttctcccgctgcgtgtgcgcgcctgctgccgcttcgctccactccgtcggccggcgagcgctcacccacctcctcgggccatcctacgccccgtcccggcgccgctgcggccggccgaggacgacatcgacctcggcatcctcgtgcgagagctcgctcgtcgccgcccccgctctgctcggccggctccgctctctgccgctccgccttctttctccagccgctcgccacagcccactgccgctcacccgccgttgctttcccctctgcaaccggcgacctcccggagctcgccagccgccgctgctccgcctgtctgcttcgccacgctcctcccccgccagccgccggccgcgctggccctccatactgccgcgtcgaagatgctactgccatccacgcccaggggaacatgagagaggaagggagagaagaggggggagagagagagagagagagtggtgacgtggtcacctgacatgtagggcccatgcgtgtcccacgctgactcagccgccacattagatcaaaccgggatcaaaaccaccaaaagatgtaaagtgaacggttttgtaagttgtgggatgtcatatatctggttttgcggttgagggacgattttgtaattcgatgacaagttgagggacctttgttgtactttttccgcccaaaaactaggccattggagtaaggaaaaagtccactttaactcctttaaaaagtaggccgaatctaattcgtacccctcaaccagaaaaggaaaaagtgcaccgaaggtccctcaacttgtcattgaattacaaaatcatcccccaaccgcaaaaccggatatccggtatcccttaactaatcaaaaccggtcacaataggtccctcggcggttttgactccggttttatccgacgtggcagctgactcagcgtgggacccacgtgggtcccacatgtcagggagaccacgtcaccaccctctctctttttcccctcttctctcccttcctctctctctttttccgatggttgccgtcacgcggggaggagcgcggtggtcgtctgccttccctcctcctcctccgcgtgccgcgcgacgccattgccgtggccgcgcgtcatcgtcggggtgaggcggcgacgcacggtggcgcggcggaggggagggcgttggcggccgcggtcaccgcaccaccgtacgccgaaattcccccaccgtgcggacgccatcgcctatcttcatcttcccgagcgccaccagccgccgaaattcccccaccgctcgccgcctccccctccccctcgtaccactccctggcgacctccacgacgccgacgatgtgacgggaggcggcgccggcgccggagtggtagaacaggcagcagtcgccccggcgcatggcacggaggctgttgatggcctggcggttgcagacgccgtcacacggcgcgatctgtattatctgttcagattcaaggagatgacatcagcagcaatgtctactctgaacctgagttcatctcctctgaccaagcaacagctccgatttggagccaacacactcattgcagaacacgtcagtggattcagctctgcaaggccagctccattgctatgttggtccagctctcactagcgagcggtcaagctgagaccgaggcggcggccatggcagcgcgccggaaaccgggtcgtcgcgcaggccggcaactacaaggttgctatccttggcgccgccagtgggatcagaccacgaccactcccccggttccgtcttgagcagctagtagttgcagttgacggcggtggcgttgggtattgctttcttcggcggcggcggcgtcagcggtggcagcagcagcggcagcaccagccgacgccctccctctgataggcgatggcggccgcagtcaccgccggcttctcgtccgcatcgccgaccgcactagggagatggggaagccggcgagcccgcgcgctaaacaagtcgcatcaccgtcgccggccacgcgtgccgccgcccgtgcgagagtagagagcgagggggaggaaggaagaagagaaacagagaaagagaagaggggaaatagagtatacgttagcgtggcaccctaacatgtagggctcacgtgtggcccacgctaagtcagctgccacgtcggacaaaaccggagtcaaaaccgccgagagatctattgtgaccggttttgattagttaagagacgccggatatctggttttgcggttgggggataattttgtaattcgatggcaagttgagggaccttcggtgcactttttccaccaaaaaactggatagagtcgtcctatctggttctttggttgagtcggcctactttttaagggtgtcaaagtagactttttccttggagtaaaattaaccggcccataagacccccctgcgtgggcaaaacaaggccgtcttgatagtagatggtgggtcgtatgcaacagttctcaaagctcgtagaaggaataaattggtcgccgagtctaaaatttgtccctaaaccaaataccgatataatgtgtccatcaattttataaaccggatcacacgatgttctaggcagtattatacccgattttagctaacgtggcaagctaagtcaacgtgtgaccacttgcctgacacagccgcctgtaagaatgccgctgacacagttgcaggagagggaggagaacccatcgtcgccattttcggtcggcatgttgtgcgtgcatgatctcggcaaaccgacgcgatttatagtagctcccagcctccgacccatcgtcatgtcgctagcatgagaacgccaggagcttgcacgcccatgccacaaggatgaggtttagggccgagttcaagcagaagaagatccattggaggagagcctcaaggtcacgcatggtccttgaatctgacgtcgccggcttgatgcgcgctccctccgatttttcacctttgtcccattcccacaccgctccgtgttcacggaacagaaccacagatgacacaaatctagcaagaaaaccctcgcaacgtatcatgccacataatgccacatagacaccatgtatcacacaagaataactatattgggactttattactattcgcttttaaaattaagggacacttcatacataactatatgactggtattgtggttcagaaaggaagttcggactggagtcgactagtggtccactcctgtcttccggctaaagttcggcacaacatgttccagaagttttttgacctcgccagctgtccattgatctgtccctggcagcgacgtgacgtcccagagtcaattaaggtcgctggtaacagccagtgctcggctcgctccatccctccgtcttccacggcgcgagactctctcgaccgcttcagacttcacatcaagaatagatgcgtgtgtgtgtccaaacctgtatgcttcgccataacacacgacaattgacaagcgaaacgccatgggaaatatccaaaaaaactctactacttgccctcgcttgcacgtcacccgtaaaacgcaccgcaccgagcatcattcccagctgctagtgctacccaacctgatctcgcctcaacccctacatatacacgcacacttcagctctcgtcgtcatacatctgctagtgtgatcagtgtgggcacacgttgcacacaggagtttgaggttgaggaggagatcgagatggtgcccgcggcgaggagcgggtggccggcggcggcggcggtcctggtggtggtgctggtgctgtcctcgccgccggggactagcacggtggtggtggcgagggcggcgctgtcgtgctcgacggtgtacaacacgctgctgccgtgcctgccgtacgtgcagtcgggaggggcggtgccggcggcgtgctgcggggggatccggagcgtcgtggcggcggcgcgcaccacggccgaccgccgcgccgcctgcacctgcctcaagaacgtcgccgccggcgccgcgggcgggccatacatcagccgcgccgccggcctgcccggcaggtgcggcgtctcggtgcccttcaagatcagccccaacgtcaactgcaacgcgtacgtgaaaaccaaaaatcaaattaacctctactagtagtactacctccgtcccaaaataagtgtagccgtggatattcgtgtccaacgtttgaccgtccgtcttatttgaaaattttgtgaaaaatttaaaaatatttagtcacacgtaaagaactattcaagttttattatctaatagcaataaaaatactaatcataaaaattttttaaatgagacgaacggtcaaacgttaaacgtgaatagtgtaaaactacacttattttaggacggagggagtacttacttttttttccccttcgttttttgcgtgaaatttgttggtgtttttggaacggttttaacgtgttggttctggacttctggtgcagggtaaactgaggtggaagcagcactttcggcccgcatgcatgtgggctcaggggagccatggcccgtgggccgtgaatgaataatcaacgtgcttgtatgtaccatgtcgtgtactcagcagttcacaagtgtgcttgtccgatcaatcaccaaattaaaggactcttatgactgtgcgcaattgtgcatcgtgctagcgaccactcaactcaactcatgcagtttcgtagttagtcgcgtaaggcacgtggcgaggtgcagtgaccgtgacaatgacatgatcacgctgtatgttctgaatcctctcatcttcgatgcctttagcgtcaggaagtgacgcacaaacgaaggaaataatgggcaaagcagaagacacaggatcgaacgcagcactgctcctatcctccttagcacacatgcactacaaaaaagagagagcataagctcgaccgcaaaacacacaaactctccaaaagagcatttcaggagccccggtcggcgtattcagcagctaacgcaaggctgttcgtggcaattggagtagattgcagagacaccgacacgtttttttttttttttttgcacttctttctcgtgaaaggaggcctgcgcttttgctgttctgcacaggggcggctcacggccgtcgaagtgacgacggaccaaccaagctaattaccgcggtgatccagacgaactccggcacgtacgacgtgtggaaaaatctaatatgttatattatgtggttttctgatctattacatcaaccctctcatgtggtatatataggagtacatatgggataaagacttggagtacaatataggtaagagttgatttatctctagaattttatctctaggactctatcttatctctctaggattctatctctagaatatattttatctctataatttgtatttgactcttatctctaacaaacacattcatacttctaacacgacggacggtagtcgccatcagaaccgagcacgcagcaaaagctcggctaagctaagctagctatggctgatgcttggctttgcctacaaagcaagcaaacaaccccccccccccccccaaaaaaaaaaaaaagtcgcatgggcactagcgccatggcgtggcgcgcgtccctatccctgtaacaacttcgcgccatgcgcaatggcgcaattcaacttgggggggagggggggggggtgatgagatgcccttttacaagtacgctcgcgcgccccgcggcatccatcgccaaagatgcgcgtcgcgatcgctcgttcgccgcgcgcgcgcggctgcgtcttcgtatatatctggcatggccgcgcgcgccaggggctaggctagctacctccatctatctacctggagttagtgtaggtgagaggttaggtcgatcatggcgagtggtgttgcggcgccggcgccgagcgtgttcgaggcggcgcggccggcgttggaaaacggtggcggcggtggaggcgcgccccccccggcgagggcggacgcgagcttcgacaccaacatggtgatcatcctggcggcgctcttcttcgcgctgctgttcgccatcgggctcaactcgctggcgcggtgcgcgctccggtgcggggccggggcgcggccgccgcaggcggcggcggcggcggaggaggaggaggagcggcggcggccggggtggggtgcggcggcatcaagaagcgcgcgctgaggagcatcccggtggaggtgtactgcggcggggaggagacggcggagaccgacgtgtgcgccatctgcctcggcgagttcgcggacggcgagaaggtgcgcgtgctgccgcggtgccggcacgggttccacgtccggtgcgtcgacgcctggctggtctcgcacggctcctgcccgacgtgccgccgccaggtgatcggcggcggcgggagcacgccgccgccggacagcgacaccatcgccgtggtcgtagcatgatgtgagagacaaaagatatactactccagtagtcttcgtagctagctgggctcctgcctggcctctttggcgccaatcccttctaaaaaatatctcgctgatcgatctgatctctccggatattttccggcgaacggctagtgactagtgactcatcagcttgttgtggcgaatgtattgacgggtgcccaattggcccaaattggtcactgtatatacacgttcaacatcgccgtcccgaaatgtactgtaccactaacattttcgtacggcgcccttctaagaaacactgttacatttgcgtactcgcgtgtgcacgcactggattttctccgtggccacgcgggtgcccgtcgccgtcgccgcagctcgatcggcgggggggattttcgatcgccggagttggggaagatcgagcggccgcgccgcgtgcgagcgagccaaccgacggaacagctagctgcgcgcgcgcgcggggccaaggccaacggcatgccttaatccgcacgcgacgtggatcgcgttgcggcaaccgtcgagattacgccgtgtcgccaaccccgcgattgccacggctatctgctctcgcctacctgcaagagcacgtacgctcgagttcgtcctgtcatgttcatgtctgcctttattttgccagtggaacctactagtaacataaatatcagcatatcgccgtcaaattatccaaccatcacatatacagtacgtagacagcgtcgtgccggattaacgagcggctcgatcctgatcaagtccccggttaaagttaaacaggatgtagtcacgtgcagcgtacaacgcaaagcccagagaacaaaaaggaacagaacagtcaggatcaatcagcctcgccaccgttttgtcttttacttttccttttcttgttttttgcatggcatgtggatggatgaagaatgacgcagcagtagcattagtaggagtactttacaattaccggctttatacaggacaagttaacagaagtagtccatgagctgcacccgcggcaccgtggccggcgggcctcgcggcgcggcggcggcgcgctccatccgtcggcggcgctgctcccacgcgctcctgagccagcaaagcaccggcttcaccgcctcgagccaccggaggaacaccgcctcgacgacgtggagccggcaggacctccacggcgccgtgcagccgtctccctcggcgccgccacgctgcggcggcgcgacggggaaccttgccgggctcggctcggagtagcaccgccgcaggacgatggcgcggttgagctgcgcctcgaacgccatcctctcgtactcgtccagcagcgcgctgtgccgcccgccgcagccgtcgctcacgtcgaggctgtaccgcgccaccacgccgccaccgccgccgctgacttcgtcttcctcccttgctctctccatgtgtacagtagccgttgccaactgcgagtacacgcgcgtgtaccataccaccacattgcgagtggtatttaggcagcgtggtggtccatgccgcggcggctacaccatttttttggagcgaaagcttgtgcgagcttgacgtcgcaaggacggcaaggatcggtactactactaccggatgagcttgtttcgtacggattcttgtcaacgaagcacgcatacatgcatgatgcatcgcatgcatggttgtagccgtagattccgatgaaaatgagacggcgatcttatctcgtctagctaggcaattttggttagccagtagcatagtggatagagagatttgttgccaaattgatggatgattcttcgctgagctcgaatgttcgatgttgtaaatattcagtgagggacatatacgcaaggaaccaacaaaaaacttgcaccataactgtcatgtacgagattccacctctgtcgcttttattcccttggagagaaaattccatgctctttactctttagcaaaggcataatgtaaagttgcacactgcaggtgcattctgcaagcaacctgctgaattttgagctgagcacaactttttattcctgaagtagtagtaccactaccactaccacttgctatacttgctactgcatttgccgtttactatttttttaaaaaaaagaaaaatcagcgaggtaaccttatacgacgatttcagaataacatacaaatgatagttgtgcagaaggtatctcagttgccaagcccaaacgctccagaaggatagatgctccacattgcaggctatttttaataggtcccacaagtatctcccctctctgccttttcccaccgatggaggaagctgaggtgccggggcaccggacggaacggcggcaagacggcccaattgatgaatggatcctcgagcaggaagtgccaagcagagcgcggcgacacattgccacatctccttgttaagggcggaagtcgcgggataagacacaaatgatagcgccaccaagctcgctagatccagcccggggcttgtcggatctaaccttgggcaatggaggtagctcgtcgggcgcgacgcaaggatggcaacagctcgacacaagcgccacctcactcctcccttctcttaccgacacctccctctccccaccgcctcaaactccaaccgccgccgccaccgcctatcggctcttcaagacgatgaagccttcccactccccggctctgtcaccgtcccgctcctcatcgttgatgtggcacgagcacgggtggggtagatcgggccatcccatcgagagccagtgcagatcgaggtggcaacactagagcttagcggcacagacatggagctcggcgacaaacggacctagcactcagtggcgacggacatggagctcgatggcgatggcctcgtcgtccacggcaattcatcaagtcatttttcctcccttcctctctctctctctcccccctgatttctgcttcctctccagctttctttgacaatgcctctcactccttgtagggagacacatttttcgcagggatgcaccagttgcctatatggaggggaatcttctaggtgacaagttgaaactcaataccacataaggtggactgtaaaatggcctaacaagttataaacatgaagagatgaagaggctaagagaaaagtaattgagaccacaattatatctcgagctttgaatctacgagactcgaggtggttccttcgtgaaaatcacgagttatatactacttcctctgtttcacaatgtaagtcattctagcatttcctacattcatattaatgttaatgaatctagatagatatatatgtctagattcattatcatcaatatgaatgtgagaaatgctagaatgacttacattatgaaacggatggagtatatgagaattatgaaaagaaaaatagaaatcaagaaaaacacaagagccgtcttttgtcattctttgctctcttttcactcaatgattcattataatttctcaaaaaaaatgtatatgtctactcatagggctttggggccttgttgccaaatggtataagatggatcataactcgtaattatgaactgcatccttaggtatcaaagtatgaaaagatgcttttgttattcttaatttgcagttgcaaagaatgtggccctttatggtccatctaaattcatatcacatcctatactaactactaacttgatttattttagaaagaaagtactatatacattacacgttcagcccttttttttaagaagttaatggtaacaagatgagtccacgggaggagtactaacattttagggtgtgtttgtggagaaggggattgaggagatcgggaagatacgtaaaacgaggtgagacattaactcatgattaattgagtattaattattttaaatttcaaaaatagattaatatgattttttaaagcaactttcatatagaatttttttttaaaaaacacaccgtttagtagtttgaaaagcatgcacgccgaaaacgacgtgcattctcactccctatcacccaaacgaacgcagccttatacgtccggacgggagttggacggattgaattcaacgcccaacctggcccaccaaaattgccgtatctctcaagtacgaagaggagtttgaacgaaatttcaccaaaccaccaaacccaaagaccaaatcaccaagaacgctcaaaaaaaaaaagaaaaagaaaaagaaaaaggaggcaaaacgacccacccgcttcacatctcccaagctcctcgtctcgtcctcgtcgtcgcgcggcggcgcatccaatccctcctcgctcgcatcgaaagcgataaaaccctcgcgaaaatctcgaccccgaggcgcgccgatcggatcgcctctcctctccatcccctctccagatcccgatccaccggggagcctcggatctctcgccggaggccgggcccggagcgcgcgcgcgccctttttcgcgggcagatgcgatccacgccgcgcccccgccgccggagccgacgacgagtcggctgacgccgccgccattccctgcttccgattctgccccgcgcgccgccggttcgatgggctcccgcaggttcgccgcggttgtcgtcgtgctcctcctggctttggccctgattcccggccccgcggcggcggcgggtagggccctgcagggcgagaaggcccgccccagcgaggtgaggattcgatttcgaggtcttcccgttaattggtctagattacttagcgcaatggattggcataagccatagggaggacgagctcacttagtttgtgttgtttggatctctccaggcagctcctgcacctaccgtcgctgcaggtggatcacataaagaatcggcgaaatcgtcaaatggccagaatcctgtgaccaaggagacgcaccaccaaacgccaccgccggcaaagccgccgaaggatcaaacaccaccgccgccaccagctgtgtcggagagcaaggggcagaagggggatgccggtaataactctgggcacccggtgccaccgacggatgcgcataagacgagtcccccgcctgaaggtcccgggccaactggtgggaaggagcaggaaggaggagcgggtggggagaagaagaatccgacagaagaaattaagaaggtgttgagttgtgaggatgcagcggagaaatgttctgttccaggagaaattaccgcttgccttcaggtttttaaggatggtaaagccactaattaccttggaaacttcactatgttcaattaattgagtttctgtttgctaaaatttataagggtagacatatttttatcaactgtatctgttgagtaaaaaaaatgttcttctgaattagtaccttttgcaagtccatttgagccatgcttgcatagttgcattcaatttgagccagttttattgcaaggatccagccaaggacaaaaataatgggttcatttcacgtgtcttgtttataagctgcagtgtttaaactagcctattctgtagagcattgtgtgttgaatattattgatgatgtactcagtaacgtcaaatttataagaacagaacagtgcagtgttgaattaatcgcgatcgaaaactgcaggaggtaacgtgaacatgaatagatggtgagatttatacaaaacaaaatgtatatgatggaacagtaggaaacaaattgtatgcatgcctatggattaccaaagatcctatgagtcgtattgtatcacttggactaatgttatgtgcagtgttcacctagtcgctaaacgctagtcggacggccacctactgactaacgactaggctgattaggcggcgactagacggattaggcgaattagacgttttttctatttctttcacacaaaaatactgattctagacattcggtactcggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgacggtctggagctaggagagaggaagaaaaaattaactagaactggaagaacagaggaggtgaggtggtggaggggagcctgatcccctgttggcctgatctagggttggcgtaggctgcttgagtggttccgtgcttgactgcttcaatcggtgtgtttgccacctcccattgacggcaaggatgaaggatgagatggagagcaggagcagcagaggagggggaagaacgtggagcagcagaggaggagagggaagaacgtagcggtgcggtggaagatcgatgggcgcggcgacggagccgttgctcgtggcggtgtgaaaaagggggtaggcagggattgcgctctctctccatgctctcaaataaggcaacctaaatccccttctataccaagtcggtcccgcgtggcgcttctaaattttatcacgcccaaattttgatttctatcgcctagtcgccgcctagacacactgtcccgttgtctaattgcgcctaggcaccgtcctgtccaggccgcctaggaccaactaggaccgtctaggcggtaaatcgactaattcactgcctagggtgtaaactggacaaattgtcgccgactagcgattaatcaccgtctagatgggctaggcggccgtttaggcgaacattggttatgtgaatggaactgaggagaaatttattttggtgtttgacacaaatgtacctcatattattctcatagctaaaatcagtcaaggatctctcggatgaagaacctatgagatgtcataatatggttttcaggtctaagagatctgtaagcttagacttagtttgttaaaagtctttggaggtatgccagtttcaaatacaagtacctttctgcaaagaactgaatgtcaccatagatcaataaaatggctatctacagtaccataacttatattttggtttaccatcgaagtgtattatcctgttataatttagaaatattagttggcgtatgctggttagtgttgcttttcttggtaatatttaaggtcaacattggacacaagggggaatgctagaaggggatatggtatgatgttgttgaagatacacaatttagtttcctcagagcgaaccaagtaaatactgcaaattgaaggcctcctttggcacataggaaatttcccgattcctgcaggaatcgaactgattcccgtgcgaataattgcttgtgaaaacaaggtctctagggacgtcgacaaacctaagaagattgtgaactgtatttgtaattaaaagaatttcaatttttgggtgctgtacagatattttgtgataaataatttcttgtgttcttatagcatttgtttcagggtagacagggatacaggatgggaatcataatatagatttctactctatgcatgaacttcacctttatcgatctaaaaaagctgtgtttatttttacaggttcaattaggccatttgttgtagtccagaatgaagggcagaatgatgttaaggtcgatgttgttattgatggtaaaatgctgccattacagctggccaagggcttctccagacaggtatccaagttagtttgttctaacatttccatcaagtttcttgaatatgctggtagtacattctcaaacttgaaatagaaggtgatagttacctgagccctggtgtgccatatattttatggttgatcactttagggcgttgcatatatatgcttctcggttattaatatgtgtttgcggtttggattaggcgatcagctagattgtctgtgcagactagtcccaggactccaagctgcataatagctattggttgcaactgtttttcccagaaaagagtggaggaccatcctcttattactgttaagagggattacagtaattttataactgtttacattcattctaagtgacacgggcaagaaactaggaataaaagcataaagatgtgtatgaatgcttgaatattttgatacttgacctccgtaacagaccagtacgcctaagtcccggagcatggcaatatttctggcattccttatgaatatttaaattttgatgaatgaatgctcatcttattcttctacttctacaacaccagtcttcagttccaagcaagttggggtaggctagagaagtagaggtgaagcttatcttattataatattataaaatattgacattcatgtttaacttaatttatttcactgtttttgtaaccctttttccatgcgattttaatatgttaaagatcctgttcttgatttgtatgatcttgctaaaatcaattgctccatttgtgttaccaggtaaacataacctatagcaatccaaatggtgtagaaattacagtaaaatctgggaaggggcagtgttccttacacaccaagcaaacagtttttgattggcaacaacagtttcagcagtttgcagcttatgcaacacgcgcgaatccaatctacggagcctccttccttgttttcactgttgtcttggtgggagtggtctgtgcttgttgcaagtttgcaagaaggcgtgctagtggagtcccatatcagcaacttgagatgggagaccaagcccccaactcatcaggcgtggaaaacactacaagcactgtggatggttgggaagatggctgggatgatgactgggatgatgaagaagcggcagcaaaaccttcagataagaaaccatctggaagtatctctgcaaatggcctttctttgagacctcagaccaatagcaaagatggctgggatgtagattgggatgactaagctgcatagaatgttgagaaatgtgatttggacgagctgcagaaaaagcacagacaaactgatagcatctgtgattgacaaggtcactcgcattctggaagataggtttgtctgtcttcatacggtttgtaccatattgttccactactactttttgtttctaggctgatacacaaactgttagtgggtacaaattgtaatttcggtagtaacacaacagcacggtttcttagttacatgaccaaaacacgaactgtaatttttttgacagaggtaactatcattgttttccattcgtaaaaaaatcagattgaaaaactcttgcattagtatgctactgtcacttcgctttagtctttagagctgtgcagaagcattgctctcgccctttccagcactagcattcttcaccttttttttgtctctttgtccgtttcttttgctctgtacaattcttcagcttttgcctgttggcttccatttaatattcagttcaggctgtattgaccttgcgtgaataaagatgaatatcatctattttgacgcttttctgaatcccgttgtttcgtgtttttgcataaccttttgatttccttgtcgctatctggttgtaacaatgatctcaaggtgtcaatgtaactattggctatactcatttccttttctcacatgtctcctcattaccaactgcaatggatgttttccttttaacaattagcgtacatatattggttctgagatctcacaattaagggtagcactttaatcttgtgagttgtacatgtcatgctattgtcgctgtaccaagcagcatgagtgacttttgactcttgagtggcaatcattgatacaattatgctactacctatagttcagtaatcagttgccatcatcagcctcgcttcagattattgatctgcaacagttcacatgtactccttcgtttctgtttagagtttcctgtagcaggcataaagcagtaatactgcggcttctggtattatgttctccttggcatttttccactcgagcggttcagtgatcagtactccctccattccaaattgatatatatatatatatttcataggtagctaataactctctcatactatatttactatagcaacaaactcaatgcatgcaccatccccactattttctagccaatagcaaattaagatattgcatttagattataaatgcttatgtgcatagatgcatgcatcaatgtccatttactccaacgcacaaataacgaatagacctaatgaatgaacacaaatatatagatcatttatgaataatcttaaaaaaattatatgtatatcaatttggaacggagggagtactaaccagaggtgcaggtacagctgcaggtgcagcttacctgctcaagactaaaatggcttttatcatataaactgctcttctctgatctgttccaagatgacaagaatggcaggagagagaccaacccttttattaccatctcgtctccatgcaagcagttgtactagttgttaccatcactgaacaaaccttttcttttttcctctgaacatcttacctaaccagcttatcacaaatcagacttcctgccattcttgtccaagtgttcctgagcaaagctatggcaagctaacaggtgaaaggcaaggggaccaactgggattgcattgtgaaaatgaaacacagcctgatgaactgggggacacaacacacacaccatcagtgatcagtcaatccatgtactgatgtacaacgtcaaccgagctgtcactgatgcttctttctttcgtctaccaaccacggcc

SEQ ID NO: 22955 - DNA, 4714 bp, Oryza sativa
ttactgaatattattacgatagttgattaggattgcagcgtcatgtcatgaggcgggtatgctccatcgtcagctacagtaaaaatttaaaaattttaaacttacttttagaactgattttgcagttttttttttgctgtaattcatgtaacatgttctagtactgttttactttatgtggcgtgaaaaagaacttggaaatgctcggatatttagcctgcatcgactagtcggcatatctgcagacttacataaatcctttttttttcaaagtttctgcatctaggcatgttgttcgtccaaaaatgttggcagaactctttttttttcctcagttttcattctcatatttcgtggtgtaccagactccagacagctcaacaaccttgtgtaccgcttgtcctacagtgcttcaccggcacaagtttgatcttatcgccggagacgatttcaaatcagaagttgttctgaaactgaacagaaacactgtatgttcggacaaaacaatgcggggctctgtttgcccatttgccaagcagagcatgcatgccactgtgaaagattccgttcttcattgctctcatacggtgtgaatgtgccacattgcctctgcgtggcaaaggtagactagagcagagcactggccgagttagaaattagtactaccaaggaccagtgctaattaatggattattgattttgtgtaaaatttacatggtaacttaaagggatttaaacttgcttttttggggcaagcgccctagctaccctccccgtctctgcccataggttagcagtgtgaaataagccgtgctttgtagtgatataaaataagagtaacaatgggtgggcattcggtctaaccgaaaatttcggtctgggtcgtcggtctttcggtttttttgtctttgaaaagtgaagaccgaatttcagcgcaaaaatgttaggatcgacaaattcggtcttggtcttttcggtctcggtcatgaccgaaattcaacgacattttcatatatgcaaagaaataatgaaaattttcaacacaaaaatcacaaaaaaaattcgtaagcacttatgagtaaagactcttattaggttgcatgcctagaataagtaggcatgtgaaaattaaagtttaatcctattaaacataatggactgtaggttgtatttagacattttttgataattcggccttttcggtctattcggttacccgaggagactaatcgaattgatcgaacaaaattcagtctttcactacgtaggaccgaatttttcggtctcggtcttttcggttctgtctttcggttcgatttttttctgcccacccctactgtaacatatacaattaaactatagaaagaggaccacttcacactttaagcacgaagattagtctatttaacccctgaagtatgaaattgggtattctatttccgaagaatagaaaccgagttaaataatcctatactaatgatatagctgtggtttttgccacgtggactatagaggagataatgacatgataataggggaatgaatattctttcaagaagtggaaaggctcgagaatgatgtacagtagtgcgtatgtggtaattagtgagtgaaaagaaactattggattgacttgggtttagtagattaatctttatgcatgtaagcaatactgtcattatccccatgaaaaaactacctacaaaactattcaaaggggttatttgagccactttcatatttttaggagtagaatactcagtttcatatttcaggggttaaatagaccaaaccaacactcaaggggttatatagacttatttctaaaaaatctattaaaaagttgcttttaaagtcgtattaacccatttttcaagtttaatataattagtatttaattaatcatatgctaatgaatctcatcgttttgtgtatcttctcatcctctcccttcctctcaaacaaacattcataccttccccttaagagtacaacgttgagtaacatttctcatcctttggtttttgctaggcaatactataataacaagatgaaaaaaaaagaaactatatgttgttggccagtttcagaagaagctgagatccacaattatccccacaagcaccacaaacagtcataccacttgcttaaaaattcgaacaaacaaacgaacaaaccaatattccgcagtaaggaaatgcctaaaaaaagaagaattcaaaatggccatcttccaaaattcatgctcggtgctctctgctctgggaccgggtggcattaatggcaccccacaaaaccaaacaaagcaaccacctcgcacactacacacacagtgcatctccacgccgccacgcgcgcccacgctagaatccaatggacgaacacctcgccgccgcttgatcccctcctcctcctccccaatggccaccgccaccgccgccctcctcctcctcacgctcgccgccatcctcgccgcggcgggcgccgtgaacgacgacgtgctcgcgctggtggtcttcaagtccggggtgtccgacccggggggcgtcctggcggcgtggtcggaggacgccgaccgcgcctgcgcctggcccggggtgtcgtgcgacgcgcgggcggggcgcgtcgacgccgtcgcgctcccgtccgcggggctctccggccgcctcccgcggtccgcgctgctccgcctcgacgcgctcctctccctcgcgctccccgggaacaacctctccggcccgctccccgacgcgctgcccccgcgcgcccgcgcgctcgacctctccgccaactcgctctcaggctacctccccgccgcgctcgcctcctgcggctccctcgtgtcgctcaacctctccgggaacctcctctcgggccccgtccccgatggcatctggtctctcccgtcgctccggtcgctggacctctccggcaaccagctcgccggaagcgtgcccgggggattcccacggagcagctcgttgcgcgtgctggatttgagtcgcaaccttctcgaaggggagattccggcggacgtcggagaggccgggctgctcaaatcgttggatgtcgggcacaacttgttcaccggcgagctgccggagtcgctgcgtgggctcaccgggctgagctctcttggagcgggcgggaatgcgctcgccggcgagctcccggggtggattggtgagatggcggcgctggagacgctagatttgtccggcaaccgcttcgtcggcgccatcccagacggcatttcgggctgcaagaacctggtcgaggtcgacctcagcggcaacgcgctcaccggggagctcccgtggtgggtgttcggcctggcagcgctgcagcgcgtctccctcgccggcaacgcgctttccggctggatcaaagctcccggtgacaatgcctcagcgctgcaagaactggacctgtcgggcaatgccttctccggcgtgatcccgcgcgagatcgcgagcctttcaaggttgcagcatctgaacctgtcctcaaacaccatgtcggggaagcttccggtgagcattggacggatggcattgttggaggtgatggatgttagcagaaaccagctgagcgggggcgtcccaccggagatcggcggtgcggcggcgctccggaagttgctgatggggagtaattcactcaccggaatcattccgccgcagattgggaattgcagaaacctgattgcattgtaagtgatctcttttttttttttccaacataacttggtggcttgctgttacactagcagtagcttctactttgttttttcttgtgttagcagctagcacttgcctgctctctggttcctagtttcagatgccatggagaaagtgatgtctatgtcttattttctgtttggaagcactaagccagcaatgtcggaaccatgcctgtcctgttgctttggtcgtatcctagtgtctgtgtccttgctttttcttggatacactaaaaaaacacaagtcaaattacataagaaatttgaatgcttcttaaagaacatataaattacaatgaacaaggcaaatcatgttgcatcattactatcaaaatcttggcactatttcagctgatgtgtgtatggctcttttgtggcattgcagggatctatcacataacaagcttacagggcctattcctgcgaccataggcaacctcaccggtctccaaatggtcgatttctcggagaacaagctgaatggaaccctgccagtggagctctctaaactcgcaaaccttcgagtcttcaatgtctcccacaatctactatcaggaaacctccccatcagtcacttttttgatactatccctgattctttcatcttggacaatgctggactttgcagctcacagagagataattcctgcagcggcgtcatgccaaagccaattgtatttaaccctaatgcctcatcagatcccctctcagaggcttccccaggtgcccccagcagccagcaccacaagaagatcatattgagcatctcaacactgattgccattgtgggtggagcgttgattattgttggcgtggtaactatcacagtgctcaaccgtcgtgtccgctctgcggcctcccactctgcagttcccactgcactatcagatgattatgatagccaatccccagagaatgaagccaaccctggcaagcttgtcatgtttggcaggggcagcccagatttcagtg

SEQ ID NO: 22956 - DNA, 1644 bp, Oryza sativa
ccccccggttaaagttaaacaggatgtagtcacgtgcagcggacaacgcaaagcccagagaacaaaatggaacagaacagtcaggatcaatcagcctcgccaccgttttgtcttttacttttccttttcttgttttttgcatggcatgtggatggatgaagaatgacgcagcagtagcattagtaggagtactatccctgattctttcatcttggacaatgctggactttgcagctcacagagagataattcctgcagcggcgtcatgccaaagccaattgtatttaaccctaatgcctcatcagatcccctctcagaggcttccccaggtgcccccagcagccagcaccacaagaagatcatattgagcatctcaacactgattgccattgtgggtggagcgttgattattgttggcgtggtaactatcacagtgctcaaccgtcgtgtccgctctgcggcctcccactctgcagttcccactgcactatcagatgattatgatagccaatccccagagaatgaagccaaccctggcaagcttgtcatgtttggcaggggcagcccagatttcagtgcaggtgggcatgctttgctgaataaggattgcgaacttgggcgaggaggctttggcacagtctacaaggcagttttaagagatggccagcctgtggccatcaagaagctgacagtgtcaagcttggtcaagtcagaggacgagttcaaacggcaggttaagcttcttggaaaggtgcggcaccataatgttgttaccctcagaggcttctactggacttcatcactgcagctcctcatctatgactttgtgcctggcggtaacttatatcagcacctgcatgagtcctcagcagagagatcggtttcatggatggaaaggtttgacataataatcggcgtagcccgagcccttgcgcacttgcaccgccatgggataatccactataatctgaagtcaagcaatgtcttgctagatagcaacggcgagccaagggttggtgactatggccttgtgaagctgctgcctatgctggatcgctacgtgctgagcagcaagattcagagcgcgctagggtacatggcgccggagttcacatgcaggacagtcaatgtcacagagaagtgcgacgtctatggtttcggggtgatagttcttgagatcttgacaggcaggagaccagtcgagtacctagaagacgatgtcgtcgtgctctgcgatgtggtgagagctgcactcgacgatggcagggtggaggactgcatggatccacggctatcaggtgagttctccatggaagaggctatgctgatcatcaagctgggccttgtttgcacgtctcaggtgccctcccaccggccggacatgggtgaggtagtcagcatgcttgagatggtgaggagttctcagggtaccccagaggatgatctggtttgaaatctattttttggttccatttctctttccctttattagttcctttttttgtctttgatagatgggatgattgcaaagaccaaagaatgtgaggagatggctagtgatttagcctgcttgcaatttttcagggatgtgaagccgttgcttcggatcagttcttggtcccttttctagaagggctgcaggaa

SEQ ID NO: 22957 - DNA, 11508 bp, Oryza sativa
agtgtcagtagtttgggcctcgtacgcggagcctcctgaatattagtagcaatttaattagcagagagctcagaaaaaaacacgaacatcaacctaatatcaaataattagaaagggtaagacttcgaactcaggtcgtccagcccaccacctcgtggagttagtcgaaagacccctgcgtgtttctttaattagcagagagctcccttgatctaatcatcaaactgtcatcaaagcaagcttatctagcgaaaatgctcttgcagtttcagttgcaatgtaacaatcacaccgcacatgcatgcagtggactagattttgtttatccccgtatagcaaagccaattccatgtcccagtattttagcctaatctgttcgtcaacagaaaaaaaggcagatgcaacagagcctgcatgttaatgacaactatattaatgacagagttgaccatgccggatagctactctatgttaatgacaagttgacaattagtactagaatacgctggtgcacgcttgtcttatactcccttcgtgatcaacgtgcaacagagtatataatttaatgatgttcacatcgcccattgactactcttgggtggatttggattaattaatttggcccctgtccacctaatgtttgatgcttacatatcattaattaagcatccacatggttcatcgttcaagtataggttaagtagctagtttctcataggccgaagacgcctgcatggagggagggtttatctgaccctgatatcattggagtaacatatataatctgcattaccgccataatgacatatatggagtatcagtcttgagtttatgacacattgttactatatattcagaccaatattactaagaatatgaaccctcgaataggcaagaagttcggatcctggtcaactccttcacatgccaacttgtcactactgaaacatatttgatgcctgaagttaggatcaacatgtattatcatctatcataacctgggtcattgttcatccacacaattgatgacgtaagtctattgatagactttcagctgatgataagacacacctaaattgaaaattgaaaaattaattttcatccttaatttttgaatcaccttttttagactctctaactttatttcataatagaaacatatccgtgccagagtggaagtatgaaagtcttgcccaaaatcatttttcattgggtcggttactttttcggtctctaagttgtgtttcaactaatgagattacaatttggtgtctatcagtagatcgccgcagtaatatgtgtctccatcctaaaacttcaaatttacgaaacaaaatgtttaaatctagattagaatttcaaaaaacttacaaaaattcgaattatttttgattttttttgggtatttcttccccggaattcctttttggattccgaagtactgaacctctctctcacacccacaaagaagaaaaatctcattcatgatcacctcatagttgcaacaataatacttgcagaaagccagaaacacatcctacaatactacacacctattagtaccatttatcacgcaatttagtcgcataacaatgctagctaggagtagatttgaaacagatcaatctcatcgaaattcatgaactcatcggcgtcgacgaacgagctgtctccaaagtcatcatcccagttcaagcagcccagcagatcgggctccattgccggagacgaacaagaaacgacgtcggccggcgaactcaccgctgacggccccggacacgagtccactggctcttccttgctcatcttcaccccggattcctccccgtctccctccggcgagcacctggactgcctcgacgacggtggggtggccgccgtctccctccagacatcgccgtcgtcgccgtcgtcgtagagcagaggcggcgaaccgctgcggctcgcggtggccggcccgaagttgatgacgaaatgctgcgagttttcatcgtcgtcgtcgtcgtccatggcggcggcggcggccgtctggcagctgcaggtgtggtcgccgaagtaggtgatgacgtagagggaagggtcttcctccgactgctggacctgcttcgtcgccgtgcagccatggtcgtccttgtagctgcaccggtagtagagcctcgggtgcttgctgttcttgatctccttctgcccgtacttcctccacaggaatccgtcctccgacgtccgcgccttctccaccctcgccggctccgccgccgccgccgctccgccgccgctcgccgtcgctctgcaaaagatctcttgctgagtcgctgctcgatcgcgcgcgccatcgcaagaacgggaggagacatacatatatatataccttctcctccggcgcgtcgacggctgggcggttgccggcttgcgcttcgtgtcggctgacgacgattcggcatcgccgccggcgcgcaacgcggcgagcgcgcggtcgcagcagcgaaggatctcggcggcgagggcgtgggcaccgccgtgcgccggcgggagcgacgcgccatggagcagggcttccaggacggcggcggactcccgcccctgcgccatcagctcggacgccatggaagaagcagccgggctagccaccggcgccgcagtagcagtagcggtagcaccagtggcaatcagcgccatttgcgcaacctcggaaaggtggtggatttttatagcggcgggtctggatcggatatagcttagctgattagctcgagaggaagcagagacgaagttaaaggaaaaaaaagtggattaaaatgattaattcgatcgggaagcgtgtctagttgctcgcgtcagtcactaacttagttactacgcgccatgcatatggatggcaatatggcatcgtgtgttaatgttgttcatgtcatcaggtcacatgtactatgttgttcaaatctaggttaaatttggtgctacttgtacttgtttatgagttgttgaaagcgtgtgggtgcaccgatgggttatactaacaaggactgatacatggcctttgctctaccggtgcaaacctcgtgtaaaaagctaatttactaaaatcctatatgcgataattttgttcttttttgagtgtagagtctaagttgtgtggtagatcctaatgtaaatcccccgttgattcctttgctcggtgtcgaaaatcaaacccctctcctaaatccctatcaaccaatttccttgattgattccagttcaataattcttttaaagatttgagtcggcgctcaaaccatttctgatttctcgttgcgaattcccattatttcaaatcaccaatttgacaagttcaaatctctaatccaacttctcaaaatctccactcgaaaataatctcgaagttcgaacccttctattcagatttctcttctaaaaaccgtaaatgcaattttcgtcaaatcctcgaattcaaactcactccaatgtttcacctctaaacttctcccttggtctcttgaaatcaattatcgattgtttcatctctctgtctgtctctatcccccttcgaatcccttcctaaataatcgatctaactctaagaaacaaatcaaaataccacttttctacctctttaccctctctctttttagagaaaaggcatttcgcccagctttactgaaagcataagagtatcttacaagcgtttcgctagggattgcagcttccaacaaggaccagataaacaaaagcaaagaagggcgcgcacacacacacaggcggaacaaagataaagaggtctagcaagcactaaaagcaagagaatggtagtcccccttgaggggaagccccttaaagacgcttgatgcagcggttggcttccatgtccttgagcgtcttcactgcggcagcatttgcaactatcacattccatggatattggcaagtagtgagtcccctaaagtctccatctctcctatcagcgtcgacggcaccaaacgctttcactgttgcataaaagaaacaactctataaggaagatgaaggatattaatttgttagaagtttgttgttaaacaccccaatcattcctaattagccaaatcgcccaaaaaccttcaacaaaaagataccacataactatatttttggacctctctgcttcccacatcaatatagtcatctcgctgtcgattgagggatcctgttccaattaagaacatctctaaaacaacaccaaagaaatctagccgggcacatttgaacatcaagtgatcagtgtcttccaattctccacaaagtttacagtcaggatcaccttgccatttcatctttttttaattggctggcagcgtgaatcctccctttcattgttaaccaaacaaagatcctaaccttcagcggcacaggtgtcctccaaatctcctgcattcttgagtacttgacctcaccaaacattatcgccctatacaaagatttagtagaatactttcctggcccctctcttttgaatccctctcaaataatcttttgagtccccaaatatacacccatccccaaaatatcaagttctcgagttgatgccctctccttgatcctttgtatttcgctaagttaaaatgtaaatttcgaatcccgatcccaactcaaaccctatttctctctatcgatcccctccccgcaataattcctggaattcaaaatttgaagtttcaaatcccaattcttgcccccttaaattcccctcaatctttctgaaggttcaaaaacaaacttattccgaaaatctcactcatgatcacctaacagttgcaacaataatacctacagaaacacaacctacaatattacacctaccatttatcatgcaatttagtcgctaagcatgctagattttctttctagatccattttaactttttcattatttaattaattcatttgtgtccttaattaattccataatgtcaataataatatatcacaataatctaccatctgaaacaaacagagcctttggttactgtaaccttactttaattaccccttccccttttgataatttaattagcacctttttctaaaacaaaacgcatattaaagactacgaatggtctcgactaaaatatactccctccgtcccataatataagggattttggagggacatgacacatcctagttaggaccatgtccagatacatggtcctaagatgtgtcgcatccctccaaaatccgttatattatgggacggagggagtaattatatcagggtaaaaattatagctaagcatagaagaaacgaatgggaattggagagaacttgcagtacagtatagaattacaagcagaccgtaattcgaattcatcttaactagtttcccttttgcggctgacacaatctaacaatatgttattgttcgagatggtaccatgaaaaatagagttggattatccaagtactattatccatgatagatctgaactgtcacatggtaatgttgttctccaagatgacaaatatatatttgtacacacatgaccctggggaaagctgtccaatctcattatctgtgtagaaaaacgtgttttacgtacatgaatagctgaaaattagttctctaagctgtactcctgaatattgaatctcttgatctagaagcttccagctgctgtgaactctcctggcgtagctagctcgctgcacatgatcatgttggtgagattccaaaagagaataaaaacattgaacagtgtgctcatagtaaaattaattttcttacaaaactctttgcagacaatttttttagccatttgatttaatgaattaggagttacagagaatcaagattattcaatgacaatgttccatattagagtttgtaaatgttttggcaaaaaaaattcgtacacatgcatagcttcctaaaaacattcagtattggacttaaagttcaacgaaatttactggggttgtgcatgagattggtgtggagattagtgggaattcattctcttcaacggccgtggttacgctaaattagaaaacaaggtgggcctggaagggaaacataagaggtaagaagatagttccatcgggctaaatggatggctggggcaataatggtgatgtgccgtctcagccctaagagatatatatatggtggtctggtggatgatagaggagcatggaaatgatgagggttgagtatttttaggcatttaggaatgcaaagttatagggacaccatggtggaggatagatagaggggatatattaagtgggcttaagaactatattaacccacatgtatagggctgtttgaatgacacccctcccatactttgtcataaaagttctgcaaactgtggcaagccacatattgtatggccaacattttgttggtctcatttgtggcgagaaaacgagactatgataagtgaggtttgattttttaaaaaggtgtggcatactatagttgtggatgccataaatttcacagtgtgtggcttgccacaaatgtcacagtgtgtggctctcaaccaaatagcgccatgcttctctatctcaagatataactgcttcttcaccaatctcgtttccgtctcaaccaataacaaccacattttatttaattctacctctccttaatatatgtgaaaaacttgagagtggagaagtgcttctattttaatttgggatggagaaaactctctggtgccctcgcgccgccctcacgcggcggctcaggggcgaaaccctagccgtcgccgcccctctcccctcctccctgcttcgccgccggcaattccgggcgacgcgctgggatggcggcggcggggccatctctcttggctccatctcgccccggcgtaggcatggcgacaatggcggctgggcggcgaggtcgcggcggcgggatggtgaggtcgcgttgacggcgtggtggtggggctctctgcggcgtcggcagcgctgcggaagggctccgcgcggctccggcgatggcgtcgccagctccgatcgccccgccagatctggccggggtgacgacggcggcgcggcggtggggctctgtgcggccggcgacaggctcggtcgatgccggcgccttcgggcgttggcaggtggcctgcagctcccgcgcggtttcgtcggcgatgacggcatcgggtcggcggcggctcgtccggttggccggcggagcgcgccccggcgccgactgccgcgtggtcctggccgggggcagcaggcctgctgcggcttttgccggctgcggggacggcgcatccatcctcttgttcctctagatccggttctccccttcttcagtggttgttcttccggtgctctctagcggtgtggcacccgctccattcttctcaggtgctcctcccttcttaggctaggctgcttccagtcgatgccggggagcttcttggtaggggtggcgtgcggattttcggcgtcctgttcgctggtcatcggccgcgctgttagtttgctccagctgggttcctgggtgtgaggtggtctctggtcgagctgcaggtgattggttgttgaggcggagttggagctgcttgtcttgcaagcttggcaacgatgaccctcagtgaacgtcccggcaatgcggcgagggtttggaagtggagccttttgagagagcctcgggtgaaaaccttgcctagtgctatcctaggttgatgatatcgacgcttgcgggcgccgttttctccttggaggtattgtcatgctggctctctcttccttcaggtgaaaaccgggttcctttcggaacgggcgttgacagcatccttgatgttgctcccttgttgaaggcttcgctcagaaggtttatgctccactagaggatgtttggtggttctggagacctcgtttgcattatgttgttcaagctgcttgccttttggtaagcttggtaacgacgacttttgtgaggtctctttagttgtttcttttccttttttgtataggtttttgtcggttgtccgtttaattaaccgtgcttgtttggttttcgggcccggtttcccttattaactgggccaattctcttcttctataaattccggcaggagaaactcctgtcgtcggttcctctaaaaaaaattgggatggagggaatagcaaacttagatactagctagctggtttgcacaaagtgaaacatgaggagccacggtgaatcagggatgaaactcgagagaaaaaaaattggctgtgtattctcccttgaatgtaaattgtataggtaagataaagtgataaaccatagaacacatttaggtgccatgccgggagcttatatatagtaatcacttgcaaattaaaatccaagtttttgggtacaatacaacaagagctagctaataattcactaatactacgcgacaactttaaaaagatgattattgtgatttggcaattgcaagggaagctgcttgcatgtgtaccaaactaggtagatctagatcaccatgagttcatcactggcaaattacgttcgtacgtactacctgaagagcagtggggaaaaactgatcagttgatctctatcacttccagccggcaccattccatggctgcggagacgactcatcatagtcgccataggatccatagttacgcataattgtggacatgattcttgtgctctcatcaatggagggaacttcttcttcttcctcttccttcaagatcggcgcgccgacatgagaatccattaatgatgaggaaatggatgcttttgtgaagtcgagcacttgggaattagtactgcttgaactgggctgatcttggaacactgtattgcatgtatgctcgttggtgagggtgaccctgaactctgggggatgtttgttgttttcttgctgcacatatttctttgcttgacactttcgctcatcactgtaaccacatctgtagtataacctgcaaattgtgtagtgcatgaattgatataaacatataattatgcatgtcagactatatcatcagttttatatatagttgatacacatttatttccaagaaagcacaaacggaatgaatgcccattcaataagtaaaaaccaattaattgtgagacttcatgtacatgtgcacgaaaaatgcagtgaacgaattgaactagcacaccattctttcggcacattctcgtcgtagtctaaactctgaacatttacagttgtgagaactagttgattgatttttgtgtgactaattggacttcagccaaactttcatacgtctatgcatgcaccgcacttaacggtacatgtctccatgcatgtgatttttcagtataatccttttatttaaatgaaataccttcaaaacatactaatgaacaatattaattttagttaaaaaaagatgtctacaatctttgctcactaaaatttccttgtcctattcagttactaagaactgcacttattttccctaaaaaaaaagaactgcactttttttaagataataaaagttcttaatgaacttagtcaattacaactgcacacaaatcatatgatcatagcactacaggaatttaaggaaagagttggtatctcactctacttttcataattatcactctacttcaaataatataattgttctataagtgtatttgcaaaggtcacttacccagattttctatatttttggcccatttacacctcgaaaaacaagtagaaccatttcccaataattagaagcatatataccattattccgacaaaagtattaatgtaataaaaacatgagtatcatactacatatattttgctatttgcaattatatataaaccgaccatttcaaaggaaaggtaggttcatttctgctcacccaatatgagatatatgcacacaatccttaaattagagctagctatgacacacgcacacacatctaaaatacatcctgatatttctccgaggacacaccttagtgttcttgttgtgacacgtctgctggcactctatatgtatgctactaattacctaggtaatactcctttattataaggtgctacagagagctagctagaattaattcctgcagtattaattcttttttttgaataaaagggaattatcaacccatgtttgaattttgattaaggtaatgctaaatcttcagaaattgaatcaaagaaaagtccatcagaacttcatgaattgatggttactttcgaaattcactgttgaggatattcttctcgccatatttcctccagtgaaacccatcattttctggtgtcgtagtaatgaataccgtctcgctgaaacaaaaaaggaagacaaaataaatcatgcacttaacttgttaacaagtttcctaaccatgaaatatagatccagccagtgctactcgagaaaagcaagcatacgaggctcccaaataatccgaatggggcagaacaatatccagcttgctaaaaaccttttagtgtcctctaagtataatagatctaggcttctttcggcatagactattaacagctccatttcttttccccctcaaagcaagctaataattagagacaacaaggaaattaagctgattaatcagtcactcaagctcaaatggaacacacacacacacacagatctgccggccggttgccggttgatggggttcttaaatcttaattatctagtccattaattagtcccatatatatgtattgccagtggtagcatgcagaagagaagaaatcgaacacacataagtagttttcggcactcacatgagctcctcgccatgcttgcctcgccggcgcttcgtctttctttcgccgccggcgccggagacggaggtgacagcagctggcccagcgccgccggatgaggaggaggagccgcagtagtagtgctccctcctctcggaccggagggcgtagagcgaggagctgagggacatggagaggctcctcacgttggccagcgcgtcgtcgcggcggccgtcgagctcccgctccgggatgagctccagctgcgccatgagctgcgtcgccagctcgctgcccttgctgagctcctggatggcagcgtccctttggtcgccgggcggcggcggcggcggcgacggcgacctctcggactttggcaggcgcctcgccattggggatcgatagattgggcagcgcagctagctggctgaggtgtaccccttcagtaggtggagacgatgtgaactttggtttggactaggggtgtccttttctggatacttgtgtactggcttagtagaagcagctatctatagaggctctgatcttgggttcaattcaagttgttcaaccattgaccaggtaaatattcgatgagatgtgtgtaaggagtttaacctttttaagctaatactccctccgttccacaatataagggattttgagttttttcttgcaacgtttgaccactcgtcttattcaattttttttgcaaatataaaaaacgaaaagttgtgcttaaagtactatagataataaagtaagtcacaa

SEQ ID NO: 22958 - DNA, 3022 bp, Oryza sativa
agggattttttttctcgaagaggcaccagacatatgatatactttgtattaagtagtaactattaatttataaagctgaggcatggacaataaacacgggttcatacaacgtcttccgtcttttttaatcatgctataaattcaatgttgctgtaagaaaatactacattgtcatacactatacatctccataggtatcatgaggtcgttttccttgaaatcaaaattttaaaaaaatgtcaaagctacaaaaattcttcattgcggacaaaacgttatttcccattgaacaaagtcaatgcaagatcgaacttagattcaaagatggcacctataggaatatattgagcaatgctatcaacatccatcttacctccattatataaaaaaaaacatccatcttacctcaagaaagcacattactaacaagttgtcttttggtggaagatgaatttaacaaaatcatatgtcaatgttggtgaaaagaaaacaaatttgtacatagtggtccaaaaataaaagaagaggaaaacaatacattattttaaagtatcccttccctacccacccatcaatactactactgtttttctattaataagagaaactttgaaatttttttctccatttcatttattgtgggaaagagggagtacatttaagtacatactccctctatctaaaattttattttccattttttttctaaaggagatgttcatattggtagtcgtcatgcatccaagacttaaatgaagatattgtctctttgtttcgccgtgctagattaaattgctaacaagaatctaatcaaccatcttaatactcgttggttgcatgtgttcatttttttttatctttgttacatgcaaataatttgatttattggttttgatgacaaaagaactatgccttagagttttggacggagggaatacatcacaatttcggtgggctcacaagattttactccagtttttcctagttggcttaaactatataaagtatggatcccatgtcgtatgtacctgatttcaacctcacgttcgagctagctattattgtcatcgttgtctttagtgcaaaagatacttaatttgtagatcatggatatataaaaggctaaaaatgaacttatttgctggagagaagaaaataaactctaaaaatcaatttattttgagacggatggatttagcttgtgtgtaacaccatggtgagcacgagcctcatagcataccatcccccaattaagtgaacatcataatttgaaccgatgatgtgccatgcatgccatcccccaagtgactatcgtcaccatccagccatccagattccagagacaatcatctctttcttctcaacattaacaatatattgggccggccggtgtacttatccagaccacctagccctatccacgttctccaaaaaaaaaaaacctagccctatacactaaaacatagaagaatacatcaggtgctttccatttccaccacctctctgcgtcaggccctggacgtcagcacaggcagcgtgagcggcgtgacgtacgctccctcatcgtcgtccacccggcagccgcgcgtgaggtttttgcagcgaaaacaataggtttttccccggtttgtgcttgactcttaacggtatccgtcatatcaggtgtggccttttgatttttgatactggtgaacgggcgttctacgcgctcgtacgtggtgatcgatatacgcaaagcgcgtcgttcgtccccgacagccaccacatggtttcacactactctactcgactccgtttggatgagcttttgcggaatctgggcagcaacagcaacgagctggaaagcatctttaatttttctgaggtgcgtcaatggcggcagattcaccggatctagcaggcggaggccaagtggatagatatgagccgaggacaagtacgtacagtgcctgctgctatttggttcgtgttgggtttttctcgaactacgtattccaaccaccggttgcattccacggttgacacgtatggagtatgaacatctatcaatcaatcaatctattctattatattattaagtcagctcgaaaataagtcaccacgtttactggggaggctagaaattcccacgttaatggaagaaaaagaaaagaagagtccaagtagaaatacaatctaaaaatagctgaaattcggaattaaaatatacaatatgaaaagagaagtccatataggaacccaatacgtgattaattaaaattcgggataataataaaataaatatcaaaattagaaaaagaaaaaagaagagtttgagtaggaatacaatttataaataactgaaattcagaattaaaaataagaaatattgaaagaagagtccatacaagaatctaatacgagattaattaaaattcggaataaaagataaaaaaaatcaaaattagaaaaaagaaaagaaaataagagtttaagtagtaatacaatttaaaattaacttaaattcagaattaaatataaacaatattgaaataagagtacatataagaacccaatagcagattaattaaaatttataataataaataaataaataatctgaaattaggcaaattaaaagagagagttaaagtaggaatacaattttgaaacaacagagattgaaaataaaaaaaataaaaatatcaaaagaacataataataaataaaataaattctgaaattagaaaaagaaaaaaaaattcaactaggagtacaatttataaataactaaaataggtgataaaaaataagactattgaaagaaaagaccatctaaaacatatgacgagattaattaagtaacaatcctatagaggagcaaagtggtggcggttgatgaacttctagaaagtaaaaaaataaaccccaatgataatcatatttgatttttaaaatctcaattacaataaaaatgagaggcagcgggcgggtcgtgtaggagtacaatggtagagccgccgatgattggtgggttttctag

SEQ ID NO: 22959 - DNA, 1228 bp, Oryza sativa
ttttcgttaaattctctctcccggttgtattgccttgctatcgacctctcatgtactttatttaaatatttaggttcgtagctaattttttttttgacacccgtagctaaaaattgatggtgaaggggagtaaactttttcttcacctcgctctttcagtgcgttggtcatcgcaaggtacatgtctagattcactcaccgtcatgcacgcgccactatcaaaatggagatcattgatagctgcatcagctgcctatcaattaatctctcatttttaaatctgaccaaattaaagctcacgggcaaaagtatatattacacacatactgacatgtggggacaccacaccagtggcaataatcagcttgtaagaatacgtacttcgttatattactaattaattactctcttatcctccactaataaagttgtcatcttgacttccttgcacacagcatgcatcaccgtcacatctcagttaaaaaaaagtccagcaaattgagtgccaggtcgccatcagacgatgcaaaagttcccggacagagcatgaatttttcttcatggaaaagatcttctccccactccatggccgccggccgggcaagtgctcatcgatcgatcaagtggggccatatgagcccatgacgcaattacgaggcagcggcggcgacagtacgctgaagcagggtttacgaaaccttttcattttttaaaccacggtcggtatcgtggaatagcggtaacccgattctaaacgatttagtaaacactacattagagtgcgggacgaaggcccagaggacgaacaggttgcagacccgtggatccgaggaaagtttttcgaggtcttagactcttaggttatcaggtcaagtatagctgtccattctaaaataaactaatttctaccttcctatctatcatgagtctataaatcgataaattttgttcttccaatatctctcatatagcctttcactaatataattttgctattagactgaactattttggtcatttcttttcctacttaactctaattgaaaagttaggatttaaggatttatgttccttagagggagtatatagctgaaattaactgattgatagataatttgatttctaatagctatttgacgatataagtaaataaaataactactctgaagtgaaaatgttgttttagaaaagtattttaagattttatttttttttacaaaacacgttg

SEQ ID NO: 22960 - DNA, 5929 bp, Oryza sativa
  unsure (1)..(5929): unsure at all n locations
ttagtgtgatgtgatatgtctgtgatgttgagatcaaagggacagttactgttaaattcttggggacggacctgtccgccgtggacgtggttggtcaatcagaaggaagcgcgtctcgaacatgaattatgctatttttttcagaaaaaaataatttacatacgccgaatcttcttattaaaaagtgaatatgtacaagggcaaatatgaacaacaaaccaatcgaatcgaggatgacattgcatctgtctgatatcgagtgtgaccattgttcaatttcgaatatacgaagaatttgggaaaaggatggcatgcaatatatatttaaaaatttcaatacctttttataaatatgttctctattttaggtgttaacctggcaataccaataatgttttgttgcctacacgatagatatttgtaaaaaaaaaagaaatttggagggctttgtttttaaaactttgttaaaagttttataaggaaaaaacagtgtagtattttggagggatttattttactgaaaaggtttaaagacaaaattatatgtatgatacatgaatttgcatagtgtctataaataagtacaataaaatactgtgcttatttcagtggaagaacttgcttagtccaaatgaaccagggaaaatatttcagacggacaaactagttcatgctactaaatgccacgctgatttcgaagtgagcataatgcatgcagacatcactttgtgcacattctagtaaaaagaaaatcgacttatgcatatgagttttaagtatattaggacgatatacatgtattatcgtgctacagttgtaagagtgaaccaaacactcaactaagaaaccatgtcatggctaccatatagcattggaaagggaggtatccaaccaaacaacacattaagaaggtggtatttgaaaccaatgaagataaagattaagttgacgcacataaaacgaaaaaactattagcatatgattaattaaatttaaattattacaaacttcacaaatggatatatttgatattttaaagcaactataaaaagtttccgtacgaaacatttcgtaccgtctagtagtttgaaaaacgtgctaacgaaaatcaagataaaatatgtagagaaaagaacgtgacgtaagcctgcatttgacatcgtcgtttggcattaaacctgcagccaaaatgaaaaaaactattaacacatgattaattgagttttaattattaaaagtttgaaaataaatttatttaatatttcaaagaaacttctactccctccatttcaatataaatatataagtactttttagatttcgacacagtcttcgagatattactttgactaacaatatctatgtcttatataaaaaagagttgtatattacgatagtatgtttaatggtaaatatatacaaaatcattttatacaaaatatactattttagtatttggacaaacatgcttcttataattctagtacatttctactcggccatattactctgtccattataggaaaaaacaatctaagatgagacattattttaacattatggtctcgttcttttctccaaccagagttgaatgaaaattaattttcatggcacgcttttcaaactgctaaaaggtgtatttcgtgtgaaaactttctatatgaaagtttctctaaaatattatattaatctattttttaagtttgtaataattaaaagtcaatcaattatacgttaatacgtaaaaaaaattaatctttatctttagaagaaaagaagaaccccaattattctggtttgtcccattatttccagttgattttttctgcacagaggtagtcctgtcggagtcgaacgcagccggcttccctttcacaccgccgcgccgatataaaagcgcgcgtcccgacggctggggactcccacttccacggcgccaaccgccaacccactccctcactcctccgcactaattcctcgcctctacaatctccttctcctcttccgctcgcgctcgcgctcgcggcggctactatgacgcagctcaggcgatccacctcgcggagcgcggagtggatataggataggatcgaggcggatcggaggaaggaggaggaatcctgggttggcttgattccccgccccagttcgagtgagcttccggagtttaatttggggtagtgttcttcttcgcaacaaggtatattctccccgcttgaatcatgggggcgcgtttgcctgtgtgtgagttttttttttttgtgaatttttcggtggttcggttggattattctcagccacattttaccacaggaatttgctggggttttggcgttccttcctcttttatataggagtagtagtcgacaggtcccatctcgagttttcatcctgatttgatgggattttcggcatttctcgcgatttttttgcacttgttgagttggtactagtacaaaagtaggagtactactactagctagtagctgccgctgcatgcatctgcggagtttagttgggacgtcgtggttgcgaattaggatggtgttactgtcaggtttcgttggcctgatgttgctgagtggcagatgtgttatttgtctctagtttgattgattttgatcgcacagagccattgcttgagcacaaaagcgactagctaggcaggttgttagaggcagaagaagtaggtacaagtaaacgatacaaatggggtgatcttcttttctgaagaactttcatgtcacttgcatactgttaccgtcaaatttggccatctgtttcagttttcattgatccaactttcattaagcaacggagtatagagaaccggagtgatttgttttcttgatattggggaattttctgaaccccatgtaccaaactgggcatgcatatgcaaacacccaaaacctcgtgcttcaaaaagaggaataaatgatatctaacatcataaacaatggtggtattcataaactcttcttttttcctagttaggatcctgaaattttggaattttgctgtcgtggatatgactagttgctgctgattatcttgaagacatgatcaatttcggaggagtactctgtgcagttacccttgtggtgttgctccccttcttagaggctgcagatggaaaatctactgatccttcagaaggtaatctttgcaagcgtattcttcactatgagccaaatcattctttgcaagcatattcttcatgctgagccaaacctgggctgggtcatattaagctggttttgaactaacacgttctcctgatcacaaattcctcattatatgttgacacatggggtaggcttaggtttggactaggccttggggcaagacatgcttgattagttgattggaccattttaaactggcttttgaaccaatattctcttatgatatctctgtaattacatcaacttttagtttcttatttgcacaatactccgttcatttctagatgggtgcttcagtgttctcccactattgattctgtaagacagtgggagtaatttgtttatgcccttgaaaaacaacaaaccagaaattgtacttcatggattacaaacataccggaactctggtctaatgaaaacatgcaagaattctattttatgcctgctgtgatgccagagtccatttctagtaactgaagtaggtattttttgacgacaatgagccgaacatagtatttgtggctatacagttttcctactaggtaggtatttgtaaatcataccctaccagttagtatgtttgtctaacagagaatgatattatacacagctcttatttgaaaaatgaaataaagagttgcaaaaatgtatgctaacgttgtaaatgaaataattctctcataggatttgtaaaaaatagtttgttatctcttgtgctcgataaccactttctatcaacagactatgagatgtttaatgccaacagtattttacattgagtttctttagttaaaagttctaaaatatttgctgcaaaatatatgttgtttttctccctatatgcagtcagtgcacttatggctatcaagggaagcttagttgatcctatgaacaacctcaagaattggaataggggagatccatgcacaaaaaattggacaggggtcttctgccatgatttgggtgatacatatcttcatgtaacagaactgtatgaccaatacttctacataatttatttgccatatcctcactttcagtttggttgtcataataggaactatgaatgctagtggtcatagaaaacggttctatagttaaatgctgatgactatgttttccatagctgattaggaattacaaatttctgatgcatgattaattgtataatctattaaagaaataaatagttgatgtcttacaagtgtcttattgccatactaaacatttgaagcatactgaattgaagtgttatatttagtctttattattgaatggtggcaatgtggcatgatgctacatttactggtaactatgcatctcgtttgatagtaataatatgtcccaccatgttaccgcagggaacctcagtcctgtctgtacgaggccccttttttaaaaaaaaaattctaagcattgttggagcagccttttgaagcttttctttgcttgaaatattcgataagggcatacagttccagtaaatttcaatctgttgctgattatattattttgctccatgtaggcaactgtttaggaggaacctctctggaaatttggtaccagaggtcagtcttttatctcagctgaaaatattgtaagtatactctaatgactgaagattttattttttgtaagttctgcattcattaaatattaatccttagtactatcttcatatcactatattttccataaaataaattaatggtgtcttcctggataaaagattagccttcatcttttacttgctgaaaaattactaaagaaaatactaattgatcagcatatagttgatttttttgcatcaatctcttataccatatattaacttattgctgtttctcttgaagggattttatgtggaacaatttaacaggcaacatcccaaaagagataggcaatatcactacgctcaaacttatgtatgtattctctttcaattaattctacacccctcttcaatatgcacagaaaacaacggaactccttaattaaattatttgctatttttcttatatctaccaatactttactctttttttcatgctttatgtagattattaaatggaaatcagctctctggtcttttaccagatgagattggcaaccttcaaagcttaacaaggttacaggttgaccaaaaccatctatccggcgcaatacctaaatcatttgccaacttaagaagtgtgaagcatctgtaaggattgttcatttccattttgttcctgctttgttcttcaatctgaattcagtgctagactcaatttcccctttcatttcagtcacatgaataataattcattaagtgggcaaatcccgtccgaattgtccagactgaatacacttttgcacctgtaagtggaagcctattggttgcatttttttctaatgcatgttgtatcaggtaacatggaattaatcttattatatactctaactaaaactttgcagccttgttgataacaacaatttgtctgggcctcttcctccagaactagctgcggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22961 - DNA, 16665 bp, Oryza sativa
tatctataattagggacaaataaagaaaattaaaaatgtgattccatgcaagaaatacgattaacaaaattcagaatttaggattaacaattacaaaaaaataatatttttgttaggagtccatgtagaaatacaatttaaaaacatccaaaagttcagattgaatataataaaactaacataaagagtccacatagaaaaattggattgaagataaatattatagcgaaaagagttttgggaggattgcagtttagaaatattttaaaatcggattaaaaataaataatattgaggggaagaatccaggtagctagaaataaaatttacaaatatcttaaattcggtttgaaaataaatattagtgagaaaacattttatgtagaagttgatttagaactattttaaatgtgaattaaaataaataatattgatagaagagtccacttttacaattgaaggctagtcttctattagctttatattaatactatcagctaaaaatcagctaaagaatctcatgtaaattagctagaaaactagcttatgagattggatcttaaccctataccaatgtgacaggagttagtccaaactgtcagcaacattaacaaaataaaatataaaaatacccagtaacatagtaatattgataacaatagaacgtttttaatttaaggttatgaactattatgaatatacaatacaatatgccatcttcagtaggtggaagaatgtcattcgaggtagtggaaagatgcaactatagatacagatgtaggggaataagacaaataaatatgccataggatttatgtatctttgatttattgtatttttatgagaatactaaaaattccatcgtgtttgttttatggacatgggaattactatattaatcatttgtcattttaaatactttttcacaatagtttggtcaagttaggtcaaagctcaaaatcatttgtcattttaaatatttttttcacaatagaatgtgaagtatatgtattatagaatgtgaatattttatagagatgctagtttatttcatagaatctgcgcggaccactttgctagtttatttcaaagtaaacgttgagacatgctagaatgccacttggtattggtacatagtatataccttctttgtcaaaactcttgcgagtatgtaccatgtctcgtacaactcccttaattccaaagtaagttccgaaagatgtgcatggtgacacgcggtgaaaagcttttctaactattgcattgtatgtacaagcaaggacgaaatcgtcgtcaaccccaaatgaatcagggcttccataggtgcggcgcacaagttgctagctacttccttcgaccttcatcttaaaattaaaattatttatattttctaaaaaataaattaaagttatgacatagatgcttgtgaatgtttgatgtgggaaaatagatgaagaaattaaatgggcaaaattataattggttcagattgaggtcgacaaagaggtactcccttcgtcccaaaatataagtagttttagggttgaacacaagtattaagaaagtcggtagaattaaataggtgaaagttgttattggttgagaagcggagctaagtgagaaaattgaatggtgaagggctgtgattaattgagaagaaaatattggtgaagaaattattatattttgggacaaatcttaagggctagaagttgttatattttagaacggatggagtagctagtttcatttaaaaaatatcttaaaagtagttatattttaatacagagaggacttgctcgtccactgcttgagaaatttatggaggacgcacgcgttggtcgtagctatcactcatcagcagctgcagttgctgagcttgccgttgacgctaatactatatattggagcgagcgatggatcgatggagtatacaacagcagcattcaatggcgtggcagaaatatctccacgccatgagccacggcagcctcaaacgaagaaaaatagacccaaattacaacccgatcgacgtgcacgttttactgaatcgttgacgcgaagcttctatcccgtgttggatatacatcgatgctcatcgtcgtcgtcgtcgtcgtcgcagtcgctagccgtgtgtgtcggctgatgccgatgccaccgttgccgcgaccatttcgccacgcacgaattcatcttcaaagacaaaaaaaaataaacaaaaacaaaaacaaacaaacaaaaacaaaactgcaacggcgacgtgctttgtcccacggtcatgcacgctgccacggacgatgtcgcgtttactgaaacagaagacgcgcgcagcacacatcttttgcagtggaaattctacagaagaacgcagcagtgtgcgttacagtagaaaaaccttataaaagttgtggacattatctctccgctgtgtatgtgttcaatgtgcaccatggcgcgaccgttgctgtaggtgaatttttcagggatctttgcagttttgctagtgacaataagaagtgttttgtttggttcagtacaaggttgactcgaaaattcagctgaatttgtatggctcgtggtgcagacaacaagatattgcagatatcaccaccattcagttagagttgctgttacacagctgagctcgactcaactggacaaaactatggtccctgggcggtgagaaccaggcattactgatgaacaggaaggtgtcaggccgctggcactaaaatctggggtaccagaacatgcccttgatgccttgagggtcagcttcgaatcccaagttcttgtagaaatctacaactgcagttaataagaacgaattatcagaaagacgacctttttagtgcattgaagcaacattgataagctgcacattctggatatcatgaacagaacgaccatttccatttccctgctgcaagtcgcagcaataactcgccacagcaagaaaattatgttactccctccgtcccaaaatataacaacttttatctctcaagatttgtcccaaaatataacaacttctccaccaacattctcttcccaaccaatcacaatcctccaccattcacttttcccacctacctccactactcaaccaatcacaactctccatcattcacttctacctattttcttaataaccgtgtccacctctaaatatgcttatattctggacggaggtagtaatgaatattcaacattttggtttagaaaggtgctatcgagataaatggcacagttgagttaatgacttcaaggaaagtaagccaccagttcacccaccagtaaaatttgaggcagccaggcaggtgcacttaccaaaggcatatatccattcaatcactcagatttggataatgatgtaatggccttataggaataggttgaaacgaagacaacagccttttcaatagcataaaatttctacaaattcatcttttatggttttcaattacgttttcatccacaagagtaaatcatgtggtacctttggtagccagtctagttgttgcagtactcaaaggatcaaaatatttgcttgttttctactcactacaaagatgacttaacagcaaaccaaaggtaaattcgagctagcagtgctacttagacatggcttttgtgaaaaaagggaggtgtgtgtggtactgtggtggtggttgtggttttctacctttgttatctgcaaacagcgtaatattgctgatgtctctctggagcaaagttcggattactttctccattaacgctttaccaagaccttgaccctgaaaatgttaaaacaggtataaaccattataagtaaccttacatgccaaaacagtgaattcaagttcatcaattcacctgatatgaagggtcaacgagaacatcccaaatggtagcattaaaggcatggtctgaagttgctcgcgccataccaattagttgcttcctctcttctccctctgtcaaataacttctacaagtacactaagatgttcatcatctagaaaaatgaatttctgcaaataatcttcagattagaagatgtggtttgactaacgcttaggatcataaacgagccgctaataatgaaacaacgaggtaagcacctgcttttgaaggcatagtaactgaatgtagtgtagcaaccaggtaactgtttcttaaggatgctgctattttggttaggggtctgcgtggccatcccacctatgagatgaacatcataaacacaaacatctgttaaagaagaaactaccgaggaacaacatgaacttggagaaaattgtgatatatattcctttatgaaaacaggatgtgttactacaaggtgacaaatattttaataatatttcatttagctctatttggtattttcgagtgtactcagctataatagccagtttacactgcataagtggtcccagttaggccatacaatagttactaggtgtgttagtgaacgaataatggttacttatttagaaccttgactgcaagaactatcaaatgattttggagaaagatcaccttgtcgcataaagcttggagatcatacacattaacatctccagctgaagaaaatatgatctgctctgtgctgccatcagcaagtgtcctttctaggagtactagttcctcgggcaaaggttcttcctcttcaattggtgctgatggtggctctactgtctctgtactgttattactcttcaaaaatctgcaaagcaaaagcattagattctctttaccatacatgacagatctaaggagcatgatataagcatgttgcttcaaatgtacacagcacatagttagtctacatactcccttgttaattgaagaaaaagatatagaaattttatcaatctagtttctctacaagacctgaactgtaaggctgagttcttttcggctgttggctgtggaggcaagccattagcgcatgaataattgagtattaattattacagacttgaaaatgggttgatttgattttttttaggaacttctatataaaaagcttttgcaaaaaaaagcaccgtttagcagtttgggtcgggaagcgtgctaccggaaaatggggaagttgcaacttccaaacaaaaaaacgtaagggcctagtctgtaaacacccaggatgttccggtcctactacatctttatattttttagtttttcagttccccctttgtcgcaggtaatgtgagaaattagtagctttcacttctcatagaggtaggaatttctaacgagaccattttcatattaacacatactacatgctatagtatgtagatttatgtgaaaatataaacatagggtttaagcaagggacacaatgtattttacccggatctaagggagtcccacagaccagccttcaaggaccaagttgccgcagcccgttttttacctgcagcgtaaacacgataagagtgtacgtactagttcagcaaataacagctaaacttcatgaacatgtcatgaacaaaaaaaaaatcaaccaaagagaagttaggcagatgacaaaacaacaaagagaaggtccacaagtttattttgccgtggagcttggacaactgtgcagtctatgattatctagctggtagctagtagccggtaaaccatcaaacatggcgtatttctatatgcaaacctaagaaataatctgaaccaccattctcaccaagacccatacggataaatgccagagtaatttagcgagttgcagtagcacgaaatgcaggatctgcagaatggtgctgcttaccaaatgtttggaaagatgggacaaaggagccagagcaaagctttacttgtttactgacgctgtaattcctcgattaagcagtacatcagttcgttgcaagttatttgcagactctggaacactaattcctaatcccatccaacaagacactagattggcatctacctaccctggccggccattgttagcctaaacatttggatgtctgtaattcctattcgcaccaaacgactactatactgtgattatccgctgcaacgcggaagggagcaccgcaccgcaccgcaccgtaccttgcgcgtggtcgtggagaagccggcgcggcgcgggggctttaccccgggcccccaaaccgcacgacgccgtggggacgcatctgaaagaggacggtgtgacgacggcggaggcggaggcggaggcggcgggcgccatccttgccggatagtgcggcccggtgattcgtcgccgcgcgccgccggagtgggcgcagccgaggcggtcgccgccgggaggaggaggaggtggtggtggtggtggtggtggagctcgctgccgtcgtctcgtcgcagataaggtcggggaaggtgggtggtggactgatggagtggtcagtggtagccgattcctcctcgccgagaccgagaagaagccgaggcccaggcggtcggcccatcaccacaggagtttggcatgattgggccgctcggttatgggcctctaatttaatctaaactcttatttccctgtaaaaattgagaagataaacaaaacaagatgagctataaatgtattattaagttatgagtattaattatctcgaatttaaaggaaataattaatatgattttttaaaacaacttttttatagaactttttttaaaataacgtatcgcttaatagtttaggaagtgtgcatgcgcagcaggagtaagttttcctatctatccgttgctaccgaacgcggcctagttcaattgttgggactagctatatcgagctacattttttcgttaagaaaacagatactcatttttcaatacacttttacattgcaaatttcatactttatagtactataaacttcatatatttacagtgtaatttttaaatattacactgtagtttttttccttactactcactatatacaaaggaaaaggatagttagcaatcacatggtggaaaaaggttattgaaatcaactaatcaagccaaaaatgtggtgccaagttttttagcaaaaccatagttttttaggaagaagaagagagagggtgagagggagattagagcaaagctttatgcctttatctacaggctacatacactgacatatctacttagcaatccctgtagctatggtgccatgccagaatccagattgcaaataggatccggatcaacagagagatacagaaaggaaaagcatccaacctctcaacagcaaaatctggggattatattgctgtctgctgatggctctttgcatccacttatgcaccacaggattcacaaagagcttcagacgactgcatcttgtgcagacaagaggcagaagaaaaaagatcagagacagtcaagtgcactataaacaaaggacaaacagctagcctggatctgtaactgcacagcacagaaagaactaagatctaagctgcccaatgaactgcagccttgcagcgcaaacaacagaacagtgcttgcgccggaatcatctcatggcaaccaggagcgccgcagccatgccacccagggacatggcccaaacgatcaaccgcagcagctactgtcctcctgagcgggtaaagtacagtttcatcatcagcttgcacttgcaggacctagttaagaaaccaagcagcaacaatcaatcggccaagtgaactaggacaatagtaggaaggcaactcaaatttattctgtaatgtttctgaagaattggagaccgggaatgaatccgagatacctgaacaccggcaaggacattttcagagactagctcagacggcgcaaccgctgcccagccgtcgacgtaaaccacctctatcagtaccagccatacaccaatatcctcaacatctggatggtgtagctccatgtgataagtgcagcagtctgaagagaatgacgacgtgcataggacgcagaaattatcatggagtagagcctgggtactgtaatctcctgttgcaagtgcctcgaccatgtccctcccttggtcctcttcttggacttggttaagctggaaatttcggatcaccattgttaatgaattcagtttggcatgagcagttaacaacgaagcacagaggtttccactattaatttgtgcacgagcaaatacccaaatactaatatacaagataaattaacagcattagtaagtagcaacaaatttacatagcatatgtagcaggatatattctattttcagttatctgaaacgaaaatggagcctcttttattgctagatgaccaaaatacaaacttctttttttatcctggttttgcacatgcttttgtccaagaaacctgtgcacgatcaaggcaacaagaacacatccacaaatcaagatggccaagaaaccctacaccagaggaaattgtaggcacgcgtggttccaagcacaactcgaagtatggacaagaacttaccttgcacattgtacagcagtagagcgcgtttgttggcttcttgattcgttggtggcagtccacgcagctcgagaaatccttcttccgcccgtacattggtggcacccatggtctcaacaggatccagttcgtctgttcgtcgcctctcaatctttgtataccttcccaatcgtactcggtgcccactgggtacctggcgagcacagcggggttttcagcgagcaactcaacctgcgagcgagaataagatgagacacaagaggctcgatcgaagaagaagaagaagaagaagaagaagacgaagaagaagaagaagaagaagaagaagaagaagaagaagaagaagtcttctttcgaaccgaccgtagcgacacggggaaggccctcttccgggtggtgatgatcccaatgttctttgcagcagtggtcgcagaaggagagccagcagtagaagcagaacctgtttcgcctgcatgtcattctccaatcctcctggaccaacctctggaggtagaggggctgctccattggaggctgccttggagcctgcagcttatcccctcccgcttgctagctcctctgcttcttggcgtccgctacccctgttcttgcgttcttgcggctgctcgctgctccgctaccgatcgattcttccccctttctcttcttctcctgcttgcgatcgattcttcttcgccctgctctctgatcgcgaaggcttcttgcgatcgcttatctacacctgttgattgattctctcggatgttcttgatgccgtcgcaatgttgctctgctctctgatgtctctttctttcttgggtcttcttgttcgtggagttcttgatggagaagagccataggcatagcgagcgggaaggcgagtgtttaaataggagcggaggcgagcggatgctgattcgattaatgggcctcttcttggagcttttacccggcccattaatatatttctcttttttgtctatttcttcttccacttcttcccgtttcgattttgtttgaggctgcgcgcgcgcgagaggggagagaggctgacgagagggagaggaggtggagagcgagtcgatctgggcggggggaagaggaatcgctcgggggatgcctccgctggaggtggaatcgcttcaaggcctcgcagttttgtcgtttggttctgtacttctgtttcctccctgtgtttgtggctcttttgcgcgattgaatgtttgaattttggtgtgattgggatagttaatcgaggaaaaatagagattcgtcttgtgaattgtgatgtgcggagcccgcccaccggaggtagatggtgatgaacccccaatttcatttctattgtcagtttcttatatgtttttggttaagtttcagctatcaggtgtgggcttttgctgtcgtgggttaatttttctgttttgctctgaatggcagattcatgtgggagcggtttcagcaattgtcccctttctgcttatcccgataatatatgccagttttgatgtaatgaaatggtagtctccttgcttgattaaggtgtaaatcctgctcatttcctctccagagagtaggttaggcaaaattcagacacttttttatagggtcttttttttttgagaactggagtaagcacagaatacagagccgtagtgtagggacaaacatctttcaggcttcagccacagaaacacagaatagcagaaccaaaccactcgtctgaccgtttcgtatagctacttgttgcattctaatcgggactgatgattaacacatgattatgttgatgttgtctagatatagatgttctcattgcgagctttgcttggaaagaaacacacgatttttttcgtagcggggaatcaacagtccatcaaactaatcaatcgaataaccgttcaaatgagttgttggagcatgggaggcaggaaagaatattgtgagattattctcttagttgttcaggattgttgacgaacaacagtgttgccagcactctgtacagttttcagttattccttttctttcagccttgatctgcctgtgttaaaatcatctcctaccaatgtaatgccagccagcttggttggccttccgaaaaagaagtgttcaagtcttttgttaaggacccctccccccctctctcatttttgttattattctattttattgaaatcttgtgaattttggaatgttgtgtattgtttgcaactcagtgcctttttttttcctgaattcagtggcttttaattcagtgtagtttggttttgcggatgatcatgttttacctcatctgttaagacttctgccaggttttacttgagctttgtttcaggctctaccagtgctgttctatcggagatgatgcaaaaggaatcattgtcaacttatactggagcagcattgtgtctttgttgatgctgtgaatgatgctacttctgcgtatcccaggcctttgtgttggattttctggcagagattgattgaagagaaccattggggatatctatgaatgaggaaagggcctcacgggctgtagttttctctttttcttgtaaaagtttttaacttcttatttctgtcaattatgctatggtttgtaatgcagaggcatcatgtatgtgtcagtcaagtatagctaatagtgtggatctcttggtgcaattgtaatcaatgtttagtgatgaactcgtatggtttggtattaacctgagcccagtatgatgtttagcgttttacacaaacaaagagatactccaaaagggagtatttgctttcactgaaatgaaattttggccttactagttgcatgcacggcctatgcgcttaactgacaaaagggaatagtactccaaatataacagtgaaaagcatccaacatctcaacagcaaaatctagggatctctgatggttctttgcatctatttatgcaccacagaattcacaggagcttcagatgaatgactgcatcttgtgcagacaagaggcagcagggaaaaagatcagacacactgagacagtcaagtgcactatcccacatttgctacagtaacaaagggccaacagctaagcctgatctgtaactgccaagcacggagagaactaagatctaagctgcccaatgaactgcagccttgcaacgcaaacaacagaactgtgcttgcaccagaatcatctcatggcaaccgggtgcgccgcagttatgctgccaagggacgtcgcccacatgctgaactgcaggaggagcttctaacctcatgacagggtaaaccagagctccaccaccagcatgcacgacctaagttcagaaaccaagcagcaaccactcaagttaggacacatgaggcagctcaattctgtaatggattaaatcaagctcaattctgtagtgtctctgaagaaatggagactgagatatatatacctgaacaccatgaaggacatcctcggggactagcacagacggcgcaaccgctgcccaagcatctacgtgaacaacctcaatgatctggtcgccatgagcgttagccttttctggatggtgtcgctcaatgtgctcagcgcagcaagctgaacagaaggacgacatgcatatggtgcagaaacgatcagggcgatgaatctggaagtaatttcctgctgcaagtgcctgaatcatgtccctccctttgccctggtggacatggttatgctgtccaatggaaattttggattacaattagtgaggtcactttcatatgagcagttaacaacgaagcaaagaggtttcctctatctgtccatcgatcgaagaagatatgaaatgaacagcattttcttgcacagataaaatgaacatcattaattttcttttttgaaggtcaacatgatctttttgagagcacattagtaccacactaccacattgactaagcatctcaagatatattttattttcagtcatctgaaaacgataatggattctcttcttttactagatggctaaactaggaacctattccattggagtaaccaagatttctatattggttttgcacaagcttccgtccaagaagtagaacttgcgcacgatcaagaaagacaagaacgcatgatgcgcatccacaaatcaagatggccaagactctaaacaagaattagttgtagccacgcacggtcccaagcacaaattttgaagtatgaacaaggacttaccttgcacattaaacagcagtacctcgccgaagactccccgattttctgattgcagttaacgcaggttcgaccacgcccttgtaatggtgtcatcctggggttcaacaggatccaatcccgattccagtctttcactctctgtatatagttccaattgtacccccagcgacccacggggtacttggcgaacgccgcggggtctccacttccgagcaacccaatctgcaacaagaagaaaaggaggcatggggggcaacacgcacgagaggctcagctcagctctcaactcgatcggagcgcaagaagtcaagaacaaagaagaaggaagaaatctttcgaaccgaccgtagcgactcggccgcgacctcctgccggatggtgacgatcccaatgctcggggcagcaatggtggcagaagggggaccggcagtggaagcagaatctgcctcgacggcacatcctcgtccagttcgcctggaccaacctgtggaggtagaggggttgctccatcgtcggagccccgcagcttgctatctcctctgcttcttggcgtccgctacccctgttcttgcgttcttgatttgcttgctgctccgataccgatcgattcccccccccccctctctctctcttcttctccctgctctcttggttgctgaggtttcttgcgatcgcttctctacacccgctgattgattctctcggatgttcttgattccctcgcgatgttgctctcctctctgatgtctctttctttcttgggtctttgttgttcgtggagttcttggatgggggagagccatcgcgagcgggaaggcgagggtttaaataggagaagaggcgagcggatgctgattcgattaatgggccttttcttggagcttttacccggcccattaatatgttcttttttttgttttggtctatttcttgatttcttcttccacttcttcccgtttcgatttccaatcaaagtttgaggcggcgagagagagagagagagagagagagagattgacgagagggagatgaggcggagagcgagtcgatctgggcagggggaagatgaatcgctcgggagatgcctccgctggaggcggaatcgcttcaaggtctcgcagttttgtcgtttgattctgtttccccctgtgtttgtggctcttttgcgcgattgaatgtttgatttttggtgtatgattggggatggttggtagaggctattcggcgactcggcctgtgatgtgcggaggccgctggaggtggatggtgatgagcaccgatttcatttctagggttttgggggggcggatgggaggagctggatttcatttctagggtttgggtcacggcttcacatcgtcagtttctttaatattttttggttggagtagctttcagctatcaacagtgggatttatctgttatcacttcaattttgctctggacagcagattcgtgggggaaagcggtttcagcagctggtccctttctgatggaacgaaatgcaagtttctcttctgatttgggtgtaaacaactcctctccaagatatcagaggaagcgaaattcagacacattcatcaacaccaaactgaaactatggtctaccaactatctacaaggtaccaacttaacttagggcacagcctcccgaaacaaacaacactgaattgctctttgttcagaactttggtaagcatagaatgcagagccgtagtggcactcgcatcttccaagcttcagccttcggccacagaatagcagaattaaatcgttcatctggctgtttcgtgtagttacttgttgcactctgagtaactacactctgatctgaggattcgattattagcatgattgtttgttgttgttattgttgttgtcgtcgtccagttatagaagttctcatagtatcatgtatcaattccaacttggtcaaaaatgaaattgctcaagactcttgttaaggagtccctctcatttttttactagtctatttgttgaaatcttctgaattttggaatgtagtatcatgtttgcagatcagagcctttttttttccttggtcagtggcttttaattcggtgtagtttgcttttgcaattgatcatgtttgacatctacctggtccattacagattttatttgagcttgtttctgtctctaccagcactattttatcggaggtgattattagcactatttgattttggttttgcaaaaggaatcaattatcaacttatactggagcagcattgtgcctttgttgatgctgtgatcctttgtgttggattttctggcagagattgattgaagagaagccagagggggataactatgaacgaggaaagggcctcatggtgagctttgcttgaatccatccacccctgttgcgttgcgtcgcctaggagcccttttttctggtgggctgtagttttctccttttcttgtaaaagtttcttaacttcttatttctgtcaattatgctaagatttgcaatgcagaggcatcaaaactgtatgtgtctgtcaaatataactaacagtgtcgatctcttggtgcaattgcaatcaatgttttgtgatgaactcaaagggttctcaacttctcatggtgttttacacaaagagatatatatagtgttttacacaacgagacatttgctttcactgaaatgaacttttggccttactagttgcatacacggcctgtgcactttaactgacagaagggaatagtactccaaaatacaacaaaaatatacatattgtgaaccacgtctttgttttattcctggatatcaagaacccgaaaaaattgcttattgtgacactttctggctgaagagcttcttcctgatctgcaggagagaagaaaatgaaacactcgtatcaaatccactgaattaccatgcattgatggatgaggtaagacatatatacctcaggaagcttttgcttgaaagagatttccaccctcgcatccagcgtgttgtcgcagacgatcttgccgtcctgcgatgcaatcaccacacctccagagctgcaaaattagggacacaaatcagcttccgatgaagtaagcgttagcacgagcatattactggtgtatcaggtactaggaagcaacaagattgtgtgtaccagaaggggccatgggcgtcacgggcggtcttgggcggcgggaggtagaccttgccgtcgatgaggatcttggggaggttcaccttagccttctcggcgtactccttcttcgccgcctccagcaccgactcgacgtgcccgcgatccgcctcccggcaccgcagcaccaccgacggctccctcagccggagcaggctctgaatttgatcaatgatctctgaatcttttctctgaaccaaaatgtgcatggatagctagatactccctccgtttcacaatgtaggactttctagcattgtccacattcatatatatgctaataaatctagacattattatatatatagattcattagcatctatataaatgtggataatgctagaaagtcctatgtagagggtgtgaggggatttggtggtgatcacctgcacgatgaggcccttgaggaccttcctgtaggcggtggcgtccttggtgacgcggaggaggctcttgccggcatcctccttcatctcgcccaccacgccgtcctgcgcccgcagcaccttgatccgcgccgcgttcagctgcgtcgagtactcgctgcaaccatgcgaaagatcaaatccaaacacagagttaataatcaggaacgacactgattcgatcaccacagttgaacattttttcgcaaatatgcagttgctatcgatcgagatcttttctgtgtgatgctcacatcttccttccaacgtccacctgcttcgccttgcgctcgtagtcctgcctgatcctccgcttctccgactccaccagctgcagcttctctatgttgaactcctgcatcacccccatcaagatcgttttcagttgacaccctttctgaagaacagaagacgaaggagatcaaattatttattttacc

SEQ ID NO: 22962 - DNA, 4213 bp, Oryza sativa
ttcccgccaaatctggacttcgatttgggctctcgatcgactctggattttcggtttttggggtttctgtgggctgttcgttcggtgatggacggcccagtttcatcaagccggccggcccactatttgtatcaagagatgggcccaacccaaatagcccattacgcgcgcaacgacggccacgacgacggttgccggcgcgcgccgcggggttgcgtcgtcgtcgtcgtcgtcgtcgtcggcggcggcggcggatccttttttatattttccggcgtgaaggcagagctcgggcaagcacgaggggtccccggaggcgctggtacgtacgcgctttcctcccctgcgccatcgtcttaatttgtcctctctgagctcaccgaacgcatcgtccgcttgatcttcccatatcccgtggtgggtgatgccggtcgtcggctcgtcgcgatagggagtttgctgtggtaggggattcttctagggtttttgtagtctggaactcggtgtaggatttgcgctatctgagcattggtgccggcaaccccacgcgtgcatgctaggtgttcggggaaattccgatcaggcctacgttttacaatgcatctctgcggcggtgattactcagtggtaagctgatttctcagtgattgcacggtgatcttctggcctcacagtgcagtgcagtcttcatggatgccgactgacctggcatgacattgaaactgatctggtggtcatctcggactgggagacagggagatcactcgaccgctcttttttgtgggcttttgctcagtgctcactcatgcagtcacacggcactgtggaaacccatgataatgcagcaagtaatggttcagtgtccctccaaggaaagttgcatcattgtttggtcctgcggtttagaaaaggaagagaaaatccttgatatgctgtgtttggtcaagtttattgttgctacttgctgcctttgttgtaaagtttgcaatatttcttttagactggtaaagtttgcaatattctcgatgcttttgccaattgaaacttatttatattctcaaagtcagtatggtgtgcttctcggtccatctgcagactgcagggctgtgtttggtggtgttgtgtagactgtagtggatgtctcgggtatttttgcttacaaccagtccccattgacgttgagactctgcttctatggtttgtcattgaagtcttttttttcctagtggctgtcaacatgtacttcagcattgttgatcttctgagtttgcatttgaatgtaaggtaaaaattgattaagttggtcctgtttacttttttggactggaactggattgggtaactttttttcttgaatccctcatagtcaataaaaactccacagtccacagggttggcgaactgccagtagtgagctggttgtgtggtttattgcagcttgagaggcaagagcaacgtagatatagtggttgatggttggaaaactgtcacaattacatggctttggacaacattgccatgcatgaccatctgaaactctggatttctcatgcctcacataagcttcttcttgaaccagtgttacgttggtgtaacatatcccctttccttcttttcattctgttattgaatgccaaccttttggatcgctgagtgaaatatataatttaggtgggttggtgccttgctaaaaattctaaagttgggaaagtgaaatggcacacaagcacaaatgattaatgtctcatttcaaggaaactggtacttgaaggtgccatcatttttcagctagatcatccatcaaacaacagctaagatgtcgcttttgctttttcctttccggtgaaaaaatatggtctaagtcttcctgcctttgacatatttaagtttggtgaagtacttcctttgttctcaatgattgaggctgtagttttgcagtactgcaaatttctaaggcttcccaagtacaatccaggatccatcatttgttaatcaatttaacatctggaaacagatagaagcaagcactacaggaatgctgttataataagacacgtttacaagtacagcactaaccatatgatgtcattattttagggttttatgatagttttcaccatgttatgtgttagaagaatacataagttcactgtcttttggttggctattgagcacaaaatatgaaggccccctgacaaattaggaccttatcctctcctcctgtagctgacagtttttcggttccagtaatcagatggaaacaatgcaggtccatgacatccacagcgctagcactgctgcctgcacttgtattattttctacccctgtagttgagaggacaaaaatgatacggctgattgcattgtcgtccaatacagacagttttgcaagtgcaggaccatgcattatcgatgggaggacggtgatcagggaacgcatggcatgtgcagacgggcttgactgcatgttacatgtatcctccccagaagtttgacatgaggagccagcagttcttccactgataactgatgaacgaagattcccagtcatctgcatcagcaggtatttgttttgtttaatacgtagattactgcataattagttgtgaaactggatagattagatgcgctatacaattgactgactataacatcctctccattttataatacccggttcgaaactttgacagctaatgcatcattcacaaaaaaagaaaaagaagaacagactcatgtgatacaaatctgctccagttatttcctctgttcctattactgttccaaaattactgcttaatgcgttagaaaatcgcgataaattaatcaagatccttttcaatgttgcagcagatgaaccgaactgtgagctgcacagatggagccatggagagcactgcatctgggtcaatcaacaattatgaacgtttctcccttccattcgctctgccctcatctgaagaggaccacagcacctaacgaccgagatgatgaactgtggactggagagcaccacacacccctcccggatttcctggcgaggtgatgagcagatgaagcttggcgatgcagcggcggcaggcactgctctgcgcgtgaactgcagccgtgcaggaggagccagatcccggcacagtgctgggcaggcagtgccccccccacaccatatgcccggctcctgggcgatgatgcagcaactaccggggtcgccatcgcccaaccgaacgtctcgccggtgccctcccgcccccggccgagatatgcagccaccaacctacggtgtgcgcccgaaagtgaccacatcttgccatgatgggtctggatggccctccccttccataattttcacatttgcacacccagaaatgagtggtagttcgttttcgtttgacatgttaagaagatgcttagcttaagctttttgggtgaaccggtcgatgatatagattaacgtcgaaatggaacatcaataaaatatggatgtaaattgagtcatggttttataaatgagtgatagttcgttttcatttgacatgttaagaatatgcgagcttaaacttttgggtgaactggtcgataaaatatattaacgtcaaaatggaacatcaataaaatatgggtgtaaattgagtcatggttttgtaatggaggaacatctatgggactcctccatttgtaattttttggcattgtaattttgtcagagcatgagcttgggaaggaaattccttttgtcagtgtaatccagtgcataatacaccagcactgtccaccatatgcagatggtttcaactcgggttggggccacatgtacattattgttggtagtgctgtactgttcagtgtacatgaccatcctcgcaagtactctgcaatttgccaagatctgaagatctggagttctggacctcatgttcggtacactgttcgtgtttttgtacactgtgcctccttaatttccctgattactccctaacacaaagctgctttaccacttttgcacgggttcttaaactttaaaaccgtccaatcgtacggcaaaaaaagatgtatcaggtggggtggaacactacgaatacaattagtgaagtacaattgacaacctagaaaaaatgtggcagaaattagcccacggctcggatcggatcagatgagatgagatctccttgttctttgatccaggctagatccaaccccaacatgaaagagagta

SEQ ID NO: 22963 - DNA, 5858 bp, Oryza sativa
  unsure (1)..(5858): unsure at all n locations
tattagaacttagaagtttatattacatcacgttacatctagtagtactatctccgttccaaaacggaggtagtataaagagttttaggcttaaatacgggtgtgaagaaaataggtagaattaaatggaagaaaattatgattgattgagaaaaaaaagttagtggagaatttgaatggtgaaagattgtgattggttgaaaagagaagatatgtgaagaagttgtaatattctgagataaattttaaatgttaaaagttactatattttgatacggaaggtgtaataatcatcatcgcagcaaaatcatccactgagcagtgaccacccacctgattactctaacccaaccaaacatctctgtaccttcttttccagagataaaagaaaacatttgttcttttcttttcagttttcactgcacaagaccataaaccgactgacacgtgggccccaccacaccctggtcccactactcccacacctcgcccgcgccgacttctcgcctctctgacttaccgcatactttactccaccaccaccacccctccccctttgccaccgcgcccacccttcaaagccacccccaaccctcaccgacaggtggggcccaactcctcgtgggtcccgcccgccattgtcaccgtagcgggtcccacgcgcggggggcgatcacgattcgcgaaagcctttacggcgagaaacaaaaacaaaagctttcacaaggcagcgtgaggaggaggaggaggggagctcagctcacgcagaggcgacgacgacgcgcacgcgcaccgccctcctccctccccgcgatctcgccgtaggggatctcgtcggcggcgaggaagcaaaggccgagggggcagcggctggggaggggaggggaggggagagcggcattggttggagcttggaggaagttgggtgtgtgtgtctgggggtgagggtgagggatcggatcgaagcttctggaaggttccgggcgcggatccggctcggtgggttgctcgctcgtggctggaggtagcggcgcgctggtggtatcggcttttggtctaatgctttgcttcggtttggagtttggaggtgggggttttattgatgcttttggttgggtggatttgttgctgcagtttgagcggggggagcaactctgaggtttggttttcctgagatggaggacctgctgggcgcggaggtcggcaagaacgactatgactggtgatcatcgatttcgttttcttcagtttctttcttttttttttgtttgtttcaccttcgctgattttgattaatctccttttgttgtcggtgtggtgatcttcgtagtgtatttggtacagcacaagtttatgtgaagttgtagctgtatttttttttaaatctgctgggttgacttgaattgacgtgttttgggctggatttgtactgaacgcttgttttgggtggtttgagtaggcttgatcttggagtgacatgtttttgtttgtttcgtaaaagaggatatgctgcattgcccccagaaacgtcactcttccggttgtagttgtgatggttgtgatcgtttctcgttaaggatggccttggtgattgcagttggttggaattgaatcgctgtgctgagcaaacgtgaaatatatgaaatatgcaattggatggataggcagttaggcaacctgtggggacgggctcctcttcccttggaaggccaatttgatgttaaactaggggagatatgctgatactaatttggggatattagcaggagcatgccacgaaaagaaagatttatttttgggccaaatgtgccattaatatgttgttcccacaatatataattgtaatcgcttatgactttttgctgtgaaaacataatcaatctgttttggttgttttctatagtattttaaaagcttgtagtaactatatggtttcttgcttgattggttgtctgttcctctagtccatacatgtttagcatttgtttctactataatgaaacataaattgtgatgctcttctcaggcttcttactccccctgggacaccccgttgtcctgtactggaggttgctgagaaaacaccatccccaaatatattacctaagcgcactgccactagatcatcgtcaaccaccagagcgtcgagggtatgtactatgtattatttgtattagaatggacgtgctaaattttggagatttgcttttgcaatctagtttaaggctctttttctgcagatatacttctaatttcgtagtttcagtgacaacctgtacccaattttctaaagaaataaggaacaattttatccatgttgcattgtaacaacactcagtttagggatcaatacctccagatatatatctctgatgaatagttgctgtctgggctatgcatcctttttctttggctgcatgatctttggtagtatgaaacattttgagctcctacaacctgttttcctgttaagttttcattaatgacacatagtcttaagtcttaaccagtgtagaaaaatgggatgcagctgatattcaaataagtgttttgatctgaaaagctttcaatgttattgtcattttatttcttcgagggaaaaatttactcattgttagcaattgaaggtttcacattagatttcaataatgaacaatgcattgaagtatttcccaatatatgccacaactagatacaaaaacaactttatttaatgaattgcatattggaattgaagaccacccaaaccagggagtctggtgataacacgtttcttgcttctctacctactcgaactacctaggcagtagttgcataattactctcggggcttttttttctcctccttgattaatcttggttataattagcatttttatgtcaaactacgttgttttgcagctttcagtatctcaaacagagaatggtcattctacagctcccactagaccagctagaagtaactctgtcactcgcccttctattcagtccactctcatgtctagctccaacaggacagcagttctcaatacaagcatttcctccgtcagctcaagacctacaaccccaagtaggcgaagcagcactgttgttgcaccaaagcaatcaattgcagcttcacgccctgttccagcaaggtcctccactcctgttaaaactcgtccatctacaccaaccaaaactcgcccatctactcctgtgagaactcgtcaaacagccaattctacaagcgactcagctgctgccaggaccacatccgctcaaaattcaaggccatcaacgccaacctctagatcacgtgctatgcccaattcatcttctggtgcaattcctgcaatgagccgcccaggtgcatctacaatttctgcaacaagtcgctcaaatgcatctacaatatctgcaacaagccgtcctggctcatcctcaagtaatgtacctgggataagccgtgccacctcattgtcttcaagtacagttccttcaatgagccgctccagctcacgttcatccacacctacacgccagcctgcaatgcgctcatcggcccctgctgttggtcgctcgccttctgttgggcggagttctagcatcagtagcttgacatcatctatcaatcgacctgcagcaaatggtggccggaactcagcaccttcatcggctccgtcatctcgtccaagttcccctggtccacgacctcgagctccagttcgtccacttgatatccctgattttccaanatgaaacaccaccaaatcttaggacaaaactgcctgaacggccactatctgctggtagatcacggccaggcatggctttaggagtaagatcaacctcaaatactgaaccatcagctgcctcagctcctgtaaagaaggtgtctgtgcctgctatgagtcgaagtaaattttctgatgcaccatccaggacacctactctcacaaatggacgccaaaacagacagagtgagaggtctactgtggatagtcaacctagtaaagtctccaggcctgccacagggacagataatggatttgggatgacgatgtcaaagaagtcacttgacatggcaatcaggcacatggtacgtttcttcctgtgtttccatcagattagtaaaaccctgctttgaaccagttaggattctgtttgcatttagccagaatttgtcatgtacatttgattcgacattgcatgaaccatgactgtgttgcagtgccttttcttgccatacgcaaatcacaagttcaaagaagctaacattactccttgaacttgtgacaggacattcggcagaacttgggtggaatccgtggcgcatccctcttcccgcatagcatccgctcaaccgccggcaagggcaggccagctcgaatgtcagatcctgggcacaccatctcaaacggagaccaccggcactacgccgacaatggcagcaccaacgggcacttctccggggactccaatggggctctctcgcgcaacggtggcagctcgaccgactcacccgaccggggaagcatcggaggcaaggagacgctgagcgagctggacatgtacggcagctcgcgctacgaggcgatgctgctgagggaggacgtgaggaacacgagctggctgcacggcttcgacgacagcaagcccgaccagagcccactgttcgaccaccggttcgagccgctcccagagcccttcagcccgctatgacgaatgcacggttgccgctgcctgtaaatctgctgttccatggtctgctttgcaagatgtgtatgccattccatatgttttctgtttggttctgtttcaggttctacacgctcttcccttgggtacaatactctgctggtaatattttactttaccgatataagacggagagattgtggggtgtggctcatttaatttatccctggagtagggattggtttccacgtactgttgtactgagaatccacaagagtataggaattgataaaaacagtaaagatttgtaagttattgtaatgccattggtttctcatggatgttatatcttgtcaaaccaaccagggttgccaaatgcgatggagaccctgtctagggaagcctttagcaactacggtttcaggctcccaaaatagtctgtagtaatataatttgtggtccggtttattggtcttatatactcttatccactcggtaggccagctatgttttaaaaaaagtcaatttaatttgttaaaatttatctgaatttcatcgtttgtcgttgtcgtcagtgaacgagcggtcatcgtgtattaagcagtatccggtgaccagtcacattttggaaccctgtgtcaagctcgcagctgcttccatcacccatgctagtgacccgtgtgataaaacacgagacggtgcgtcgtgctgggacgggacagcatgagaagttgagaacgcattgaagtcgaggctggcccggccatctccccggccccggcccgtgcacggcacggcacgcgtcgcgctcagcgtaggtgggaactgaagagcccaccggcgagaggccgcgtcttgggctatcttcccttcccatgccgatccacggcttttttttttctttttggaacggccgattgttgccggcgttttatatataataaggtgtcttattttaaggagaaaataagaccaaactttacggtgcacagttaattaaagaaaactgggtaaaaaccacaactacaataaacactccaagaaacctaaactaccacggcgacaaaacattagccaagcacaacactcaacaacgctgctcaacacaagaacggtaaagccaagcagcaagcaagaaggaaacagaactccccaccctagtaaggcacgacgtgtta

SEQ ID NO: 22964 - DNA, 4646 bp, Oryza sativa
tcaactgccatcgccgactcaagaatgaactaggtttacacccggataatcgaaacacgataggatggggagatacccaagacacctccaaggagggaacgacaccgtaggcgtcatcgtccgggctttcgccttggtcaccaccaagctatcagtgctagagcagtcccagcgtcgacaattacatgcacgtctgctggtgtggaagcaatcgtcctagcccattgccgcacgccgaggtggcctactttccagcaccacagccgccaagtccctccacgaaaaaggagttgccatcaacaaccgagccagcgagcgcctggatacctctcgccgaccaaccgggcggaagacctgtggcagaggcccacatgtacccgttgccaacgccgcctgtaggctggcaaagagcttcgctgttagggactgacgcaaaggctgcttgccaccgggaggagccccatcgtcgccgccggaaggggccccgtagcctccactatccgcaactctggaagttgctcacctccgcctcacgggccggggaggagttctcatgccgccaccgccgtctgctggctggggaaggccccagtcgccgtgcggcacttctgcccgaccaccaagctggcaccgacaccaccactgccgcacccagccgccgtcccgccggttaggctaatctcatccacggttgaaccatcaacggctgaaactgctgctgccttctccttgggctctcttttcttcattggctgaccggggcagatttaacgtataatcaatgggggccttggaccgtagtcaaaaattacactcattagatatgtccctaattgtatgacctatgggcccccactctaattgggaagaagaaccccactccttttttctgctccttccatcacgcaaatgcgtgcatgtttaggcttcgaatgtccgttccccttctctcaatcccccaactggcaaatccataaactagggattaggaaatgggaagagacaagcgagcccatcatcatctcgccccatctattttgcttccgtagaccgcacttcaccttcgccgcttccttgatcactcaccgtcgacgttgttctgcacggcgcactccatccatgaagaagttgtggcacgttgggcctgctgatctctgtatcactcggtgcgtactgatatctccctctcatgcagtcaataattgatgaggatgactctctagggcagtaggtttcccttcaatgctctatctaatcatccttgtcatgatctgataagggagttaatggacaatttttataatgtaatatctcaaagtttttataagtttgtatgaggtgagctccacttagctttctaacttgttatatgagttatgtatgcccgtgagtttcacttagctttctacttaacttgtaatatgagttatgtatgtccccagtcaatttttttaatgcgtccgcccctgggctgacgcattaacatacacgtcttggactcctggttaggctaatctcatcaatagtttcattggagttttattcttaataaatgagatatcacataaataatttgatgacatggagaaataattatgaagagagagggaaagagtttcatctgagtgtatcatgtttcaaagactatgaaactggttgaaactagcattggaggctagagtgtttcatctcatccaaatgtaatcacatattcacatgtatcactattaaatgctatgacaaacccgtgaaaccgcaaaatgaaactgtacattggagatcttatttcatttgtatagacctttttagatgacatggcactcttggtaacggtgagttgaaactctccactggaaatgaccttagagaagcttcagataatgtgggaatctagaaaaaaaaagggtttgttctttaaattctacaactatatgttttccaaaaagtaaatttcacaaaactacaggttcttcaatcaaactattgtataactacatatttaaggtgttgtatcacaaaatagatttaacgtgaaatttattataaactacaaattcaagatagagtgccaaagaaataaagattaagtagtaaatttatcataaaactatggatttagtacctgtttaatcataaaactacaatgtttatagctctaacataatgatagtgctaagggatctaaacttagaatatgtagttttgtggtaacttcaatattaaatctgtagttttgtgatagttgaccttaaatatgtagttttatgataaatttagtgctaaatctactgttttgcgatacatcaccttagactcgtgttttgtgataggttgatcaaaatatatgtagttttatgaaatttaatcttgtcatgatttgagatcccctttgaaacaaaagaaaaatatatgaattataaaggacttatatatatcctatgagaaattggattgtttttttaccaattcctttaaaattcctatgaaataagccattctctaaagcaattttaaaggaaaataagcatgagttctcactccatattttcccatgtcttaaattcatgtgtccgaatcaaaccacggttctaaaactttcatgtgtttcgaaattccacaggacttcaatgagcatgacatttttttcatgtgtcgcaatcttgcgttttaaaggagtacaaaataaaactctaaattatttgaaaagcttaagattaaaagaagctgctagcttcctaattaggggtgaagacaaaccttcccatgcaatgctaggtcgctagccttgttttcttccttgtcctcttgctgcatgttgacacccaaggtatttatgaaccaagagcaactgatcaccaaccagacgtcttggccacgaaccacaaaggccccttatggtttatcacggttctaccaacacattttccatgagtgagctactacatatgaacggttctaaattaagctacaacaacttaacaacataatactaagggacaattgctcatttgaccctattttcaggtctaactaccaatttgactaaacttttctaagtttatttgaccatgttttttcaatttgaagttgccgtctgaccctactttcactacactgtgagtatttcacttagaaaaaatagaaaacaagaatttacaatcctaaatgacgaaaatgccccttaatacgtcaatctatcctctatcactcattcctatcctctctctctctatcatctatcattcttatcctctatcagcggcggctcggcggcagctgtagcggcagaggggcggctcggcggcgcgacgcggagggccgccgctggcggcgaatgaggaggagcggcgctcggcgacgaggaaggccgccgctggcggcggatgcggaggagaggcggcgactcggcgacgaggagggccggcggtagctgcggctgcggaggagcggcggcttggcggcgcgacgcggagggtcgccgctggcggtggatgcggaggagcggcggtggaggggcagctgctcgacgacgaggagggctgccgctggcgacgacgggcggcgttggctcggtgacgaggaggaccaccggtggcggcttggcggtagctgcggaggggcgacgttcgctcgtcgacgaggacgacggccggcggtggcggtggctcggctacgacgactgccggcgccagcacgcgtgaagcttgccccgtgacaaacgaattttgggagaataatgtcaaataagcaagggtagaagtggtattttgggctttttgttaacaccgtgaaatattctgttcttaacagaagagggtcaaagtgtagcttcggttttaaaaaagagagtcaaataagcaaagtgacaaaaacagagttaaattggtagttagacttcaaaataagatcaaatgtgcaattgtccctaatactaatggctagtacatcagtatcacacgtcaggctgacgcgatcagtacacgcgacctactccaaaccggcgattgcatcattagcatttcggtgatgacagtacagattttatctaatttcgttaacacgttttttgaactgctaaaaattgattaaaaaactgctgaaagatttatattacacgaaatttttctataaaaaatattttaaaatatcagataaatatattttttaagtttaaaataattaaaacttaattattgatacactaatagtctataaaatcgggcctaaatccaggaagccccaaaaaaaaagtgagatgtgatgtgatatgattgtgctgtgcttgggattcctcaaactaccgctttgaccttgagtccttgacaaagcaggcgtcagcggcatcagtacaactacatgcgtctcgtccatttcactgttgtcactgacagagccttttgatcagcgacgcagcattcagacaacgatcagagccttcaaccttttcccgcagccactcgtcggatccatcataagaattgctaatttggttgaaattggaacgatgtgacggaagtttacgtgtgtaggaaaattttgatgtgatgaaaaagttaaaattttaaagaaaaaattgggaactaaacaagggctaagtttaggtgacgttcttttcttcttaacatgattcggccgggggtgcagga

SEQ ID NO: 22965 - DNA, 1750 bp, Oryza sativa
ttcgaaattccaacttttttatcacatcaaaactttcctacacacaaacttttaacttttccgtcacatcattccaatttcaaccaaacttccaattttagcgtgaactaaacacacccgaagacgaagatggtgatgaagattaattttttttatgtaaaacgagttggtattaacatattattgattgagttttaattattataaatttaaaaaatagcttaatatgatattttagagcaactttcatatagaaagttttcgcacaaaacgtattgtttagcaatttgaaaaatgtgctacgaaaatcttaatcttcatccactcttgttggataaaagaacgggaccttagtttgatttgataccatatcacaacactagctaaacgtacaacataccccccaaaaaagtatttttcttaaaaaaattacaagcatgttaaagattgaatatggaatcatatgattaaaactacatatcaagtgtatctataaaagtaccacactctttacaacaactaaattttgtgccacataattcatgacaacacgctgcaaaatgtttggtaaagcaataatgaatcgtggtatatatccaactaattaaacaggccctaatataccaacctctgtaaaccataaaaggcaatgctggaagcatggtttttgaggatttctatcacctccggtcgcccactcggacgatctgatgatgggcttttatcacatcctacggtcttcgccatctcttatggtcttcgtcatcttcaacgttttcttcgccgtatccaatgatcttcgtcattcttgatgatattatctgtttgtcgattgaagggacgtattcgtgagtgtcttcgacgaatgatcaaatacatgtctagaaatcaataacgtcgtataaaagtagagtgagtgtttgagtattacattattgggtacccacacaaaagacggagagtaagagcatgtttagatccattcggaatggtaaatggtaaatggcaaaagttttgtcattgcaaaagtactagttggtgtttagatgcatcctaaacttttaccattctagcactttttagtatagagagagagatcccaaaacactttttagcacaatttactattatgaactagcaaatagcaaatggcaaattgctaacttttactactagtgtttaggtccaaaatagtaaaacttttactgttttggagaatctaaacagggcgtaacaaagcccagcttaattgggcacttggaaggagaaaaaaaaaagagaatctggtgtgaggttgtccatgtgctgatcgaccagtgaccacgaggtctgggtgtagatcccgttgcttgcacagagctggatgcgattgcacgcgatctctctctccctcgtcgtactgggtgcctactaacctcataattagtgcatgtttcgtggaccttttctctgtggatcggagctggatacgtactacgcgcacagcagcataccaattcgcctgtcctaacgaggacgatgtatagtaattgagcaactaatgtagcagcgattagcaggagcagtgcccagtgcacacattgatgattgatctctcgaactcaagatgtggtttaataaagtctaagtcgacaggcactccatttaaacaatgtactcgtactaactgcttatctgtcgaaaagttcagagccacagccactgcaagagtgcagtctgcagagttcagaccaagggatgtttcactggg

SEQ ID NO: 22966 - DNA, 1944 bp, Oryza sativa
ttcctgcacccctcttctttttgttagacacctcctggaaactcttttcatcctccttatcctctcctgctctgatcctttcgatgtcagagtcagtcgggatttgacacctctcatattcgtcttcaggtagcaactcctgtgttaactcacccccttcatcctgagattgcatctcagtcatgaactctgccttctgagggaacattcagttgttttatctttcatctcatcccataacaccatggcagtgcccatttcagccttcttcagtagggaacttttcttagataccagcttcttgatactacacccctgtgtcccatgtgatttccctttgtatgcaggggggcagaataggccccaaacctattcccctgattactgtcagcatctctgagttgtctccctctagggctattttgattcttaaattcatcatcaaggttcatgtcttcttgcaactcttcatcatttttatcatctttatcatcaccaccatcatcatcagggggcatctgtctgttttcatatggtgggtagccctctggttcccacttagtcatgtaacccaccttgttgatgtaaacatgaactgagaaatgtaactccctaggatccttgcacgccaccctgactctcacaggaccatctctccttaagctagctccatccatagtttcaaactcccccaccagttcaacaatggcagcaattgagtgactgttttagcaatttttggaatcccaaatattttcacccacacagcaaccaattgactgttttagcaatttttggaatcccaaatattttcacccacacagcaaccaattgactgttttagcaatttttggaatcccaaatattttcacccacacagcaaccaattcatccacggcttcctcagtcattccagtctctaccacacttgccttaatcaaagaggtctcaaagtcaaaacacttgcatgttgagattttgcttctaacctcatcaaaagggaaattgattaaaaactctttgtcatttagttgcttcactttccattcccagtttagtcccacaaacaaatgtttcaattcagtaactatttttaccactgaaccctcaccaaggattactgttagaatacctctcacaggagctctagcaacctctgcatcagatatctcaacttgaaggctatagaaaccatgccctgggattccaaatccacagagtttaacacctctcttcatcagattcataggacaatgagcagagatgtgcccagtgttgtgacaagagtaacagagaggagggttagggcatgttgcctggtgatggccttcgcggccacacttgaagcacttgatcttcggaggacctcctcctccccgctccgcctcaaaccccgggcgcccttgggattggggacgaagcgcttggttcctgggattctgagcgagcagttgacgccacatgacattctatccccttttcctccaccacccttcaccgcctgcgcccgccggcggttaccgacgacacgactccatccgccgccgcagcccaacgaccggcggcgtcgcctgcctccctgacccgccgcggccacgagttagtgcaagcgcacccgccgtcccgccgctcccgccagtaaggaggttcccctattgccatgttgtatcaaagagaaccagcaatgcttcctccctgctccccgtgccggccatggcgacggtctcctcttcttccctctcgctgcctcctctctcctggtccttattcttcacgatcttcgtgtccttcatggcattcgtgatctctgcagctggcgtctccacccgctgtacatcctccacgcggaccacgccgcattcttggccacctgatacgtcggcgcgtttcgccagagtcgctgcctctcctttgccgtcaacgggagccttgtcgccatgcaca

SEQ ID NO: 22967 - DNA, 4594 bp, Oryza sativa
  unsure (1)..(4594): unsure at all n locations
tgccccccacaacatgcagacgtatatattagccaagcatgtgtatatggctgagcacactcacatgtgtgtgtgtctatatatatatatatatatatatatatatatatatatgcgccattacgtgcatgactcatgcatgagtcatatttaattcattagcttgcttagcacattagcgttgttagctagctaatttacctgcttcctgcaaccagccactaacacacaatatgcgagcgcggcggaggagcggcggcgggcgagcgcagcagtgggcaaagcagcggagggcgagcgcggcggcggaggggcggcgggcgagcgcggccgcgggcaaagcagcggagggtgagctaggcgaagcggaagacagtggatgggatggggagctcccccgtgctcggccgccaccaccgccgtgccccgtgccctagcgggtgccccacggcgccggcgacgaaggcctcgaggccgtcgatcgcgccgtgagcttggcgggcagggactcgacgaggaggacgaggtcgtcggccttgccgaggacgcgctcagtggtcgggaagagcaccgcggcgatgtcctggacgacgaggagctgcctgtccgtgaagaccagcgtggggcccaccagatgtgccctaaagacggtgtgaaactgacatgtgggacccacgtgggccccaccttttttataattcctgcgtgaaactgacatgtgggtcccacaagttttatttatttttcaggttgaattgccacgtaagcgtcatgtcaatgccacgtgggacagagaccatcagccaaaacagggacgaacttattccgctctagttggatcactgcgaatatgggccgtcccttcctcggcccaaatgttaactgggccttttggttagctgcattgtgaccaatcggatcactgcgaatctgggccgtcccttcctcggcccaaatattaactgggccttttggttagctgcattgtgaccaatcgaatttggcccgtccccgcgatgggagcggtgggttctcttctccgacctctgcgtttcctggttctggttctaaatggcatcgtccagcaatgtccgtatacagattgtacagaatattgtccaaaaaaatcttctgaagcgcaagcaattgggcaaaaacttgagattagaaatattctgggtcgttcgctttgagaaactacttccagaacctgcccaaatcaaaaccctctgtcgaagcaacgttcgtatcaggatcacaacaaatgctaaacagatcaaacttggcaagagaaacagcaagatagatctgaagttttaaaaaaaatggaatgatagataggattgtcacagaaaagccaaactgggtggccattgggacgggccgtccagcattaaatcctgcggtggtttcctctagggaagagctctccgagagagccatggtgatctcagccatgtgatctcgaatgaacatcacaaggccgcacctccttcccagcaaattcgccgcaaagtcaatagaaacgaacagagaaagcaaccaagaaacgaaaaaggaaggcaaagaaacgaaaaaggatgactgacgttcccgtggttggagaacggcgacccattcgcgagaagatttgcggccgcggtggcggtggcggcggcggttgggggaagcaggagagtccagcgccttcttatatagagaggtggggtggggtggttagggcaactcgcctctgggccacgggacgccgaaaagagagaaaatcttgagcaggccgaagtgtacgctacccaaactgggccggaatacgcgccatcaacacatcatgggcctctttattaacagagagcaataggaataagttcactttgtgaccctcaaaagtcatcgaaatataatctgaccctaaaccacaaaaccggatatctcgacccccccaactcttaaaaccggtgcaatttgactccctcggcggttttggagggtggcttcgctgatgtggcacctacgaggcatcctagtcatcaaataaattaaaaaattaatgtggggcccacctgtcagtgactcccctcctatattctctctttcttcgttggcagtagcgacggtggtagtattttctctttcttcgttagcagcggcgacggggggacaaggggagtggcggcggctggcagcaccggagcgtagccgaaccgggggcggcggtcggcggctagggcggcggcggctcgcggcagtgggaggacgagtggaacagcggcggcggctggtagcaagctcccatcgcggtgcggcggaaccgggggcaacggttggcatctgggacgacgagccaagaaggacgatggcaataaatttcccctccgcctccgaaccccaccgcaaactaccgccgtcctccatgcgccgccgccactcggcgaagctctcgtggcgctcgaatcgctccgctccctcgccggggctagtctccggcagcccttccgcgtccaccacgtcgaacgccatggcgtagtaccgtagcgcgcgcgcgaaccgcgcctcccaccgcccggagttgaggccgccgccctcgtgctcgccgaggaggaggatggcggcgcccgtgctgcgtgctagccctatgatgtcggtcagcgcggctcctgtgtcgtaggcggctcggtgagcgccccaggaagtcggtcagcgcctcggtgaagtaggcacgccgttcttcgtgtcgaactcgggcagctacggtggcatcatcgccgacgaaccaccaagatgattaagctagcgtttgtggatggagcaggcgcccaagatgacgaggaacatgaggatgacgacggtgaggaaggaggcgacgacggagccgctggttcgctggcagaagccgtggaactgcatgcatatgggaacccagttcgcctgcaggttgctgttgtgcgccaggtccacgatcgccgccgccgcggtcagtagcacagccatgatctgcacaaacatcaatcgctcggctcatcaggagccgctcattcatggctccaaatcaatccaaagaaaccatcgaatctggcgcggaactagccgtagaactcggtgaagacggagagcgtctcgtctgtaaccgcgagggcgaggacgacgagcagcagcgcgggctgccgccgccgttcccctcgtccttccactaccgcgagcctccgcagccgagccgccaccgtcctagccgccgaccgccgcccccggtttcactgcgccccgatgccaacaagccatcgccgctccccccgtcctcccgcagcagcttccaacgaagaaagagaggatatacgtgggggagtcactgacaggtgggccacacattattttttaaatttatttgatgactgggatgccacgtaggcgccacgtcagcgaaaccgccctccaaaaccgctagaggagtcaaattgcaccggttttaagagttgaggggtcaatatatccggttttgtggtttagggtcacagattagatttcgatcactttttggggtcacaaagtaaacttattcctacagaatgtacacccagcagcacgtacccatgtcctagctagtgcgcaagctaagaatcgtcagagctaaaataaatcaactggagtagtactaaacaacatgtcaacacgtcaaaaagtactacatcctccgtttcacaatgtaagtcattctagcattttccacattcatattgatgtcaatgaatctagacatatagaaaatgntagaatgacttacattgtgaaacggagggaataactaatgttgaacatgtcgtgtttcgataacttgactttttgtttcattatgtacaaacaaatgttccatgaaacattttaatgaccacattctttttcagatcggatacgtagtcccatccatatcgaaatagggcagaatatcgaactagcttcgctcagctcgtaatccaaatgagcagaatgtatcagctcgactcgtttgtcaccttgagccaacttgtttagcttgcgaaccaacatatccacccaaaaaggtctgcaaattaaacataaacatgatcttccaggaggatgaaatctattggcaggaaaggagtggggagaaacggctacttgagggggatgctaacacagccttttttcatggagtagctaatggtaaaaagaggaaaagtaccattagaagtttagaagaggatggaagagtgattgaaggtaactcagaactgagagagcatataacccgttattataaaggcttgtttggttcggagttaccaccaaaagtgttcctgagctaggatatgtggaggaataggggaagggtggatcaagaagataatgactttttaatcagacctttttccgtggaagagattgagagggctttagcaaaaatgaaaaccaatactgcccctggtcctgacggcttgccagtttgcttttataaggagttttgggagcagttgaaggatcaaatcaaagagatgctggattctttgtttgaggggagactggacctttggagacataactatggggtgattacttcaattccaaagataaaagaagcaaataa

SEQ ID NO: 22968 - DNA, 19574 bp, Oryza sativa
aagccttatgcagacccaaggaggatggggggctgggcttcatcaacactaagattatgaatgaagcactcctctgcgaatggatttataagttggaatctgggaacaatagtccctgctgcaatcttttgaggaagaaatatttaggtcagggaggtggcttctttcaatcttctcccgaagggggttcacagttctggaaaagtttacatgaggttaagaattggatgaaactgggtagtgcctacaacattggcaatgggggaggctgtcaggttctgggatgatgtttggttaggggaggtgcccttaaaaatccaatttccttacatttatagcatttgcgctgaccctgataagtctgtcagccaaatgttgatagaaggggggtgggaaattaggttaagaaggtcgctaggtcaggcggatttgaatgaatggtgtgaattgcactcaaaacttagcacagttcagttgacctcagaggaagatataatgttctggaagctgacaaaaaagtcaattcataactaaatcgttatatagagaaatgatctttggggggggtcaaagacattgttatccaggacctttggaaagccccagtgcccctgaaagtgaaaacttttgtttggttgatgcttaaggggagaattcaggtggtaaaacagttaaaaaagatgaaatggccaggtagcccaaactgcaagctctgtcagagtgaggaagatatagatcatttgatgtttagatgcccatctgctcagtttcttgggtgtatcttgagaggtacctttagctgcccgcatatccctgcttctaggaaagaattgcttaatttggctcagttacagagggtagacaaggccaaagttctttggcttctttttgccactagattttgggcaatttggcttattagaaatgattgggtctttaataacaaactgatgacaaatgtttcttctctgccttataaagctctttcgtttgtaacgcagtggaaaaggctagctccggtaaacctaaggggggaggtggagactgtacaagggttgttgcttgccagcattcgcgagacagaaggctcaaactgatgatggcgaactgaagaatcaacatctcttggatagtcccctgcatggaacttttacttctatgcttctatgtcgatccttggcttgttctgctgtgccatcagcattagttcctcgctttcttttcagactgtgtgccttttgtttgtaagctggaatccccagcaatttgtgaaccttttatgcttttagtaaaagctgggccttgtgccttttctcaaaaaaaaaggtctgcaaatcaacggccgaagagtggtgacgacgaagcagagcggctggcggctggcggctagcctggctctcaagggtgaagacaagcttagggcttgagccctaggtttgtatcctaaatcccttgcaaatccttttcaaatttcatggaaaatttaaagattcaacaaaatgcattggttgagcactagagttagtaaatttctggctccaaccctactagcaataccacagagacgacggtgaatgtataaaacaaagacgtagaaggagccgtgcctgccgcgaagtgggggtggtgatgtgaagctgcgagctagtgggcagctggtggtaagtggcaacgacgagggctcgagggctagctaaatatgcattgaaccatgatatctagaaaattaatagttattggatccctctaatgtttgatgtattattttttctttagttttctttgaagtattttaaattccccgctacaacctgcgggatattaactactagtatattatatatcgcctgtcatgcaaacttgcaattcaatcacacggatatatgacaagcatataaatatataatggtgggtggtaagtagcagcacatagagattgatcgagaatggtagcacacggcatcacgcacgcacagcacacagattaggcacaataatctacaggttgtacaagttctcgacacactccagttagatacttaggctgtgttcggcactggctgttcccattctctactcctcgttttccacacgcacacttttcaaactgctaaacggtgcgtttttttaaaaaagtttttatacgaaagttgcttaaaaaatcatatagatgtatttttgaaaaacaatttagcaaatacttaattaatcgcacgctaatggatcgctccgttttccaggcgcacgcacacttttcaaactgctaaacggtgcgtttttttaaaaaagtttttatacgaaagttgcttaaaaaatcatatagatgtatttttgaaaaacaatttagcaaatacttaattaatcgcacactaatggatcgctccgttttccaggcgcacatcctgcgtaggggtgggcagaataagaccgaactgaaaaaccgaaccgaaaagaccgagaccgagaaattcggttagtagttcgatctcggcaattgaaagaccgaaatttattcggttaattcggtcattagcctcggctaaccgaatgctaaccgaattaaccgagaaaaccaaattatagcccagtaggcccaataaaccaaaccctagaggaactcaacccttagccacagagacagaggcaccgcaactagagatgaaaacggatcgaatacggtcggaaactagctatatcgtattcgttttcattttttttttcggaatcagaatcggatacggatacccggatatgaaaacataatcgaatattatcgaatacaaatacggagcaagcgaaacgaatacggtgacgaatattaatcggaatataaaaacctctcaaactaagcatcacaaatcaacgaagaaatataactcattattttttctaataggacatatcaacattttcaaaatttagcaattaataataaacaaccacaaacttgcacacactgatattatgaaataccatccatcatcatgtgaagtgaaaaggcaaagcactactaggcatgccagataatgtcaaccaatctttttagtctaaactctgaagtctgcaatgctgagttggtgtttgcaatgctgctacactcgcactgcataagctgaagctgctgctgctacttgcatgagaggaattcatcacaaatctgccacataacacatatacactaaacaaaatcaaatcagtgaggagctctacaaatcaaatcagtgaggactctacaagtcataccaaatcttggggcttgacggtgaggcaggcgaggaggcgatggggcgccgcggcggcggcgttggcttggcccggcggcggcgatgtggcgcgtgacggcgcgaggaggcgatggggcgcggcagagccggcgtgggttgctccgacggcggcgatgtggcgactgggcgaggaggcgattggtcccggcggcggtggcggcttggccccgcagcgaggaggcgacgacggcttggccccgcggcggcgccggccgatgaggaggtgaggaatcgtgcgcctgtgggactctgtctgggactggacggtgggagactgggagtggactggatctgaatggatggagattggagacttctaaggtttcttgtaagtcagaaaaaaaccagaaactttccgaccgttatccgattccaacggatatcatctatatcatattcgttttcgtatccgcaaaaaaatatccgtattcttttccgtatccgaaaatttttggatatatccgactgaaactatccgtatccgaaaaatggtccggtcggtcggaaattatccgaaacactttcaaccctaactgcaaccgcaagctacaacaccgcgtcgccatctatccccatccatcgcgctcgggctcgcggccttgcgcggcgcagacccgcggtcacgctgcctcctccatcgcaccggcgcggcgccgcctccatcgcgccaccgtaccgcctccgccgtccagccagcccgcctccacctcggtgccgcctccagtggcccacctccgccttggcgcgacggcgctgcctctagcgacaacgagccgcatccgcctccacgccgcctccagcgacagcgagccacctccacctccgcctctggctcgacgccgccatcgtctccagccagctcctgcctccgcctttttttgtctctctgaatatttttaatttgctagtcgcgtgtgcagatgctgagatgcttcgtctatctattgatctattgagttgcttttgatttgtcaatcaaatatttgctgtttgtattttatgaattttttggttctaatttctaaggacttctgctcgggttagttcagtcatgaccgagactgaaccgaactaaccgaggaccgaattgttcggtcttcagttttgttcaggaccgatcggtctcgagtttttgataaccgaaatttctaagagaccgagaaaccgaaccgaacttttcggttagacaaaatgcccacccctaatcctgggttgggaagccaggcttccaaacgcagccttagttagctactccagtatacttacttttagcgagcgttcttctaaaatacaggacgaggacgttacacatcaacactatacaaagcatacaatagttagttagttacctataaatatatactacactaatatcttgtcacatatgtcatacacacatacatcttcgtgctgcagctggctacaaatctatagtccactacttttctctctcatattttatcttcttgaaatgtgtttataactgacttatagtatgctattgtacatgctctcatggacgaaagcgcgcgtgtagatatgtgtatccgtaggacacatgcacgcatgcatgcaaggtataccatcacatcaatggcgtggccggccggcggccggcatcagtcttctctgtctagcccgaacttgcggtcgaggtagcggccgacggcctggaacgtcgggccgtaaaacccgccttcgctgcttcctgttcctgatccggatctctccctctcgctggcttcagtactttcgtcctgcgacgacgtcgtcgtagacgaacgtgggggcgagtagtagatgacattgatgtactcgccttcattgatgtacaccggcggcatcgtcgtcccggagccctcctcccacggcggagccggccagccgccggtgaagttcttgatgggaacagtttgggctccagatatgatgctgccgccgccgccgccgtcgtcagctctatcaaagcatcaatcagatttttaatgtcagagaaagcctgaatcactagctaggcaagcaaatatatgtggtgctgtatatggatgtcatggtctgttggtcataagttgatcacaaattttattttgatatattcttaaaaacctaactttatactcgttgtatatgatcgacctaatacgtactataagtttgtcaatcctgaattttccgcagcagtgttctagtatgaattcctagttgttcactgtaaactgaaatcagggtgttgaaagattaattagagatgtgtttttttttgcgattcgtagacttagatcaagttgaatcaatcgaatgcaaactttattttgggtgtctaatgtgaaggaagactattgcacattgctcttcagtgcgtgggcacacctcaaactttcctggatccaccactagttagtccaaagttatagattatatttgagttaacagtgataatctagcacaatggctcataataaaatggcagtgttgtataaagggctagagtatcttagtgacaaattaatccatacctgctttcggcagatttataaaaacgctcgaactggggctgcctacgccaccatgatcctgccgttaagactccgcgcctttctccttcgacagatttacatgctccttccccgtggtccttttgtagaaccacagatttctcattcaagccttctttcacaataaggtgttgtttttcagtagtcctatgttcttcatctcgtgtcctgacattgttattatctttatcatcaaaggtccaatctacacaccgtatgttgacaattggacgtcccggatgcatcctaatggcatcagtcaaagctgactctgcaaatcttctacaaagatcaccagcagtaaaatcgaccttaatttttgcagtgatctcttcaagtcctgacaaattttcgattccaacgggtatagcatcatgctgatctgctctgtggacatcaaaacctagcttgagcttccggagattaggcattgcacctgcctcaaatttcatccacgctaagctgcatctgaactttaagtatttgaggactgagaaccttgcattatcaaagacaatactttctgcaggctttgtgtggacataaagtgacaaaacagtgagagcaggtaatcctccaagaacatcaacatcatagcttgttacttccctaatcccaatcattaaaatacagagatttccaagctgcccaatccaattcggaaggctagaaaagatgcaaacacatggtaacaactcaagcctctgaagaagagctggtggggaggacacactgctccagccataaacagatacactcgtgcttgtagcactgtgaatatgcagagtatttgcataagaagagcctacaggtgatagagttatagatttgagattagggagtttccccagaatggatccaaggtattgcatattattcttcagattgtcagaatgtatggcagaataggtgagctgaagatcctggagattggtcagctcaccaaggctccatagattctctgatgtgttacagctgagatcaatatatccaagtgttcgaagcgatgacatgtgagcaattccattgggcgggtttgtcctagcaggtagactaagatgcagcaagcctgggagatgaacgatgtctgatggaactgcatctatttttccatctattttcagtgcctccaaatattgtagaccttgcatatgggttggcatttttaaggtgatattggaggtgaccttcaaatatctcagtcggacaagttccgaaatttcagtgagatcaaaactgatgctgtcctcatcaccgcagaaatgtagaattagaactttaagaagttgaaaccccgtaatagaaggcatacaattcaagaccccgcaaaaggcaagtgtccgaacttgagacagtctcatattagttggtggagttgcatcctctacattaccgaagtgaatagataatcgtcgaaccttgtcagcgagccttgtagtcgcttgtgtgtggtctattgcaatagcaaaattttcttctgttgacatgtatgtaataagattgagtaccatatggtgaaccacacaagacaaaacctcaccattgtcattgatatgtacaggctggataaattttctatcaacaagctcactgaaataggctcttgaaatttcttccttttcatgcccttcactaggacagatgaaaccttcagctatccattgattcaccaaatcatccttccaaattatgctattctcttggtacattctgagatataacatgcatgccttcaaatgctgaggaagactgttgtaacaaaggttcaatagttgtttcatcccttccaaattaggatttgccatcaaactgtaacctaaggtctcgtttatataatcccattgctcatgtttctcaagctgagttgctaagaggcttgcaatagtgacaacggctagcggcaaaccaccacatttccttacaatatcatacgaaacttcacagagttctggaggacaattagaatgagaaccaaaaactgtactgaaaaataaatttcttgagtcatcctcactaagtggtttcatcttgaaaatatagttcgactcataaccacaagattgcagagctagatcttcaatttctgtcgtgatcagtattctgctgcaactattaccatctggtagtgtgcacttaataatatcccatgtgcatatatcccataaatcatcaattatgatcaagtacctgccaaatattttcctcaaaaacatatgttgtacaataaatatattgctaatattaacctaagtcctgataattactgcatggagcatttataataatatatatttgggctttgcgtatctttgacattgcgactcgtttatccattatctacaaaaaaaaaggtactttgtatcacaaggcaatactgtacgcacctcttatcttgcagatgtgtccttatactggaaatcaggctatgcaacttccaattgtcaggtggctgctgcaggcgaacctgtgagagcatgctgatgagaagcctcctcatatcaaccttctgagaagaacgcacaaatgcctggcactcgaactgccgtccaagtttgcggtacagctcgttggcaagcgtggtcttgccaactcctccaactcccacgatggataccacctttagcttcttctctccatcagccagccactcctggaccttgttaatggcggcatcgagaccgacatgccggacgccatcggcacgctttctgcaaagcgtgggatgcccagcactagtattggctatgccaccgaggtcgctgctgtacaagatggcgtggcgttgaagcgcctcctgcacgcgaaggctgaattctctgatcttgtttgccatccacaggcgctgctttagcttctctggaaccagaggagtcttgctccccacaggtcgccggctgaacttacggcggcgaatcgtagatacgcttggataccggccgacggtggcagcgtgctcgtactgctcgactgcatcctcgtactggtcgatgcagtcctcgatgtcgtaggacagctcacgcacctccttcgtccagcacctgaccaccatgtcatggtagtcctccagttccgtggcatcgctgtggtgaccatggaggatggaggttatttcctcaatatcttgcctgatgagcggtatctcctggtctgctcccttgggcaggatgttgccgtgacgacgcaggagttcatcaagcctccctgggaggttgaccatggcgccttccatggatgtcttgtctgaagacaaatcaagctaagtgttacagatatccaaggtgtacttctaataaaatcgatgctgaacaagaagcagataatagaaatggaacgagatagagagggatctgatcactgaacctagaagttgaaggcatcagattatccgagtagaatgagcgagctctccgagcaaatgaggaggccggactttggagggacttcttccattttgcttcatttcctagcttcaagtctgacgcttctccctccttggggatttaatttgagtttcttcggatgggaccatttgtgtcgtgactagcaaagctgttggccaaactatgtatttggtagcaccctttcaagatagttgcaatatactatgatgtgatttagacaccaatcctcaaatacccctgaaagtgagaattacatttcaactctaaagcttcacataatttacatttgtctcaaaatgcagagttgtctgagtaattgtcacaaattacactctacctcatatattaggatttacagatgcatgacacgctccaccatggacaaaaaattccatcttaactacaaaattgaatggctaattaagagaccaagtctttcacaccatactatctcggtctcaacatatagctatttatgtcattttttggagagattaaagtcgaagtgattgcttaagatgagaaagtaggtaaaagaattaaatgagaaatggttatgattagttgagataggaaaataggtgaagaagtagctatattataagacaaatttaaatcctagatataggggtacatgcataaaggaggaattagtaaacaggcttttggacacaccaaaataaacatgattcttttccgctaagagcacatttatattgtactgaaatgcgaaataagtagtgaattacgaataaaaaacaagtagctatattcagtgtgcatatgtgtattccgtgtaatttattaaaaaaatcttctagtattttttggtatgaggataatttaccatccttaagaatataccaggagcaaatttacatgtaaaatttggtattttcaaatactacgtatcttaagatactaaaaatttttaatgtaaaatttaggtatctcaagttaaccgtaaaatttctcctggtataaagctgtgggttcatctaaagtttgttttaagaaaacacatacctgtggcagtagatgttgtgcatctgattttgcactcaagtgggcgtttccgcgcatatatacacatacgaatggtggattgttgacttgttgaaggttgcaggtctgcagctgccgaagctgctgctgctgctgctgggtggattggtctggagccatggagtccgcggtggcgagcgcattcttgaaggccgtgatggggaggctgttcatggcgctggagaaggagtacagcaagcacaagggcctcgcgcaagaagcccagtccctccagctcgacctccgcatgatcgccgccgtcatggacgaccagctccgcgccatggggagggcgacgacggccgacgcccgcacggccgtcgcgcggctccacgccgaggagatgctcgacctcgcgcacgacgtcgaggagtgcgtcgaccgcttcctgcaccgcctcacctgcaggcagcaccgcggcggcgccggcgccggagcgtcgtcgtcgtccttggtgcggcggatggcgcacgagctcagcaaggtccagagccggtcgagcttcgccgacgagatccagaggctcaagacgcgcgtcagggaagcgcagcagcggatcatccgcatgaaacctactttggatgtcctcgccggcggtggcggtggcggcggccaactcacaggcgctgccggcacatcgtcgacggcgccgtcgtgccgcgcgtcgcgcatcccggtgggcatcgcggagcccgtggaggagctcctgtcgatgctggacgaggtggacggcgagccggagcagatgagggtcatctccgtcgtcggattcggtggctccgggaagaccaccctcgtgaaggcggtctacgatgatcctcgcgcaaaggacagattctcccgccgcgcgtgggtcaccgtcggtagctcgccgtcgccggagaccagcaatgggatgaaggggatcctgcgtgctgtattccagcaggttcttcccaaagacgccatggatgctgacggacagcatcttgaaacctcgctcaaagaatacctgaaggacaagaggttagtgcacatttaacatttttcttttttttttgaactactttcatatgcaaaatttaacttttaattggacttttgctcctcattcatcaatttgactgtcgtgtgtatatattgatcagggttcactgttttggaatcccaaaaaaaaaatcagggaaaggaaatttcagacaaaaaaatagttttgaaaacttctttgctaaattcaaacaaattctgaaaacaggcactcaccggtggacacaaatatttgaatcaagattatgaaccctgttaccctgatactgatcagcagaatttatgttttaccacttaattttgctactcatttctcaatttggttattaggtatttaattatcatcgatgacatcgggatggatcaatggaacatcataagatcgacctttgaagacaatggtacaagcagcaggataatactgaccacaaccatccagtctgtggcaaatatgtgcagccatggcaatggctatgtgtatcaaatgaacacacttggtgaagaagactctaaggaactcgcttttccagggtttagatcacctgagttggagcaaggttcagcatcattattggggaaatgtgatggtcttcctcttgctctggtcagtgtctccgattatctgaagagctcaaatgagcccacaggagagctgtgcgcaaagctgtgccgcaaccttggttctcatctgaaagagcaggatggccattacagcttttcagaactcagaaaggtgctccttgacaactatgacagtttttctggctatcctttgagctgcttgctgtatcttggaatatttccaaacaatcgaccactcaagaagaaagttgtaatcaggcggtggttagccgaaggatatgcacgaaccgactctcttcgtagcgaagaggatattgctgatgagaatttcagtaagcttattgaccggaatatcattcagcctgttgacacaagaaacaattctgaagtgaaaacctgcaaaactcatggaattatgcacgagtttttgctgaacaagtccttgtcacagatattcatcgcgaaatcgtctcgtgatcatccaagactaggtgtcaatactaatgcgtgccacctttcttttcattctggtgaactgacagagtgtgtggcatctgatgaagagttatctcgtgtccggtctctgacagtctttgggcatgcaggtgatgcaatttgttatgttcgcaggtgcaaactgatacgagtcttggatctacaggaatgcagtgatttggatgacgatcatctgaaatacatatgcaaattatggcatctgaaatacctgagctttgggagcaatatcagtgagcttccaaggagcattgatggactgcattgtttagagacactggatttaaggaggacccagataaagtttttgcccattgaagcaatcatgctgccccacttagctcacctgtttggaaagtttatgcttcatgaagatgatgtgaagagtgtgaacaagatgagtaaactacaaaaattcttttcttccaaaaagagcaatctgcaaactttagcaggatttatcactgacgaaagcaaaggttttctgcaacatattggtcatatgaacaagctgaggaaggttaagatatggttcaaacatgtcgaaggcagcaacaattacatcgctgatctttcacgggccattcaggaattcaccaaggctcccattgacagggatactgaccgttctctctcacttgattctgaagaatgccctgaaaatttcctgagttcacttgatttggagacatgctctgaaggttccaaatatgctctgaggtcgctaaagttaaatggcgaacttcacaagttgcctccatttgttaatttgttgtcaggtctcactgagctttgcatttcatcacctatgctgacacaggttcatctatcaacgctgatcaatctgaacagactgctctacctcaaactggttgcatataagctcgagaatttcgaaataaaacatggagcattcccgagcttgcgacgcctgtgctttgtagtgaaaagtgtcacttcagctctgcccacaatcaagcatggagctctcccaaatatcatatcacttcagctgctctgtcaaggtccagttggtctttctggcatcgagatcagacacatgaaacatctcaaggaaatcacaattaactctggagtggttgtacaatgggaacaggcagcaaagaaccacccaaataggcctaaagttttgttcctcagaaaggttgatccaatggaaagcgaggaacggggaagaccttgtgccataagggagcagatgaaaattactgtagctcaaccaactagttcaggtgatggactgaactctagcctcaataagatcagactttcagagcctccttcttcacgacttgagatgcctgttcgtcatatggtggatggccactgaggcagcaccccagacttccttggcaaacctctagcacaatataccactgcagctggcagacttcaatgaagaccatccaaattttgctaaaaaaacttggaaatctagattgctgttcagttaaatggtccagatttctgtatttccgtacttgtcatgttatgtggttaaggttgtaaattggcccggttttttgtaagttcagggtgttaaataaccatattttaaattcttaaaatacaatgatctgtgattggaggtgtgcaattgacctcttgcataactaaatcgatcctgtttgtaaaaagtacttggtatattttggaaataccaaaattatgtatcaagtgccgtatgtgaaatttattattttcgatgaaataaacaaaataaaaaagttcaagtaaactaaaggactagtactacttcctagttcttacgaggaacgtaaaacaccaatgacataaccaggctgtttaatcagtcaaaattttttgaaaatttttaatcagtcaaaatagagtttccaagtcataaattctgacagaacatttgttctcaccatgatgcaacaaaatcaacaggagcacaccgctaaacacattattcagattctgcgaggaggactcaccgtccgtggctccaccgaatcaggcggcgcgatgcagacgaaggaggagggttcccggcccgccaccgtcggcccccgacgaggaccaagtcggacggacggaggaagaacggacggcggagaagacgggactccccctcgtgctcgtcctcgcaccgaattccctgttgctgcgggattccatggcctcccgctccagcgccacgccgacgcgcccgtgcgcgacggcggccgctcttcctctccctccccctcgccggcgcctggaaccgcagtgctgttgctcaatgggccacatcctacttaactcggcccgttttgatcgggtcgcagccatcctatttcctgatgggccggcccagtattgttggcaatggttgccggctggtgtgtacgcattccggcccatgctgggtctctgtctgtgatttgtctaggggtctcactctcacaggcaaatgagcttaagagcaagtacaagtacaataggaccagctccaattatttccacgtaatctaaggacaaagctaaacgccagaatatactggtaggtagtctctaatttatctttgtgcctttccatagcaatagtattttattctttatttttcttcaattctctctcttcctctgcgttatcttcctcctatctcccaggtaatatcattttttaaagaaggatagtatacatcagtaacacgtggaggtgattactgaggggtacaacatggcacgcaagagcttgctaaaccgaggcagttttactatcattgtgatccccaagtttccaaataaaacaaaagtggaccgacccgtttcaggttatcagatgttttgattttggtcaaaatcaaactaattcaagtttgtagaaaacaataataatattttcaactcaacataaatttattataaaaatatattcagctattgatttcataaaactaatttggtatataaactaagttaaatttgaagtagtttggttttaaccaaagttaaaacgtcatataaccttaaaacgtagggagcacttgccatagcttctctattagagagggagagcgagtagaattaaaaacctggaatgtgatggctcgtgcgatgcaatcgctccaagctgctgcttcgctgagctctcctgctcgtgagtgcagtagccacaagcttcgccaatggccaggacccaacctcaatcctgtctcctcccttctcgttgtcccctatcaacatgaaaggaggagttgtgcgcaacaagcgctcggacgagcgtgtgtatcaagggtgagtactactgactacttttgtttcagccaccgtcgataagccatggctacgaccgctcctctctcacacgtagcaggcccatttatcttgagcgtatgtgtcgctggcgactaattagcattcaaatctacatgttcttcttatcgttagcattgcgagctctattatacttgcttgaagctcaagcccatgattttggtagcctggttgaggcaacaattaattttaaccacaaagataagtaatatctgaagaggtatggcttgttgaagaggtccaatatactcccaagacagaaaaaaaaatgatgtgtttggaattatctgattcattatctaaaaaaaaaaactatggttctttacccttacctctttcttccccataatataacaccctttcctattgtccatttaaagtattagccttgatcatagccagtaagtaccataaccctgttgatgctgtcgtaagagcatcaccaacagtccaccaataatctatccccaaaaattaatttttgtttcctaaactgaaaatagatggtgaaaaaaccccttacttcaagagatagcctaaatttaatcccaaaaactaaaagtggaaccttctgctaaactaccaatagaaattctagttttttttcctttcccgtgcgcaggaggagatcgccccgacgcggggaggagaggagaaacgcacggaaggagggaattgggagttgttttctcgccctcaaatacacgtacctagaaaattggagatgggaactccaaaacgtccggagctcttttgggaatcttttggaccagtttttttaaaccaaaatccccaaaaaaataggattgatgatggaatagatagactgttggtgatgctgtaaatccgatgttctctgtgaatttgggctcgctacagttgcgctaccacagccacagcactaccggtcagacctattatccatgattcgcactccatcaaccaattttatcaagaatcattgcttcaaaaatagccaatttcgtagcatttgtaacgtctgggttagcgactaataataacaaaaagaaaaaaaatcattcttcaaaaacaactattcaaaacttccatcaacaatccagatcagcatccttcgaggtcgaagtcatgtgactttgtcactaacatgtgagcccgatgattcctgagcccacatgttaatgacaaaggcaacgtgcattcgatggcggagaacctcaatcccatccatccatcttagcgtgaggttttccccctttcagctcagcagtgagccctccatcaacaaatcgatcatggccaccgtgcgcgctcttcgcctcactccagccgtcgtggcagtggccggtggtggtcggagaccagcggcgccgagcacgtcctgatcggccggtgctgagccgggacgccgccggcgggaagggacagctcgagcacttcgttgcactcgccgcaccgtatcctggtggtccacctcctcctccgtggccgcggcggcggcggcgtccgcagaagctccgagcacttgccgcagatcacgaatggcgcgccgcccaggaccgggcggcaggggtcggtgccctcccgccgcgcgggcgccgacggacgcccgccgccgcggtcgccgcggcagctggatgacgacgccgacgtggaagcggtgtcctgcggcggaagcgcccgctccagctgcgactccagccggcggaagagccgcgaatcgcgccgcgtcagggccctcccgccgccgccgctcgccgggcgcggctgctcgatggtgacgatcaagctgcggaggttgtccagcgcgtggaggagctccttgtgaaacgccgggtccatcaggcgcgccgccgcgacggcgcctggctcatcgggaggtcgaggcaagccaccaccaccaccggacgccccgagctcctgcgagctcaccggcgacggcgactgccatggccgcccctcctgcgcgttccttggcgtgtagaacgcctcctcgctccgctccgaatccgtcgtcgtcgtccagtcagacgagctcgacggccgcttcgtccgcctcgacaacggccggacctcgtcggcgcgccggtccgacccggcgtcctccggctcgtcggagaacaccgacgcggtgtcggcggagaggatctccagcctgctcagcgcgtactccgcctcatccgtcggctccgggttcttgcctgcggagacagcaaaaaaaaaaaaaaaaaacaccaagaaacaccacagcttctgggcgtcagatccatggcgactaatcaagcacagctgagattccatggcgggcgaggcacctcggatcggagtgcggcatctgctgcagtagaagatgacggccttggggttctggtagatcatggcgcggcagtacggacaccggccgaaccgcattttcacctcctccgactgcatcgccgccgcagaacttctccgactaccaaagcatcgatcagaaatttcgtcagagaagaaggcgtttgatcaacagcaatcaattcggccggtgagatgcatcttgattcaaacctgaaacccccccaaatcaatgcattctttatgccaaggtcaagtcaatcaacttcagctcgctaactgaatataactgctaattacgactcctcattaagacattgaccaattgcagtggaattgactgcttcataatcatttaccaatcccccaaaacaaaagctgcgatgaacattgctacgcaaggacatgccgggaaaaaggactcattgacctctagcgaagatgggaaatggtgatgagaaattggagattgacgctgtctcgacatgaactttagtacggggctacggcgacagtgggcatccagtacacccgtgcacgggagtaaactgttgcaactcaagttaggttttttttcgacaataaacatctcgtggattgagagttcagattggtttcttgcacagactaattgcagagcaacaagaagattgggggagaacatggcactataatcaaattaaaatataccaaaatatcaaattaaagaaaagaacagggaaacccactagatccctgaaaaaaaactgaatctcacctagctgtcagaatcttcagagcccctctgattcttcagctcggcttctcagacacgagataataactgaatcgagccatggaagaaacaggaggaaatacgggggaggaagaaagagtcttgagccagcgaagacacagcgtacaatccgaggaaatattttactagtacagatcgtgaactgaaaagggcatcgttggaaagatgggattggagcacagcattgccgcttaaagaaaaactgtgattttaattggtcaattgcttgttccagttcactgaattttctatcttggtacaatactaggtgtgcagtttgctttaaaaaaactagcatagtggcccgcgcagattgtgcggctatcatcattatattttctctcatttaatagcatatatgttttctcattatattattcaaatatactaaaataacaacataattttaaattttgcaataactttataaaactagtaatattcatattatattttatatacgtgttagttattaattatttttaatatcaaattttagttatttgtaaattatatatattcctatatggactctagactcgtcttttaatatttctttttttaattccgaattttctataaattgtatttctatatagactctatgctcttcttccaatattatttatttttatttctaaattttcatattatattttatatgtgtgttagttattaatcattttcaatatcaaattttagttatttgtaaattatatatattggggtgcag

SEQ ID NO: 22969 - DNA, 14914 bp, Oryza sativa
cttttttctacagaattagtcaaatttagagtagtttgactttaaccaaagtcaaaacgtcttgtaacctgaaacggagggagtagtttactactactcaattgatgactttttaagatggaagtcaacggaagctaatcagtaagcaagtaaatttggtggtctagttgtgatgtcggtcagtcttaagttgatcactaactttactttgatatattcttaagactgagctttgtactctttgcatatgatcaaccttacctaccacaagtaggtaaggtttcgcagcagtgttctcgtgtgacatcttctccaaaataatcttgaaagtggtgtgcaaaaatgtgaacattagtctttcaagtttagcaatcaactttgactaaattaattgtgttaaccaatcaaaggaaactcatataacatatttcctcgttaatcacaaatttttttaggcaagtgaagaacaacttgcagttgcagcctctggtctacagaaaaaaacaaatcttatgatcaggtatgtgtgctgcaagggcccagctccaacggcccaatccaaatgcagctgcaaagcctgcaagcatcagcaacctccatttctttttaaaaaaagcatcagaaaaaaaatataaacaaaaaatgttaattgcattatcccacttgcattatcctccgcccgccacgtgtcccgtctcccagcctcagctcgagctcgccacctgctcgacccgagtcctctccttcgcttcgccgctgctgctgctgcgggctcgcttgggatgagagccccctcctctccatggcctcctccctcctcctgcctcgcgccaccttcgccgccaccaccaagcacatcgccgtcctccacccgcccgtcgcatccgcctgcaggccccacccgcccaggctgatcaggtgcggcgccgccgccgtcccggacgacgagctcctccgctcgctctacctcgtgcaggccgacgccgcgtcgccggtggtgtccgcggacacgggcaatgatggatgggccgctctccttgacgagatcaggggctccctccaggcggaggactcgtcgtcgtccatcccggcggcgaccagcggtggcgtcgtcgtccccgacgagctcctgaccgcgccgccgtccgtcgacatcccggacgagatcctcggcgcggacccgtcgtcaaccctgcaggcgcccggccccggcggcggcgccatcccggaggaccttctcgcggcgctgcacctggacgcgtcgaacccggtggtgcgggcggcgtggggggcgctgtcccgcctcgacgagctgacgtcgggcctctcggggccgcagcggtgggcggcggcggcgttcgcggcggcgacgtgggcgtacctgacggcgcggccgggggtgctgagcggggcggtggacgcgtacgtgctggcgccgctgcagctggcggtggacagcgcggtggggcggcggagcctgaggatgagcgacttcgtggtcggggagcggatcggggaagggtcgttcggggtggtgtactccggcgcggtggtgccccggggcggcgcggcgccggcggcgaggaaggggaaggcgaagacgaggctggagctggacgagaggtacaaggagaaggtgatactgaagaagatcaaggtggggacggcgggggcgaaggagtgcggcgactacgaggagtggttcaactaccgggtggcaagggcggcgccggagtcgtgcgccgagttcctcggcagcttcgtcgccgacaagaccaagtccgagttcgtcaagggcggcaaatggctcgtctggaaattcgaggtaaattcgacatcaactcatcagttaatgcttgatgctagtatgaactgctgcaaccacatgcagcacagaaaattagtagtagtaacaacaattttaggaatcactaagctttttttttttttacgcaaaaaggtagagagtctctatcttatattccattatagaaatggcggtcaaagtacatggccaaatggccaaagaaaggtaaaaggaatacagaaaaaaggttacactggaaatggaagaaggagaaaggaatcactaagctagcttatagcatgcaaaaatctcaacagcctttaaactttaaacccaaaatttgaactgcttttatattttaaactcggtaatatgaagttttcaagctttttaaacgcaaatgagacataatccactctgtgatacaaaactttgaaagaatcaccaagcttacactacgcaaaaaagttcaataactttgtgatacaaaattttcaagtttttaagcccaaatgattcaaaaaattaaacccaaacgaaatgcaatatgattaaaaaaaagataaattggcccatgcaggtctcgaacctgcgaccttcgcgttattagcacgacgctctaaccagctgagctaataggccttgttcttttatatttgaaaaaaaacattcaaattttttaaacatgatttctggcgcgaattcatggcagggtgaccggacgctgggcaactacatgagcgaccgcaacttccccttcaacctggagggcctcatgttcgggcgcgccgtgcgggggctcgacgacggcagccgcgccgcgctggtggtgaagcaggtgatgcggcagctggtgacctccctgaagcgcatccacggcaccggcatcgtccaccgcgacatcaagccgtccaacctcgtcgtcacccggcgggggcaggtgaagctcatcgacttcggcgccgccaccgacctccgcatcggcaagaactacgtccccgaccgcgccctcctcgacccggactactgcccgcctgagctctacgtcctccccgaggagacgccccagccgcccgccgagcccatcgccgccatcctctccccgatcctctggcaggtgtcgaacacctcacaccttcttcttcttcttcctctccgttcaatcttgcgccgccgtcgatcaccgtcgtcgcgttgctgtttcttggctgaatgcagattaacagcccggacctgttcgacatgtactcggcggggatcgtgctgatgcagatggcgtcgccgatgctgaggtcgccgtcggggctcaagaacttcaacgccgagctcaaggccgccgggtacgacctcaaccggtggcgggagaccacgcggcggagacccgacctgcagatcctcgacctcgactccggcagggggtgggacctcgccaccaagctcatctcgcagcgcggcgccgacaagcgcggccgcctcaccgccgccgccgccctgcgccacccttacttcctcctcggcggcgaccaggccgccgccgtcttgtccaagctgtcactcagcaagtaggttatacaaaacaactcaatgcacaaaattaagaacacatgcagtgatcaggtcaccactcaccaatggcattagcatttttgtttatgatccattggagagatcaagaactcaagattgatccaagagagagggaaaaggaggaggaagaaacaatatggtaatatataattacattgttttgtatgaggttaatcactttgaacagtgcggtgcagagtttgcagacactagctaacttaacttaattactgcccgtattcggactgaactctactgagaaatccctacttctgttggtcagcttcttgcaacctatgtagatttctgaactgtttcttcagccaatccagtactttgattcgacagagagctcattctactgatttggctcaccaatttcttaattagacagcaaaccaaaaaaaaatgcttatacatcatcatataactttggccggttaagctgttcgaacttttcctgaagatcttcatggttgcctccaacaagcttatcaatctcctcattgtttttcatgaagatgaacgttggggttgcacgcacatcgtattgcgtcaccagctcctgacgaatcaaagtaaaaatgccattcatctttgttatctgttgccacaaaaaaaaaagtgtacagagagcaaaatgggcggcaactggaaaaaattcagaatattggatgtaccggcatttcgtctacatccacggacacgaaaacaatgtcaggatacttcagtgaaagttcagcgaatagaggggcagcattcctacacggagtgcaccaaattgcactgaattttagcacaacctgttcagagggacataccaccatggttaacataaacagctatgctttcatcatatatagtcagacaattgatcaacatcttactgttttgccatgctcagctacttcttccattgtattgtcccaattcttttgatcagttaccaaagtcacatttccgccactgtagtccaggtgctcctcggcgtctacagtgctctgaaaaaaaaatagaagcataatgcaggtcccctaattatgagcttgaagatgcaaataataagcagcactacttgtctgtggattggggcagtgcagtatattgtaatgtctagttcaataaccacaatatgaattgtactggagaaggagattatttacgctgccacagcaacccatcgacttgagaaaattcgtcaagatgcaagtgtcctctgctccactgatgaaaaaaaaaatcgggaacaatattcagtactggtgtcaatgccgctaagccaagaaaaagaagaggtcacacaaaacattaacctggatgttttgatggaaaaagaaagtcacattcatgtaaataagctcctacttcctctatcccataatataaggtatacatacatttcaagattcaactttaaaaatatttgactataatataaattaaattttatttgctaaaattaatatcattagattggcatttaaattcactttaagatggttataattttgttgtaaaaaacttatagtatatgagaaattataggtcaaatattagttttaaagactgtgccaagtttgaccatgctttatattatgagatggagagagtttttttttctagatgggacaagatcctgttcatggtagtgatctggttaaggggcaatttcgttcttgcccctactttcatcttcaatattgattttacccctgtttttttagggttttcgtttttacccctacttttttgaaattaaagcaaattttacccctactttggatggacatattgacggtgttacatctctggcgaaaagacaatcatacccctatttgatattgaatatttgtctgaatgtttattcaataattgtgtatttgcccccatttttacattgcatttttcacaaacttttgcaaatatgacaattttttatagaagattaaaatttttgacataatataattttgcgacaaatttgataaaatttgtatattttgcaaaagaaaaaaaaagacagaatttgggcatggtttttacacagctaacaaaagacatgtaatagcaatcatcacaaaatcaagcaaatccaaatcatgaggtcaaaaaaatccaatctagtagcatgttgcttcttcctattgccaggttggtgctgcttgccgcagcgtgcacctccggccgtccgccgcgcccggcctgctcgccatcagcttgcagcgcccctgagacctgctcgctgcgcgcggcctgttgcttggcgtgctagccgccaccgcttggccgggccactgccgtcgtcgccttcccgcatgaagccgccgatgcctagctgagacgccgccgccgcaagctcctcacgataagccgccaccgcctggacaagagcccatcgtcctctcgtccccttgtcgagccgcagtcgcctggcctgcctcgacacgcgcggccttctgctcgtcaccataggtgggattggggaaggcaaggaccggcattgtttggttatggctcaccaggggtataaaggtccatcaacgaattaaaaatcattacttcttttttttctctacttcttcagctccataatcccaggttgactaacttctgttaaaaatagtggtaaacgtctacttcatttccaaaaatcaggggcaaaaataaaaacattaaaaaataggggcaaaattgatattggatatcaaaataggggtaagaatgaaattatccctttggttaaaatactattgacgtcagctccattgtttgtttgttgacttattagtcgtagccaaaatttaagttttaaaacttaattttagagttgattttgaagcttttttcatcgtagtttatttttgaacgctagcttttaattgcgaagaacacaaatgcaaaagtttttacccataaattatctttagttgcttcattcacatccccacagcttatcagccatagagcaaacgatgtatgcagtcacttttaactttgtatagacgtttaatgtttatgtaaaccttcaatagcatttaaaattttaaatacatgttcaatactcatttgataatttgaactaaaaaaagtagaaataaaccgtcaaactgttttgtgacgtaaatcaagagaccatatttcacatcatgtcccataaaaataattcacaccatgaatgtaaattaattttgccaggatcacggtccaatcacccaatcacaaataacctacgaaatttatagagcaatattttttactgggtcggctaaaatgttattaagattagaggggaaaagagaagatggcttttctggtttcccaaatctctcacatgagcaaagataatgattggtgacatagacgatatggaaggagcgaaacaataaggtttttagggcccctttgaatcgcaggattgagaaaacataggaataggaaaaacgtaggattttgataggaatgtaagtgtaaaacagaggattgcaaaacgcaggaaaaacacaggaatgaccgtttgattgaatcataggaaaaacacaggaattggatgagagagatatactcaaaggaaagttagcaagaggttgaagctcttgctaaatttcctccaaaatctctataggattgtccattacataggaatttcaaaggattggataggatacaatcatttgtttcaaagggcttcataggaaattttcctaaaattcctatatttttcctccaaatcaaaggggcccttaatggccaatgcaagaccatacaggaaatagcgaagctagcggcatcggggggccacgctctcaagggagacaggagcacccgcccatctaggtggagcatttggtcgtcaaattgttccgcgagctatcaatgtattgtttccccgcccccattttattctttcctttctctctgtaataacttttttttaatcttaatacaaaagatacacattttgcgtatcctttaaaaaaaaaagagagagacgaacggaaggaagatagcatttccggccggtttccccaatctctcaaatcatgcagcagcaattcgctatacaacgatgaacacattgttcagagagggggcgtacctctgcaagagcaaaagggcaagaaaagtttggctcgccgtctgcttggttctgcgccgagcacgtcggccgtgcgtcgacggcggcggcggcggcccccggcggaggggtgggtggcacggggatggcgccggggctagcgaagggaacgggcggccgccatgcccaccctgggaagcgaagctccttgtcaaccgctgaaacgacggcctgacggtcgctaataccggggtggatcgccagcaaatctgcaggagagaatagctaaaattagccttcctttcaccgctatctcccttcagattccacgccggcttagctaccaaactgatctgcaatgccagtggcagcttgccattgccaagcaaaaagaaaacaaaaaataaaaataaaagttgtacaattgcattgtcaagagagaagcaattccagaaccagttgtcccaagagtatctctactttatgttcttctctttttctgagccaaatacacaaaggtgttttcaagccaaaggaatgtggcaaagctggaagttcattcattcaatacaacaaaccccaaagagttttacatgataggaccatgtcacccagtgatgatcagtagagctactggaaattaaacaaacacaatgactaacatcacatttctttcaagaaaaaaaagagtgagagaaggaatcacagcacagaatgaagaatgaataatgaagaagaagaatcactaaagaatgatcagaaaatcaaacagaaaaagattcactagacacattgctaccaacaaccttcaaggtagaaactattgaacctatttttgtctcagtggcatgttgttatttctgtgccatcaggtgatctggattgcttcctcctttagcttgtcctcgggggataacctcgtccccgaggaggagttcctgatctcctcaatcctccttaccacttcctccatccgaggccgctggtcgggaacaattgcaacgcatgccatggcgagctggagcatctgaaccatttcatcctcgctgttcggatgcctcaacaggtcggcatcgaaaacctcggaggtccattcttctcgaaccacggattgcacccatcttgggaggtgttcgatggaatcctcacggcctggggatctaagaggagcttttcctgttagcatctcaaggagtagcacaccgtagctgtagacatcggatttctgcgtttgccttttggtctcaaggacctccggtgcacggtatccaatgagccgtgctgggatatgagggatggccatgagctgcgcaaggccaaattcggagatacaagcactgagtccctgcgagagaagaatattacttgacttgatgtttccatggatgaactttccacccccctcagcatgaagatgagcaatcccacgtgcagcttccagagatatctttactctcgttgcccaatccaatgtagttcttccagcagttctattccctgaatatttaccataaacagtaggtcagatcatgtgcgctttcatagcaatacatgtacacataaaaggcaagttattcatgaattcatacttccagacaatacgtttgcaaatatgttgtgcagcctgtactactttcatgtatttttcttcacaggatatcaaccaaggaccaagatgcagtatacctccagaatgcatacgtcttctagtcagtttttttttagaaaataaatttcctagccatcaaatttagaaaaataattggtcggtttgcaataatagcttgttcgaaactacatgattttgtacatccataaaatctaaaagtgtatcaggtagactcactatgacatgcttgtaaagacaacataagaaaaggaaaaggttgttagacatagttcaatacaaaaaaggataaaattttggtccttgaggaggtaacaggaggtaccccattcattttctagtgtcaggaagtaaaaactttatactacaaaaatagaggactgcaaaataactcatcaaaaaagagtgagcattctatatttgcttgcacgcctatatgtagttaaaaccagctaataaattcactttgcacaaacaaaacaggttctgtcaggcaatgaaaggcttaatgatttgaagtaatagcataccatgcaaagcagcacaaaggctaccaggtgtcatatagtcatacaccaaaagcttctcgtccttggagtaatagtaagcacgcaattgaacagcattttggtgctggccaactctgccgattatctccatttgctgttcaaattccctctttcctgcgaccacttccttcagtcttttaactaccacggttgtgccatcctcaagaacagctttataggtagtcccataacttccttttccaaggacttcagctgaggccctcaatagatcctccaggtcaaaattatacgaacagccattaaagaaaatcaatttattcctctctgcttcttgaataccactactgctgtactcctgctttgatttttcagctcttccacctgcagcagcctttcctttggatgaaaatgaagctatgccaggctcgccatctttctttcttttgaagatgcatatcaagagcacaacaatcaaaatcagaagtaataaccctcctccagcagctattgcaattatgacaccaaggctaagccttttccagaagcttttcttggtatttgggggcaatggcgacatcggagaaggagaaggtgctgttcctggacatggttccagtggaagtccacagagaaaagcattcccgaagaatgaactggctgggaatttctgcagggaaggcggtatgggcccactcaggttattgttgcttaaatttaaatgtctcaaattggggaggtgaaggtcagggatgggtccagaaagagagttattctggaggagcaatgcagtaagttgagtgatattttgcactttcaatgggatttctccatcgaaagagttgtacgacaggtctaggaatgttaggttggaagatagtgaagttggtataattccggacaagttgttgtgctgaaggtaaagagaatgcagggaaggaatggatgctacatcaggggggaggctaatggtgagacgattggatctaaggctcaacacctgtagcgcgtcaagcttgccaagtgtgtctgaggggatgggaccaaagagccctactgcaggtagacgcaattcacgaacacgcctcccatctggtgtgcatgtaatcccaacccacgatgtgcagacttgagtcgtgagagtccagttgagttttcgaccatggggcactgatgcagcaaatgcaagaagggcctgcctgtctgagtttaggtcagcacatctggcacaagggatgtgcagaaacaaaaacgaagcagaaagaaaggctatgagcacaaggtgctgcattgttaggattaacttgaccaataatgaggaccagaattataatccaaaggtccacgtcagtgcttcattcctgccacattaaaaggatcatagtcaatagcaagtaagattgttcatagcatcaggagtgagagacatagaaatacatgaagcgttaaatattaaacacatgttatttgcaaagtgggaaaactagtaaaaacataaggtattttgaatacaaaacatgaagccatgaagaatttaaactttctagtggacatgtatcttctttttaactaagaacctacctgaaaagatacatccttgcaacgatagcttttctgtttgtcattgtaacgatttgtaatggacccaaacacacatatgtacgaactaccttaaggagcagtggagtttgatgcactaaatttgcattcgtccatttacaatttaccagaagcatttcaatttttttactattcatatcaagggtggcttaagagcattgatccattgagtatcagattcctggtcctgctaaggaatacaaacaaatatgctgccagaatggcatccattgcagggccaacatgatcagagagagattgaagaatttgcatgcgagggaagactgaagagtctacataccctaagctatctctcagcataatcaggagcccacttggcaactttgaatcacaactgattgttattattgacacctaaagctggtgtaagctcataatgcacattattggaataaagcatagagtgataaattgaagagaagatgacaaagtactggtcctctcttttatatgtaaaaggggaccaccaaattctcaactgctacacagcaaacccccctcccaaatggaacaccaaaacagaataaccctccttgttttttctctagtcttgtccaaaagatccacacccaaactaatattgccggtttatctcgagcttttctgaaatggagcggttgggaccatgtgccatataaaacgaaacatgtatctctttgataaagtaccccatccacgttaaccttttcacaaaggatagctccattaattctcttaacaaaatagccgcggcacctaaacagtgcacttaatcgtaaccagaaaggacacaaggatagtgacaatgaacaagacaccgttccaatcggacatggcatagcacattatattggtgctctctcttgcaaagatgttacttgcacaaaagcaacatgcaaagcacctaacgtaggctcagtcactactactatatctcatttcagctcgttctttttttctaaaatctagaggaccaagtgctttgggtaaaggcaggagcacgaaaccaaaagtccagcacataaagcaggtggtctcaagatgcaagaaaccagaggggagtagaaaagatgagggttttggaggcaggattggggatctgctcgctgatgggggagatcatgggcagcactgcacactctggcacagtgctagggccaaagacatctcacattcacaccataggacaaatgtgcaaagcaaaagctaccactgtctcacactacgcaacagtagaagtgtaccacagtactgctcctctgcttgacatgttgtaaagatttttcatgtgcagtaaatccaacttgggaattgcactagtaaaatttttcattgtattgagttagtagtactgtttaaaatatattctacatttctaagttactacagttcagcaatggtcagtggaatgagttggtaactagatggaagccaacaataccattagttaatcatggaatcacactagaaatagagagagtgccatggtcaggtagattcaaagtgcaaagtccttaaacactaagaaaaggactacgcccatataatctccttttcctttttttttctaaaagaaaaaaagaagaagaagagagcacgcgtcaaacaaccaaccagcctatcacacgaaagagaaagcagggaacagtttgttacaacttagaacagaaatcagatgaacaatctacattatatactcaaccaaaatttcctccctaaaaagaaaaatcagttttccttttcattttttttacagtataagcaggaactgggaatcactgaattatgccatatcatacctcgcgaaattccaccggagttgcggccacagctgaattccgcagcagccatgccatgctcggtctccaaaaggctcaacaaacgcagaaaaaaaaagaaagaaaataaatccgacctttccggccacacggatcaagaaaccgcccgccgccgcgccgccgccgctcgcctctccggtgcggaaaccccttccagtcgccgccggcttaactagggcgagagccactcaacacagcgtcagaaccacccccaccaagaactgctccaagaaacaacgcccgccccgccgtggccgatccgccgcgcccggcattcccttccccggcccccgcgcgtcgaccctcccgcagcccgccggccggtcacctccctctcgctcgctgcgccgcctcctcccagtctctgtgcagcgcgtgcgcgggcgcgagtggacgaagtggcggacgtgtgcactgttcgcgcgggcggtgcgggtgcgcgaggcgagcgagcgagcgagttttcgctgcgcatttaagacaagtgaagcgtgtgtgcgcgtggtaacgattagcgttggggggtttggaggaagggagagctgtggcaaaatggcggatttgcccctagacgtggcgaggccagagaggatcagaatcgtctgcagtcgactgcactacgcctttgttattaatttatgagtttagagattatcggatccacatgttagcgataaaggtatggaacatcggatcttgcaattagctgcagaggatggtagagagtggagaggaagaggacctatatgttcgtaataaaggcacggtatatcgaactgtgcagtcagctgcagaggatggtggagagtggagagggaaaggaggaggcaaaggcgcaaagcaaccgtatcgcgcgaggaagatgacgacgctaggataggcttgggctgggttgctgacgctgacgtgcgggcccgggaataggtaggaggaggaacacgcctacctggactggaactgaaaggaaaagtctgatgaatcttcccccggtgtcatacgcatcttgtgtgtgtgtgtgtgatgctcgtggtggttgtacttgagcctggagatcattgattttcttaatgagtactccctccgttaaaaaaaaaaagacaaacccggtttccatgtccaacgtttgaccgtccgtcttatatttgaaaaaattatgaaaaaaattaaaaatacaagtcatgcataaaatattaataatgttttatcatctaacaacaataaaaatacgaattataaaaaaatttcatataagacgaaaagctaaagttagacacggaaacccagggtttgcttttttttttgactgagggagtacgtaacagtagtacagtacacataagaaatgcaaggagtgctggagtggtattattttgagggcttaatgacgttgttactgtttaggctatgtttggtacaatgaggctatgtacaatgaggctatgtttagttccacaaaagttggaagtttatgtgtgtagaaaagttttgatgtgatggaaaagttaaaaatttgaagaaaaaattgggaactaaactcggccaagttgggagctaatatctagcgcacgcaaaaaaaattaacacatactccctccatttcaaaatataaggcacaaccacccttagcttaaagaccaataaataattaatatcacatcattgtcatgaattatcccaactagtacagtacatgcaaccaatagaattaaagatcctgtgagtgtatgatttaaaataatactccctccatcccataatataagagattttgagtttttgcttgcactgtttgaccactcgtcttatttaaaaaatttgtgcaaatataaaaaa

SEQ ID NO: 22970 - DNA, 475 bp, Oryza sativa
cggcgatggcagttgagtttggcgtcgtgtccttcttgaaggcatcgtcgagtaaatccttggtagtccttagctttaccttgcattgatacctaagaatggtttttgggaagtcggagctgcagcgtcgagacgtttgatgagcttggcaacgacaactcgaagctatgcttggtttcagttgcggtttggctgttgtcctttgggaagtcggagctgctgcaggattgcaagctcgacaacgatgacttaagttggaccgcgtgaattgctttttgtttcagtgtagggtagcgagtttttgggtttgcaaggcttgtcagtctgtcctgggtgtgcacaattgactggtggtcatgaagtcagagttgcggcatcagcggggcgtaacgtgtgacaacaatgacatgagctcttttgagttgtgctttgggcttgggtcgggttgggtctgtgccctgacctgatgtttctt

SEQ ID NO: 22971 - DNA, 485 bp, Oryza sativa
attcctgcagccccctttatagtttaaatgatatacactctttttttttcagaaaaagtgtaaatatgaaaaaacttttgaatacgacatttgatcatttttcttttttcaaaaaaagtgtaaatatgaaaaaacattagcaatgattaaaatatttttaataataaagaaaggtcaaaaaataaataatacttacataatttatatttttgattaagatgaataatcgaatgttactttcaaaagcccataccgttgtttattgatggaggtagtacgatcttgcatattcttgatgtactagtttatgtaagatcaatgtgtgttttgattcttattctgtgatgaataattggcatctgtgattattggttttgatatttggagattattgtcgaagtggttttggagatgattgattttcaggtaatgaacagggttgctgttttgtcgggtccggtcaaaccgggcaggtgttgctggtc

SEQ ID NO: 22972 - DNA, 248 bp, Oryza sativa
ggccctcaacttgtcattgaattacaaaatcatcccccaaccgcaaaaccggatatccggtatcccttaactaatcaaaaccggtcacaataggtccctcggcggttttgactccggttttatccgacgtggcagctgactcagcgtgggacccacgtgggtcccacatgtcagggagaccacgtcaccaccctctctctttttcccctcttctctcccttcctctctctctttttccgatggttgcc

SEQ ID NO: 22973 - DNA, 675 bp, Oryza sativa
tatgaattacatatattgctggtttaatatgaatttcaaacatatggacgcacagtaggaaattacatatattgctggtttaatatgaatttcaaacatatggatgtacttttttaaaaaatataatcagcttaggagagaaaaagaaaaaattggagaggataagcagcagaaaatgaaggggcaatcagagtcgaactcccaacctatcggccacaagtttcattggctagagaagtttgatggttgtgccatgatgtgctgatacacaatgtgactattcagtggtcagtgaggccacgtccatggtaacaaattggagttgttacacgcacggacgaaaattaatggaaccgatcgctcatgtggataaagtggatgatggacggaattttttaaggaagccttgcatattttttaattaggtatagatgtgtttgaaacctcatatttaacatttccaatcagtatcgaagtaattgatattgtttttgaaatcccttttgccaactactcctaagagctagtacgaagttaaaagtggcctacaccattgtcaaagccataccctctatcctaggagtcatgagatatacggatacggtatatcctcaagtatacggaaagaatgtaagttaaaaaaatcggtaagttcttatggaaatactcttaaaa

SEQ ID NO: 22974 - DNA, 11894 bp, Oryza sativa
aagggccctcctaccatgatcctggagaaaattcggtgccaaatgggccagcaaaggtttggtcgaacccattcggccccctttttcacaagcagttactatcgatctcctaatgatggttgtgatagtttatagcgctccaaccgccatcaggaggatagatggcaagaagagagtgaagatgcccttagaattctatggatgatcacactcccaaggcacctccacctataaataccccctcacctccttcattccaacacacaccaagcatgagctgaattacaagaggctctattgtatcttttatgtacattagaattgggagagaataagggagaaagagttggagaaattctagagttgttggtactttcctctttacttttgtaccttgtcaattactcttctttaattcataatatctttattgagtaattgagatttactttgtgatgattatctcttagttagttcctattatcgagtaaatgaacctataaatagtgtttactttaatgtttcattggcattaaagtagtattaaatagtctagacgtggtgtctatactagagtacctgcatttgttgtgtatcccacagttcgttagagtagaggtagtggcagccctcgagatcactgtagtcctccctgtccgggtacggagtagagcgctgttaacagtgaaatttggtaaaccccgaagtcatcatcggcctagagtcagtatcggtttcagagtcctggaatcagctgatggaattatcaagtcgccaatagtcggattcttactatattcggttaagaaaattaatctactaatgaaagtttatctagaagacatcgagttcaaggaggatgcggcatgacagtttatgtattaattaggaatagtttgttagtttccttttatctttaggaaagtgtgtttagtgcccgataaggactttatgttttccttttatctttaggaaagattctttcttgtccaacaatgactagtatctacccatgggtataaatatgtacacccggggtcattctaaattatctcaacgatcaatacaactactcttggcgcatcgccaccgtctttaccgagggtgcatcggctttcgatcttcagctaaggggtaagtcttatgttccgtcagtcttggccatcgtattggctacattggcgtcgttcaaggctacatcagtacattcgacctcttggattgctctggttcagttgatatatttgcctatttatttatcatatatcttagttaatctagttgagcatcttaatttgatcatattggctgagatttgttttagggtttatgctggtatcgactaaatatcttgctagattagattaactaaggtatctaccactcttaaaatcagtcaagggcttgattgtctagatattacgtttcttttcatacttagtgctgcatcagttaagtttgatatactaaatcgtgtttcgaactataatctctagcctgctttttgattgcccataagggtttcatcggggtttcagccaatgagttatatggatgttggatcggtttacaaggattagatacatgttggttttagccgattgcaacaaaggtttcactgtttatctaatcttgttaatttaatgacatcggaccttgttggtatttcttaacgatattactagaaatataattcccagcaatggcgcagaaatactcctggtatatattggttacagagttcatccgcaagcgcacggatataccattgtagcgtttcacccgagagtatttcaaagatatcgtatttgtttaatcctgtgggaagattatagtagagagaaccgtactaataatttatatattacttgtaataaccatagtctaagcatgggttagtataattcatagggtagaatgacacacaagcataagactactcattctcacatttaatctatctaagctaagtgggaagaaaatagaaaagaatctattcctatacttctagtatgcatattatacatacatcttagctataagattaactagctaataccctctttccgatgccctcctggtacttcgagaagccatccctgattgtcgagttcctcactacaacccatcatgaccatacaaccggggcttaatacagaggagtaccctcctcaggaaattaacttaggactgtatacacgcacggaggaataaccgtactgagctgtcactatcagcggtccacctctcttctgcagcatataaccccaaataatgatacccaataatctagacaccacgcctaaactaccagatactactctaatatcatcgtcatgacatagagtaattgcataagcaaacactatacacgtaccattgcatctctcagataagctagcagtataatcaatataactcagatataaagtaaagttggcattgatatacttggaaagtatgtattacaatagcagaattgtataaaaaagaatattctaaataaagtacaagtcttacaaaagaagaaaggagagctactagagccatacccaaactcttccaaagacttccggactccggtttctattctattcctactacattatcttgagaatactaaattaagtttgagagaatatgagaaaactttgcttgaagtgtgtgttgaaatggagagagtgaggggtttatatagcctcccaatgacggatgtgacggttggaatggtcggaaataccctccaaccgtcattgggggctaatccacaccgtccagccgcaactctacatccaacggcgccaggatgggtttggccagacccttggttcggccgaaccatgggctgggccaaaccagcccaatttcgactggcggcctcccctcttgatatattttgtagacttgtgaattttggcccagttggtcgtgtcatttctaagttcttggcccatcgttccacaagtatgattctcgacatcgtccgattcattgatctcttgttttgatgtcgattctcctccattttatgttcattctctacaagaggttagtaatcctagtactagtggaatatttattattctaacacaaatatgcattgcaagcataactagttctcctttattttggtagtattgtggtcgaagctgattgctaacgaccgtcaacaaaacccccaagcttgaacctttgctcatcctgagtgaaggacaaaaggaaacaaagatttggttgttgatcaggagttgctactatgcagtatatctcaaatgtataggtgcaaggtatatgtactctctctcaaattaaataattctatggcacggtggcttacccttacccctgattcccacgagacactgtctcaccttgtcttgagtggttgaaagacaaaacagcaattagagcactaatcacccaatctttattcaacttttattccggaagtttttcaaaggattttgcaaaagaaatccaagttcctcaaatgattcactcggtctctccaagtgtatcaatattatttcctcactatttatgcctctttgattcctactctaaggttgatatgtggagctcggtagggatcaaacatggcatacttgtattcacatttattactaagtcaaaaactcaaacgaaaatagataactaaacatactcaagatcaagatcgtccaaagtgtgtgtgtgataaatggtggaaatgaaatgtgagaaataaagaaaacgcttctcctttgtgcttacttccttctcccaaaatccttttcttataaataaggagagggcatggctacattattttctcttttttttccaacgtcatgctcatgcttgaaagagcataactttattattttcataaccttgcctttccctccttcttttctttctctcttttttttcaaaaaggatttctttttaggagaagaaagcacataaaagcatggagaatttatttttggtggtagtatggaaatggaatggataattgctagcttctagtgtaggagtttagcatctgcatatatgtgggtgtatgatcttgatcatagagcatgagaagtatctacacaagtcacaaagatttgacaaaattcaatggaattgcaagtaaccaaaatgtatatggtttaatcaatatggaatatttttggctctggtaagaatttatatcaaatgaggaacttcataagtttatcattttgaaaaataaaacatccggaattcaagtcaaacttagacaaggactatagcaactcttatttactatctcatatcttgcaacaacttagactcagattagcaaatgcagctcatttaccttaggttcccagataattgttggctactcatatttaatttttgagagtacttacctatgaactcatatatgagaaatataaaacagagcaactatttatcatttcaacaaagagaaccaatttgtcttacctagcataataaaatttaacctatctttttggtattttctattttgcaaatttttatgttgttttcaggtttatagaatgcaattggaaaaacaaacatgcaatcggaaagggaaatatgcaatgtgatataagttaccttagtgggcggatagacatctccctccaagcttggctttcgctcagggttcttaataaggattgaatccctagaagcggaagtacgcttaaaggccatcatgctgttgctgcatgaggctgttcatgttggtgaactgagcatcagcattttgttgccattcttgcatttgcgctatgtgttcctcgaggttgtgttgggtctctcccgtctgcatatcaagggtatccattctcctggtgatttcacccaagtcccaacgagaggaactcgtgcgccattcaccgggagatggaggcataccacttgatctgggggactgattgttccagccttcccactgtatgtcatgaggcgcccgccaccggctctcactggcactttcccagctcgagatcccaatgttgtggtgtggagcttgggtgcatccccagttggctcccaacctgcctcatacatctgtacgggtgttgaggatgttgaacctttccgttcattccttgccatgttgcgtgtctccctgtatgttccacctacacgagattcttctatggtctgcaggggtatggttagttcatgatagttgtacaaatgataccccgcgttaggcaacggaatttcatttgtacaaccagggaaaaagtatatcaaagacccatctactccatgtttaaggatatgcccttgcactagataactctcatcaacacagggacgagcggttgaaatataagcaatttgatcattggtaataacccctagtccctttgctatgcgagtaatcagagaagtgcataacaggagcagtaaatcttatactttctaaccattgccttatcatacattttataggagcaattttaatcttcctaaccatggcaaacatgataatcagttcatcctctctaatatgtctaagatcacctataggaaacaaagtcatagcaatccatttgtgaataggcctaattgtaggattatggatatcattcatcctaatttcttgcaaattgaagcaccagaaatgtcttcccaaaatctgtttttctcaaacccggaaattccttcccgaagatcgattttataggaatcgtgaaaaccaagaagtgtacttaatcctttccatgaaagtgtgtattcattatggaaaaagcgaaaggaaattccatcttctatttctttcgaagtgcacagaaattgcaaagtaagcaaacgagaaccaggctcatctactacagtaaatctctgccatccaacagctttccaaatagcacgaaagttagtatccatacctatctttttagcagcgccggagagtatacccacgtgtgggcatactcccggtccttcagcatgtagtaggtttgtctttcccgatcaccgacaaggtcgaggtcggtgtcgctcaagagatgttgtggaatgtcagcatcctccatcgagacgtctacggatgaacgagcactagactcatcatgatgacttgatggagagccggatcccttcttgaacagactagacagttgcctcctcatcctgcacaaaggaacaagaacaaactaactcgacgggggttagaataacaaaagtttcacccgccggttagcttcatcaaagcaacttgtttatgcaactaaatgcttgaatttgagggaaactaacaaagcttgaatgaattttgagagcaaatcatggagagggagtgaaaatgagttgaaatgggggtggatttccttctcccggccggttggcttaaatagaatgcccacaacggtcataaccgacctgtgggacccactagccgttgcctcaaagaaagaggcacgcaaccgttggccttgctggaggccaaacccttggtgggcccaaccaaccccacattcggccgttggattccaacggtcagtgcggtcatggctcagcgaattttcgttgaaaattttattttggtttgctctggaaaattcatttgaagtaattttctcaaaattcaattctaaatgcaaattttggaattcacatatgcattgatgcaaaaatgcaaattgatggaaataaatatgtggatacataccaatttacctgttggcgaaggtcacgtcattttcggtccaacgtgcaagaccatacctcccttcagtttagttcgcggagtttccacccatctccggaggtgatggagcgggcgtcttttgctttaccttccacaccttctttggttttggtgcgggcgatggcttcctctgagctggcttctcttgtttcttggctgttctgtgggtttggcccgtatttgatccggaccatggaacattgttcggtcctcggctaaaactcaaatttttcttccttcccgttgatacggaaacggatgcttcctgttcctacatcaatgttggcatccgcggtgctaaggaatggactccccaaaatgagcggcgtctcctttttagtgtccatgtcgagcaccacgaagtcgaccgggataaagaaatcccgaatcttgatcggtacatcttccgctatcccagctaggtagcggaccgatgagtcggtcaactgcaggtgcatcggtgttggtgccaacaccatgaagttgagcttgtcgaagacgtctttgggcatgacgcttacacttgctcctaactcgtagaggacttggtcgaatttatgtgtcctaatcgagcagatgatcgtgggacaccccggatccttcttcttttccgggagcttgtggagtatgacattgttgcactgctctgtcagcttgaccacttcagttgttgggagcggccttttgttgttgagtatatccttgagataacgtgcgtatgttggcacttgcatggcatccaacaacggcacgttaatgtggatcttctgaatcactcaagaaaatgagcgaactactcatctactgccggtttcctgcttctctgagggaatggcagcagtcgtgtgtcacaatactcctggggcacggtcttttctggctgaacttcttcatcagtcgtgcttccagatggtgcttcttgggtgatactgctggtttctacagggttaggatatggcggatcacgagtggacttcttcatgggtttctgggcagtcattcccagagtggtccatgctgtcgcagacctcacacgtgacgtgtgagtccaaggccttgatggtgccttttggccttttctcgtgatcgtccaagagtttcatgaggaggtccagtttggcagcaagcatctccggctccttgacggtgtgcatgcctcgatgacaggtctgaagtcattcctcgctctagcccatattggagaccattttctctatcaagtcgacgcctcctcgaaccgtcttagagaaaaaggctcctccagctgccgcgttcaggtggtcgcgagacgtgggagtgagtccattatagaagttttgcaggatcagctagtcatccatcccatgatgaggacagacggccatgtattcctgaagtcgttcccacgcctcaggaatggactcgtcccttgtctgctggaaacttgaaattctcccacgaagggtgttggttttgcctatcgggaagaactttgacaggaatgccattgagcatttgtcccaggtgttgatcgtggcacggttggcataaaaccactgtttcgctttcccaaggaggaaaacggaaacagtcgcagcctgatggtgtcaggactgacccccttcattgtgtgcatgctgcagatctccaggaactgttgcagatgtgtgttggcatcctccttaggcttgccacagaacgggctagcctgcgccatcgtgataaggctggacttcagatcgaaattcacgtctgccatgttgatttgcgacccagtggccacattgtcagcagagggagcagcgaattcacagagggtcttgtcagccatagtcttgaaagttcgtggcactggtatggctggtttctgtgtcggaagagttttctgcggagcgacgactcgcgacttgacgctctgaaagaaagcctctggattttccttgaagtttttcggcaagttaaaaccaatcatgcactaccctgtttccacaataaaagtgaaaaaaaccaaggttagcctgcaaaggacaatgattatacagaggtaaatatagagtaatagtagtggtaatctcttttataaatcttcccggcaacggtgccagaaatgtttattggtatttcttaacgacattactagaaatataattcccagcaatggcgcagaaatactcctggtatattatggttacagagttcatccgcaagcacacggatataccattgtaccatttcacccgagagtattccaaggatatcgtatttgtttaatctcgtgggaagattatagtagagagaatcgtactaataatttatatattacttgtaataaccatagtctaagcaatggttagtacaattcatagggtagaatgaaagacaagcataagactactcattctcatatttaaactatctaagctaagtgggaagaaaatagaaaagaatctattcctatacttatagaatacatattatgcatacatctttgctataagattaactagctaataccctctttccgatgccctcctggtacttcgagaagccacccctgactgtccagttccttacgacagcccgtcatgaccatacaaccggggctaaatacggaggaataccctccccaggaaattaacttaggactatatacaagcgcggaggaatacccgtactgagctgtcaccatcagtggcccacctctcttccgcagcatataacacaaaataatgatacccaataatctagacaccacgcctaaactactagatactactctaatgtcatcgtcataacatagagtaattgcataagcaaacactatacccgtaccattgcatctcccaaataagctagcagtaaaatcaatataagtcagatataaagtaaagttggcgctcatatacttggaaagtattacaatactagaattgtataaagaagaatattctaaataaagtacaagtcttacaaaagaagaaaggagagctgctagagccatacccgaactcttccgaagacttctagactctgttttctattctattcctactccacaagcttgagaatactaaactaagcttgagagaatatgagagaactttgcttgaagtgtgtgttgaaatggagagagtgagaggtttatatagcctcccaatgatggttgtgacggttggaatggtcggaaataccctccaaccgtcattgggggctaatccacaccatccagctgcaaccttgcatccaatggcaccatgatgggttcggccgaaccataggctgggccaaaccagcccaatttcggttggcggcctcccctcttgatatattttgtagacttgtgaattttggccgagttggtcgtgtcatttctgagttcttggcccatctttccacaagtttgattctcgacatcgcccgattcattaatcgcttgttttgatgttgattctcctctattttatgttcattctctacaagaggttagtaatcctagtactagtggaacatttattgttctaacacaaatatgcattgaaagcataactagttctcctctattttggtagtattgacggtcaaaactgattgctaacgaccgtcaacagacctccagccgatgtatgctttaacctttggatccgtgcttattctatcgtatcattattagccgattggtttctattagattatattgttgttatattacattatcatcagccgattgactttatttacatcaagtgtcagattctgcatcaaacatatagccgacagctcaaaaccctatcgctatcggctagtattggcatcgactggaattattccatcgacttgtcagtcaatcggctcattgatctgctatttgtatatcttgtcagttgtaggatcaaactgactggcatgcctgcatctcatcaacctttggacctgcactagagctaagtagatctcccaggcagttgtgttcttcaacttagttcgcgccaacatagttttggcaccatctgccgagcgcggatttctcgtcaacaagcgtgttctggtagcaacgagcaaatcagtgcatgaagtattgcggtagaattaaattaagctttctgtagacactgtttctcactaggaaatctattagggttacggataaggcataccttctaccctacgatttaccaaatataccggattggcatacctcgtatcatacgatatgtttccgtatgcgataaggaaatatacaagatattatggaaaatatcctcacaggctagagattatcagagtcctactcggagaggatagggactattctctatcgtgcagggttcgttgtctttgagttctacttagagactaaggcaactcatggtataaaaggcacaccttcgaatgggctgaggatcatcgaatcatagcaccaacacacccatcatagtttacaaagccgaatgacttaagccgaagccaccggggtatctcgtcgaacaatctcgacaaggatctcgccggtaccatcggattcatccgttccctttgtattatgtggttttccatataaatctcatataaactggattagggctactacctcacgaggggcctgaaccagtataatccttgtctcttttctactttgattttgtatcgtgtagattctcgtaccaacgtaccccaatacccaattcatccggtctacgggtaccccccgtcgatagtggcgcgccaggtagggggctttggtgatcaaggttctgccgacatgacttcaagccgctccaacaactttgtctacatcggccccattgcaggagatccaacctcaattccgctaatgtggactcaactcggatccatcgactttccggtttactctgcgataccgatctcgtctggcccaatctctgtcgggaacaagaacgtcgtagctacgacttcgagaaatgacatgtcatcggtgcctccctccatccatacggaaaaaacagacaacgactatgacaacgtcaacctcaagcggccaatccccatcccctcatcgggaaccaggcgccgacaaggatgttctctcagaaatcatctgcctggtgtgttatccataaaacacccaagcactttctatcagactacccagtggcacaacatgtgaaggatgaactcagatcttataaagaacgaggaatccaacgaacttcaccgacaaata

SEQ ID NO: 22975 - DNA, 3846 bp, Oryza sativa
  unsure (1)..(3846): unsure at all n locations
tcaagctgcagagtttttctcaacgctaccaaatcttcctgccctcaactccagcaaccacgagttcaatctcggcgtgttgcaaaggaacaagacgcagacaaaaacccagatcgtttggtaggatttgtaggtttggatcctcacgaaccctcggtcctgcacggtcgggatgatcgagaatcaaactctccacgtgacatgaacatgatcaacgggagggcggcggtgaaccatctgctcgagcaaacgcggatcacacccgcactcctgcccaacatctgaacatcgttaactcgatcctaagagaaagccctttcgatacggtcttgcatcccaacggtgatcaatgggttcagcgactttgggagacaatggccaacctgaacagtgcttttgcgacagttgccaaaccaccagccccagacttgccgcatcaaggagatgatgtacatgacggagccgacaccgaagtcagtcaagaccatagcaatcacccaagtcgagatctaggtcgaaatccccgcaatgcttcacctcgtgtccctcgtcatcaaaccccaccgccacaaggtaatcacgatttacgcgatcacttagttgggcgtcagcgggaacaacgagttgacaacaatgctcaccaacgccatcctccgccgcgatgaaacaacgttgcgaatcaaggaggccaccctaacaagaaccaagaccgataggattgtcgaagtcatcatgatgatgaccgtcgagaacggcgagatcgggacgacaatggtcgaggtcaacgacgagataacgatgatcgacgatggcaggagtcgaattctccagcctcccgtcgatatcatcaacaaggacgccgatccaggtgcaacgctccatatccgagcggcccttcgtcatcatcatcttcatcgtcctcatcatcagctagaccacctagaagacagcatggacaccgaccgcgtatcgtaccgggaggaggatgcagagcattcacacccacagtacgagaagtacggtggcctgagaaattccgaccaggagcaatagagaagtatgatggaagcatagacctcaaggagttccttcatgtctattctacagttctctatgctgctggggcagacgacaacgcactggcaaattacttaccaactgcgttaaaaggatcagcccgatcatggctggttcatcttcctcctcgctcgatttcttcatgggaagacttgtggcagcagttcgtcgctaacttccagggaacgtacaaacgccatgcaatcgaggacgacctacttgccttaactcagaaccccggtgaatccttgagggactatatttggcgcttcaacgaatgccgaaatacgatcctcgaaatcatcgatgcttctgtgatacgtgcgttcaaatcaggcgtccgaggttgctacactacctaggagctggcgacatgatgaatcacctctgcacgcaagttattcgagatcgttgataggtgcgctcacacagatgatgccttaagacgaaaagataaagggaagacaggcgaggagaagaaaacaatgaacaaagaagcgccagagtctagcaaaaagagaagccgtaagagcgggaagcgcaaggcaacaaaagaggttctagaacatatacctaattaagatggacttcatcagctaattaaaagaaatataataaagtatacggcacctttgtctaatcctgatcttaattgttacttatcaatttaattagtagacctgcttcctcataacataaacaagatacagatcattcaagtcggcagctccacgtgcatagagccaacctgaattaattaacttattcttcttcttgaccacaatatcagcagcatcaaaatatgtttgctgacaccatggaaaaacaccagcagctagcccttttgatccctcgctcttgccatttttcatgactgaagtacaggaaccaacctaatattcattaaactgtcggttgtaatatttgtgtccctgcatgcgaatcagctataggtgaaatatttagggtagacatggtctcatcacacaaattgtacaaaataattgatgacacacagaattccaagccttcctattccaaaaggaaggaagaggttcccattgaagaaaacgtaccgactagcagggtacgaatttgtaacgtcccgcctcttctaggccgggcccttcctgaccggtcacccatccctaaattactccaagccaagcatgcttaactttagagttctttagaaatcggctttcgaaaaagaagttgcaacttgttatatgagtattctaataattctattaagccttagatcggaatgttacataattgccccttgataatacaacaaacatgtgactagaacaatgcctaagcctaacctataagtaaaggatactttaatttccagtacagctagagcaaaatatggacaccgttagcaaagcagcccccatccacaaaagattttcttaaagaaattatttccggactattaacacattcaaaactatgcaaaattagaatattcacatacctctctcagagagagagatagttaagaccagggttcacgattccgacgaaaaccgatcgaattccacgaaatttcgaggtttcgacgaggctgcagaagccggatttcgatgagtttcatccaaatttaaatttgaattgataaaaaagaaaaaaattaaataaaatcttataaatagtatgatattcatcaaacctattgggatataattttttttaataaattgatgtattccatatatttactaaaatttatagtaggaaagaaaagaataaagaattaaaaaaggaaaaaaaaattagtttacctctttttctagttaccaattgaaattttgatgatttcgctcagaatttcgccaaagccgaccggttttcgcgagcttaggtaaactcagggaatttgtattcaaaatttggtttatgaaatttgttcgaaatctaccggcattccaccgaatttcgcgaaaaccattgttccgccagagcccgaaacataaggccatctcggaatcgtaaaccctggttaagataaacgggataaatgggaacttaccgcgcagtggtggatggcatctgggtcaccaccggagtcgacagcgatgcgttccagctccaggactggcgccagtgtccacatcattatcccgtccaccttagcctcccgcgctgtagccttccacaagaacctttggttgcggcggccattgggagtgggaggaccgtgtgttgggactgaaccaaaacacctagaatgtgcaaagtacaattcactaaccggcaaacatatttcacacaatcaacccatcatcttgccatgaactttgaggatagtttcaactagcaaatcaacaatgcaataacaataaacacatacacacaagatatggtgatttacgtggaaaaacctcctcgatgtgaggagtaaaaaactacgggaccaacggtccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22976 - DNA, 734 bp, Oryza sativa
tcctgcagccctttcgtgaggagtgctgttgttgcactttgtaaacacagagagaagtaataaagtcgtcatctactttgagagatcttcaatttgtgtttgctcgggttcggcggtccaaccggtgagacaccaccggtcagaccgacggggtaacggcggttagaccaaagcgactacggcggttagaccgacagtttccaggcggttagaccggcgcatctacttcggtcagactgcgattcatcgatttgtgggtaacttttaattccgctaaaagttttggtttttgggtacaccaaccatttaccctctctggttggcttagttcttgctattcgatcctacatctctctcacaaaaaacaaactttgtccaattttctacctcttatcattgggatacaagctgcagattttcaagcaaataaggcttacatacaataatttaatttcaaagcaaatgtctgcctgcaaaaatcgtgtattttcgcaagccttgaagtgcaggcggagtggatggctgcctgaaaaaatcgttttggtccgcttgtaaaatttttttttttctagcagtgcatcaaatcctcctggatcaccttccccagagggctatcctgcaatctgcttggtccctgcaccgtgctcgcttgcggttgattttttatttttctcttcgctgctgctgctactgttcaaagtaagcgaagtggctggagaggtgacgaattctaa

SEQ ID NO: 22977 - DNA, 756 bp, Oryza sativa
catcgggatcaatcaaagcacttcaagggcattgccacggaaggattggagtccaggaaagggcatttgaatctattaattaggatatttttagagatattttcggtaagagtccgcctaagggactcgttcgtattttaaattgtaatagagatagagtcgtgtccagcaaggacatgttattacttcgggtataaatatggcccgacaccttgtaaacaagggacggcagttcaataatacttcggcgcattgccacccttttctttttttcattgattcgacgagtttttgctttcgagttgggctgcatcgagtttgatctccgacgaagaggtaaagcttgttatggccgtggtttgcattctcagaattagtgcttacatctctatgacactctaatcctgaccgtgtgaattgccgagttatcatatacgatgtacaatctagatcgatctcgtcatctaacctcatcggctagcttctatcatcgaaaacggccgatagatttagataacgacattgagttagattatacagtgtatctaccatcttgaatgagttttcatcgttttgtttagattttacgtttctcttcatacttaatgctgcaccggttaggttcgatctgttaagtaatgtcttgaaccgtattatctagctctttctatgaatactaatagagatagcatcggagtttcagccgatcttacctggtttatttgtcttgttcattatatggtccttgatcttcta

SEQ ID NO: 22978 - DNA, 22548 bp, Oryza sativa
ataaagttgtttgtacgttggcatttcttggaactcacacttatcgatgacattttttggttttggacgcttgtcaatggcatttcttggattatctctttatattaagatctgacttatttgaagtatatcaggctctctatcagactgctagttcatcctacttgttagattgattacgttttatatatttcatctgtattgatatcttagtataaggtagtatcagagtactagccgatacacgttaggtttgctctatcggctatgctgtgagtatacacaatctctactttgaagcacatttagatattaagtgatttatactgtctcggcataccgtcctatctatcccaatcacttggtccaaatgtatttcattggatagactgtgtattgctgacatctacagctgatcgagtatatctaataatatcaatgctttatcttccctcgccgatctaatgcaagttacatcggcttggctctgaacgatatgtcatcggcaatccagccgatcggctatcgttgatgggtttaactttgttcttctttgtttcttgttggttgcatgatcaaaccaattatcacactcagagcccgaaagcaatgtctttggacctgcactagagttaagcagatctctcaggccagtgcgtgttttctgtgtcaacaataatgaaataaaatatggtatctcaacctagtggtagggattattactaatcatttccactaatgttggagaaatatgtgtatgctgatatattaaggagaaaacacactcgtcatgcgagaaaatacacctccggacaatcaggacgtgtttacacggattggaggtcccatatgtcaatcaaaaccacttagaattagtccaaatcatagtacatcatgttgggggcccattaagcaacctcccaaccaaaggagaggccgggaggtgtgttcttgggttcggccaaaaccaccagttcggccgaacccatcctagcgccgttgatatctattttccacgtatatgctcttgatttattcccaatgacggttggagggcatttagtgtcgaaactagatttcggaaatactaaaagggtagcgaacaagttatgaaagtggatgggttatgagacgaaggatttatataggttcaggccttctcaatgagaggcaataccctactcctgtccagggaaaaaatccgccaattgtggtattgatctgacgatctgatgtgtggttatgccctcaagcagccccggacccatccttacataggtagaggagtcgggattacaagatagaaaccttgtcccttacagtctaggttctatagataccttacaattataaccgactaagactacgtgatatttccttgacatacaaattaacatagtacccgtctttacatattctattactatgagttacccccgataaccagtcgggtaacgtagctctatgggtatatggtacccataatctccagagtagctcctgagacctttatagatgacgagataatcttctcccgagtggtttagtagaaagacccgagttcttcaatcatctttgtcacagctcccgagtacttcaatcatctcgagctatgaagggctaaaaaataaaaattttggtgcatcgactagatgcacctaattaggtgtagcccccccgaccatgtgattagttgaacaaactaaacatatagtcaaggataaaaataaacaaccaaccaagcagtatggaatgattacaatcatcaaaatgacttaaacaaaacataaagcatatgcagctcagatccctaaagcaatatgatttagagtatatgccgactgtaggatcaaagaggccgactagagggggaggggtaaataggcggttttaaaacttctggctaaaactgagctttgtatgtggaatcgtaaatcaaaacggttttgcacaattcaaaacctaaaccaactagtctcaactatgtgcacaaagaagctaggctatgttgaggtttgcaagccctagggtgataatagtacaaataaactctagtatgtaaacttgctcaaagtaaatttgcacaaaacaaaagagacaagtgacaaaggatttttccacccgatgttcggaagcttgccaacttcctacgtcaccgttgaggcgagcccaacttcaccgttcaaaccacgaaaccaccgcaagcccccttcgttaaggggtgagcaaggtgggagccggtccacgaaggttgttcttcctccactccagagatggcgaacaccgagccactcataatcaataccgggcctcctccacaaccttcttggagaggtcaccgggcaactccaccaaaccatctaggaggtggcatcctccaagagtaacaattatgaaccgtgagttcctctcgacactcaaggctgttgttggcccgatctttcggtgagttgtgataactacgatttgggagaaacgttgatgatccgactacaaccgtacgagacgttgtgttgcgccttagcgatcaatacacctctccgtgggttgttgatcttgtcggtgcagatcaaccctattcctgcaagcaaatcgaagaaacaagcaagaacaagataaaagcaatctgatattgcaaataggaatttaatacaaatgataagttggggttccgaagaacaagcagacagatggtctagccgacacgcgcgctgcaagcaagtagcaatggctaaactttaatctatcaaaacccgagaaaccctgaaggggtaactagctatatataagggtgggaggacgacctaggggtgcctagggttgtgctccaccagcttggggcgcaccccacatgggccccacctgggccggggtcccaaatgaagttacaagcccacaggctcatgataggtgacgcagcaccttgtttcttcatctgtagatgacttggatggaatttgatgatgatgccagatccgttggaaagaggacttcgagagctttccatcaagtactcatgggccgaaaacggaggtcgtatgcagattcggcggccatttgaagtcagcagtgtagcaggtagccgaatctgattccagcacttggaggacttgatcttgatatcatcttgttcatccatgatgtgagcaatggttgtatccatagtagccatggtcacatcatcctccccttcttcacggaaaaccgtcctcggtttttccatatggtgctcaacgcgtggtcgatttaaaacaacctatttcatcaaatcaaaacaagacaaactcgagataattttgttagcaataacatttctctctagcttgcatgttttatccacatgtataggaggttctaaatctgaacatatgtaaactctacgcaccaaatatattcctctatcatcagattcgcaaaatatatgaaaaatagcactagttggacaaggcaaatcagacttagcaaataatttcttcttcaaattatcgagctcacaaaaatcatcaaactgaacatagcccaaaatatttaaagaagatagcaattcacattcctgtacatcattagcaatgtgaataacatgcttaaaatcggcacacaaagaaacactaaaaatagcatgttcattcactagttgtggtagggatataagtgaaacattatcacacaactcttctttatcacaaggaacagcaagtaaatcaacttgtgacaaaggcaaatcagaagtagtttccaccaaaatttgctttagattagcatggatagtggacaaatgtgactcatcagaagcacactcaccttgagtaataccagcaccatttaatttaccttttatgccctcttcagataatgtaggcgcatcagtcttctcttcttccttcgtgagtgatggagatgatatctcgagcatattgctcttctcctcatggtgaatgttctgagctccctgcaaagtgtcagtaataggaggcacaagcatagtttgtttctcccttgggttctttaaaatattgctctcaacactgcaagcaagcatgaacaagtggcctatatgattatatgtcacattaataagcccatctgaatatcagaattaagccctctaaaaaatctagtcattgtattctcattgctttcttttaaaccactataagtgatacaaattttaaagttatgaaagtactcccgcacggttttgtccccttgttttagatgttctaatttctcaaggagagtacgtttataatatgaaaacacaaaatttttcctcatcattgttttgcattcatcccaagtttcaagcttattgccaacggtgtaccaccaaaaagatgcagaaccggtacatttattattagcagccgtaatcatttgagcattagagaaatcatactcatcaaattgtttgtctactgctatctcccaattaacataagcggcggaatcatacttaccatcaaaaactggcaatttagattctacccttgcaagatcattatcatgtacctcatatgtgatgcgtgaagaagtcgctatatctcgttgatggtgaagaagtcgatgttgagcatgaccatctcgtattcccttgcgcaatcctgccatggttagtagcaaacaagaaacatacacaagaatatgcacgcttttatcaactactaggtagtggcagctgaaatatcacacacactcaagcttttcccaagctcttacaagttcttactaaagcaagcagaatggtgacgtacaccgacttaaccaagcaccccaatggaggttggatgtatcgatgccttcgcaaacacttgctgtacggctgcaatcagatctgtggagctctaggtaggcttaaatatgtagcaaagggatagcaaatgctcaaatcagagaatgcaaagttgaatgatcgttcaaagtcaagtaccgtgctggtcctaggctagaacgtactagagacgcgagtctagacacaaacgataccacaagatagcactagaaacaattcaagcacactctgatatatgaaagcaaactcaaggatacaactgatttttctcttttccttctttctttctttcttttcttttcgtttttttgtgcggcttttcttttcttcttttttttctacacctttctgccttttttatttctttttttttgatttttttaccaaaaacggactcaaggacctcactgtaaggttatagggactcaactgtaaatataaaaattacagggactcaaatgcaaaagtccatatccaaatttagaactatacaaaaatggaatgctgaatttatgccggttccgtttttccaaacggatcacgaaaccgacaccaacaaaaaattccccaaggtgtatgggctggcacggtgtagattaaccgtgagggagggagggaatcggactcagtctgtggtggtggtgggcggcaatggatggatacggcaccacggagttcggatttggtgagagataaagggaaactgatccaatctacaattttctttccaaacccaacaaataacaatctaatttaatctctcctttccatctaccacaccccttccatctaccacacgcgcaacagcaacaagcacggccgaatgcatacggcagaccctagatgcaactcagcaaccccaagaccgaccgacaaaaacttctgaaaactacaaaaatggaaccgtggcagtgagccgattccattttcgtaggtcccgacgacaacagagacacgatgacggtgacgacagtggtactaacgtgaccagaactcgaaactctaaacggactaaacgctaagaccagcaacacgactcaaagatgtaacgcaaaactcaacaaagcaaaaatcgaaatgaacaatgcaatggcacaatatggctaggtaaatgatgcaattttttttggctattttctggttatgggtagataaaaactcaccgagcaacgaaagctctgataccatctgataaaccctgagttcctctcgacactcaaggctgttgttggcccgatctttcggtgagttgtgataactacgatttgtgagaaacgttgacgatccgactacaaccgtacgagacgttgtgttgcgccttagcaatcgatacacctctccgtgggttgctgattttgccgatgcagatcaaccctaatgatagaggaatatatttggtgcatagagttttcatttgttcggatttagagaaacatgttattgctaatcacactacttcgagtttctctagttttgattggatgaaacaggttattttgaatggactatgtgaagaacaccaaatggaaaagccgaggacggttttccgtgaagaaggggaggatgatgtgaccatggttactacggatacatccgttgctcacatcatggatgaacaacaagatatcaagttcgagtcctccaagtgccagaatccaattcggccacctgctacactgctgacttcaaacggccgccgaatctgcatacgacctccgttttcggcccatgagtacttgatggaaagctctcggagtcctctttccaatggatccaacctcattgccaaattccatctcagtcggcagaaactgaagaaacaagttgctgtgacacctgtaatgggcctatgggcttgtaacttcgtctgggaccccggcccaagtgaggcccatgtggggtgcatcccaaccaggtggaggacgacctagaggacctcccacctccttaaatagctaggtagccctttagagtttcttgggttttgatagattaaagtttagccattgctacttgcttgcagcgcgcgtgtcagctagaccgtccgtctgcttgttcttcggaaccccaacttatcatttgtattaaattcctatttgcaatatcagattgcttttatcttattcttgcttgtttcttcgatttgcttgcaggaatagggttgatctgcaccggcaagatcaacaacccacggagaggtgtatcgatcgctaaggcgcaacacaacgtctcgtacggttgtagtcagatcgtcaatgtttctcccaaatcgtagttatcacaactcaccgaaagatcgggccaacaacagccttgagtgtcgagaggaactcagagttcatcaaacaagtataggatgcctaccaaagatgatcaagtgtaacactagatctaatgtttgtttgactatgcctttatgcaatgaattgttggcggtggtcttgacatcttaaataccaacctttttttttcagatgcaatacaagtttttgttgtttttttttgttctaaaagtttttgttgtttcacagcagaaactggacattttgatgatggtatacacaaatcaaaatttatggtgtgaccagtgacaattgctctttctctattcttgtcttcccgctccatactctatccaattctctatgaccagaaatgcgtagaattggtacctcaggctgatgcactttaaaaccatttgttttgatagtgagactgcgagtataaatcacatcgaagcgcggttgaaggggagcataaagaagtgaaacattgagctttaaattcttgcctgtagcaaccgttgactatgaacatttggtgttctttctaagaaatgataaaagtggacaaggccaaatggttgaagttcagtttgcacaatgaccagtaaaaaaattttaagaaattttcttgtgcaattaattaatcttgaatttatttttacatgttctcatctgaaaaacatggttgacttacgaatccatgtttcaggcgctacgcacattattgaaaataaactcttgaaatgcctaaacaattgagcataaaaagtccaatatttttacttttgttgttctctccacttctcatgtaaaaatgattatatatacatacatttgaggcacaaattttcatttataaatgataattgtgcttatccccgttgcaacgcacaggcactcaactagttaattattcttaaaaatacctaaaagcccgtaagctaatactctttggtcgtaattcaaggtgtctacttgaggattgcatgtatatcataatttaaattcattttaatttttttatcaagacatatcataatttaagttctcaaatttgtaattccaagttttaaaaaataaattaacaaacaaatgttaaacctagaaaaaaaagaccaccaaatgaaacaaaaacataacaaaatatactctcttgggattcaaacatagacaaagcgttctgtcttttataatagggttaattggatccatactattgtagatttgactattcagaaaaataccattataattcgtttatttgtagccgtgccactgaacttttacaaaattaattaaaaccgtgccactaccgtaacattttccatgtattcccttcattttccatcttcttcctcccttctcccgtcttcttccttcctggccgtggcggacagggtgtagttccaaagcaacgcggagatgacggtgagcttggtgctacaaagctggccggtgcagcacactagccgcggcacactagcccgaccggcatgctcaggagctcgccgctggagccgcatggcagcgcgcgtcggcaacagctccggtggcaacaggcaccacgcttgcttttgcgtcggcaacagctccagcaaggagtcccttgttccacctcctgtactagcctatggtggtgttcttttcttctgaaaatgaagatgacgatgaagatgtatcactggattcagcaaccatatgagcataatgatgcctgcctcaccaaggcttgctcgagttcgccgcggactgaggaggagaccgacgctgccagcgaggtggggacgcgcggatcggccgcgggaacgggagagccagcttgctggcgccggcggcagcggagtaggcaaggcgctggtgctagagcccgccagatggaggaggaagaggaggcgaggcggcggccggagctggcaggagtcatcgggagcaaacagctcaccgcggcggtcgggcaccacgccgagcagcttctccatgcagcaccccgcgatggcggcgaaggacccgccgcgcgcgccgccgcggcgacgacgccgccgactacgccgaagcgtgaagccgcgcggatgacgtggttgcgcttgcggctgctgctgctacaccacccacagcttcgtggcagagcccctgaagatggggctctgcgggcaggcacgccgccctaacgacaggaacggcgagcacagcgttgccgctgtggccaacgttgatgccgtcgtcggctgtgccgacgcgtgaagccacgcggacgctgtgctcgccgccgacgtagcagacgcactcaacttcgctgcgggaaaaagaagggagaagacagaagaaggaagaagacgaaaagggaagggaatggataaaaaatgtgatggcaatggtacggttttaattttgtaaaatatcaatggcatggtttcaaacaaacgaattgtaatagtatttttctaaacgcgcaaatttgcaataccatggatcgaattaaccctttataatacgcgcagatcctagataacgtggcaaaccgttgccaccttaaacagggcatcagcacaatgcatgtggcaaactctaccgttgccaccttaattttttcaattagtatttgccagtctattcttaaaaacaagttttccaaaagggtcaatttatcaatttttggtagaaaataggacactctacatttgtagtgtaattatatttgaaaggttttaggagaactttttctgtcaaaactcaaaagtagtcccttctatttgtttggaccagtcacaccccattaggccattaaaccacgcctaccgaaaaccagatacaaattctgctcaaaaggtctcagctttcaagccttagccagttttttattcttttgcccttcttttatttttttaaaacgaagtcatcttcattattcattcgagataaactttttttttctcctgaggaaactactatccgacggtactacaatttgttacaatagaaaattggtaaatcttagtagtcgcctaattttggtgcgcatctgagtttacagatcggtgttacataaccacgtataacaccaacagaggatcatctcatgttgccctctcttaggacatcaatcatatcatataatttcttgttggcaccagattgtatctgcagtaacagtagcaggacagttaacttatttgccactagcacgcctaagaacagagaaatttatatgtcacattccatgaacagtaactggattctgacctttttatggagaaacagggcagcatccacagttccctctgcgtaaattgaacggccacatacattgtgttgaaactcaaatgaaactctgcataaataaggggtatcacctcagtacgttgtgcttgtcaaggctctcaatagaatccagcagacctaggaaaaggtttacttacgtctcatccggtgaagtgagatggtacatgtgaaatgcgtgaccagaaagatgttcttctgggacaccaaccaatgtaagctgttcctgaggatcccggacctgcttaacctacaagaaagacatgtagaccagtgtgagagtttgtgaagaacatctcaaggaggttttggttatgctccaacaaaactacaatgcaagaagctgcttcaacaaaactagatatcagccttaagaccattagcctaataaaagtgtgttcgctgctgatggatgggaacatatcaccccagcacggaaaacggagcagtccattagcgcatgattaattaagtattagctatttttttttcaaaaatagatcaatatgatttttttaagcaactttcttatagaaactttttacaaaaaaaacgcaccgtttagcagtttgaaaagcgtgcacgcggaattcaagggagaggggttgggaacccttgggtccgaacacaccctaagacatattagatccaaacaaaaagcgagattttacagtacatcaagcaccaaccctaaaaggtactgacaggttgtccaacactgaatttgcagtgtgcagcatgttactctgagagacagacattgggacaagtaaactagtactactaattaaatctaagtatctagtatagctcattcttgaaatggaacagaagatgcatgcttagtttcttacataatcgtaaactgatttttacataagagaaagcaaatggcaatcctctaaaactaacaataatctgcgaaagacagatatgacaatgtttcataaaaaacaaattcaacataacgattttctgaccatgtaagcttccagttaacatttacctcgttcaagttaaatgacacacccaacttctgaaagcaagagataacagctttggccgtgccagaaatgtccaattttgtagcttgatgagactccatgacctgccaattttgttatttcaaagaagagtcatgggccactgcaaaatatgaaactaaagtatatgatgtacattcagttataacaatagatggattccaatggagacaaataagataaacctactcacaactggatgtgattccaagagccaaaccagaatgaataccacacagtggagataaataagataaacttactgcctgagttatccttatcgactaaacaaatgaatgcatcctgctggacatttatactaaaatactaactgtactttctagtatgtaaagggtgaaaactctaaatggtttaataagctctaggtctgcgtctgacaagtaataactgtggacccccgactctaaatatgtcaagtactaaatgtgttcctgcgcctataactacatctccctaagtagtaaatgtgttccctgaaactgtaaatgcgcaggggcctggtagcaccgttgacactgaatagtagatatgtattttttatagatcatttagctagtcactatagagttgtcaatccaaatcttctgtgaagtttcaatttgcaagaatctgtgcttcaaagtgaagttccatagagcttaacatctaaatagagtgttgacttgtcaagaggaggcacttttcaagtgtaagtcgtatgtgaggctgattccaaatagcttatgagtctaaccatctcagtcataaattttgcaaagactaaacccctgaaaagttaactttcatgtggcatgtacagttgtacaagcacaggcttacaattctagctccaccactgtggtttaggactgaagcacaaatgcagatagaagataggcatactcagggtgttaacggtagttaattcaaatgattagaacattaatgcatcatacatcataatggttaccaattaacagaaatatcgctgatctttcttccattttcctacgatatagctaatttctgcagttcctaatgtagcatgtaagttccacatggatactgttccagtggtttggttcataagttctctaccacttactagttactccactcacttaaaacttccataccaactgaaattgctgagctaaataccatcatgattctttaataaacttcctaacatcaagttaatatgataaagttttctgtttgcacattattgcaagcaaattactgagcccataatgaatacaagtacacaactcatatcaatcaactgaagcaccaaatttgatgttgaatgaagaacaaagagacagttataatgcttgcaaggaaaaatcaaactatacctctagtttgtaacctgaaaatgcaccggggaattgctctgccatgatttccatggcagcaagaaacgcgacaacctaattggaaggaaaaataggagtaagcagtattaataaggagaagatcattagcttgaccatgcaatggaaatagttatacctgcttccccatctgtggggatatcacagcatacacgtttgcgtcctcaactgttttgtgcaacagttgcctatttccacctgttgtgcccataacaaatggcaatccaagtttacagtaaagctcagcattagctgcacatcaaaaacaccataaatgtcagattagcagcaataatagtgagcaaataatatgaaaataaggaacataaagcatatcagagagtttaatttaattaactaactaataaataaaagttaaaaggctgacataagatgaagagcagtagcggctatcctgccaaacctacttccgatagaatatcaactaaggaagattggattctgtagttaaatattcctgtttctttttgtacagttgcaaacagaacaacagacaaccatacatacataagctaacgggatcattataatcgaacatacaacttaatgattacaacttgctcttctatccattcatcaaaatatacgataattttcaactaggttcagttgtatgcactatgtagaagaagctcgagctgaacatgagatagggatttgtctgatataaacaaccggcagtttttgctgatgcaattacggaatgcttacttttggtagagtttagcatataaggagatcaagcaacagaaaatatttatatgctcaccattaacagcatcaggaacagtgtagtcaacaactatcatatctgggtaatccttagcaatcgaagggagaatactttctccttcagatgggtcacgaatataaatttccctatcacaaatttcaacctttccatcaggaacctcaatagcactgaatgatacaggaactaactgaagaccagcagatacagctgcttcagcaacagccttccccattttcccagtacaactattcacctaaacaggtaaatattggtataataagtgaaatctgagataataaaataatggatctacaggaatgtaaatcatagaagcagttaagcggtgctttaatgaaaattttggaagtaattactaatcttagtaacttcaaactcaagcatcacagtatgatgtggagatgttgcaaggagaaaaattcagtacgtctggatcttaaatttacagaacactcaaacaaagtaaaaaaaaaaaaaaaaaaacaggtcagctcaacacgatatatgattgttgacgtgaaaactaatgaaaaggtaaaacagcagctaccagctttttaatatcgtgtgctaatcatagtaactgaaactaaacaagcaatcgaacctgtcggacttccatttcatggtgctacgcacccatttctatatatgaaattgctttataggatattgtctggaaactgaagtactgaatacaacatattaagtgactcaggcagctaaaaggcaagtttgattgagtttttttcaatgctcttttcaaaagcatattttagaagggaggaactgtgaactctatcttcagtaaagtagtacagcggttagattttccaaactctatatttttgttgtagtataatctcaaactgaacatcttttttatgtgcctaattgagttggtcaaacatcccaaattccattccactaccttcttgtcgagcagaaagcaactaactatcagtacatcctccagctgcaggaaaccaaccatgtgcaagaaatgggataggaagaagatgaacgatctttggcacagctgactcgagccagcctgtcccgattggcaaccccttgcactgaacccgcatcaagaattgagaggaagaaaatgaacaggagagatggaaggagaccaaggaagaagatgagggtaatttgttctaaaaattttagtaaacgcatcaaaagggtatgtagtggtatatttccaatacctaaaaaattataaaggcatggctctaaatagttgaatagtagtggcatatatcaaaactgatgaatttataatggcatggattcaattaaccctaatattattgccaacactaattcataatggctgaattaaggaacagaacaggaaaaaaaaagtaaatagatccctttattgtgttgataatcattttgcagccatttctcctttcctacatttcccagtttcggatggaagataatcataattaaagtaaacactaacaagtactccttaggcaatgccaaaggtacgagttaatggccttggcctgtttggttggcagccaaaggttgcaatgccaaaccttaggcacgctgcatgacacaatttgttagcctagtgcttagttggtcggtataattgtggattgccaaacttcgttagtttttatcaaattgcattttgtgtggcaatgcaacacatctggcaaagtgaggtgtgtggacaccaagcaaaccggccctaattcctaaatccacaacaagggcagagccaaaccaagcaaccttaccagtatcgggaacgagtgcttgggaggcgccgcaggggcactctcgaggctctggctagcgagggcgttcgtgatcgaaagcctcgccattggaaaccgccgcctcagcgtcaccgtgacgatttgggaacagaacggcaggcgccagcggatcggacctcgtcgcctggcggctgcagcggcagcagggtgcgtggcaaaggtggaggcgagcatttgggtaggtttctgggatattggtagccggaggagaggacgtagagcggcggcgaaggaggaggaggaaggtgagccctgcccgagtctagggttttgggcgatttggcgttttctttttcttccttgaacggcccattcaaaacccggcccgaggttaaaaaattcccgaaggcccaaagtctatattttgatttaaacccctaatggtggtgtttgaatctcctggagatgaagattaagtatttcacgcaaaacgatgtgataataacgtgtgattaattgagttttaattattataaacttgaaaaatgtattaatctgatattttagaacaactttcatatagaaagtttttgcacggaacacactgtttagcagtttgaatagcgtgccatgagtatccaaattttaatccactcctttaagaagaaacgaatgggacctatttctgcttattaggatagtaatcttttggaatatgatattatttaactagaaaaggactgtgcgttgcaacggaaaacctaatcgtttaggttcatggcgccttgcatgtgtagtattttgacattatggatcatgatgttgacccacatggcaagctatcgtgtagcgcttgcttcacttgattgcaaaaatctcttcgaactaataaatggtgggtcattgaactgaatatgatttgtcgcgtgaggagaaatatgacagcagttcaaaattcttaatgatagcattagtctggagataacaaggatccacctaggcactgaaaaagccaagccgccagatctgcattcaaattcaatcaggattgcattgtagtcaatcataaatctaatttgatcatacatgtttaaaaagtaatatatgtatatacctttcaaaaattgcattagaattttcatcaaattggaagaatgggtttcctcaacttggtgaacctcgacaaaggaataatataatcaaatggaaatttagcctaatttaattcagctttaccaatttacacgcagataccacacgagtaggccaatggcagacaggattttcatgatgtgtattcaagatttacaccatgacatttagaagaactattctttgtgttatcaataaaaaaaatgctagtttttttaataataaaaagatgataatgtgtagaaaaacatagtagaaaattatatatatattgccgttttaacatgaatttcaccgtgacatttgaaagatattccttatgttatcaataaaaaaaatgcaaagttggtgataaaatgtagaaaaacacagtagaaaattacatatattactggtggtttaataataaggggcaattgtgttcctgcccttactttctagttcaattatgattttatccctactttttagggtttgtgattttgcccctacttttttaaatgaagcaaccgtctacccttggttttgacggtagttaggtgggccccaagtttctgaatcaaatgagggaaaaaacgatattgtaatttgtgaattaccatcatgcccctgatttcactaaatcagtctaccacgtgtgaatcggcatttccccaatcgaaaaacctagatcgaaggcggcgcacgcgaggaagcggcggcagagacgcgcagggaggcgcggcgtcgcacgcgagcaagcggcggcagcctcacgggccagcgcgcaggaggctaggcggtgcggcggcctcgtgggcctagctcgcaatgcggcgggccagcgcgcagggaggcacggcggcctcgcgatccggcgcgcagggacagaggcggcggccggcggcgggagcagcaggcgcaaaggcggcggatgggctcgcgcgcggcccgacggcatgcccgcacgacagcaactgtgttggcaacaacattttgccattgggtgcatctgccgtagaggaaggcgccgagtgcatcgcctcatgcgccgcctccttgatggttcattttgttgattgaattaactggcaagcagctgggataaatcattgagggctctgctatatgtgtggatttgggattttttttttttttggctctggttctcctttccttttcctttttcatgaaaagttgggtaataaattgatttgtttggaaaattggtcgccttcttctttctttttcccttcgtgatgtatatatgtgcaacttatatgttcctgaaaaactggcaataaattgatttgtgtggaggtgccatacaatctcaaagttaaatcttttagtatgcatgccagatccatcgccgcatgcatgacacaacggggcaaaaacactgcatcctcacaaagaatgcaaagggcacacctgtccttctaccactaaattaacaccattaaggggacttgacagagtaggggcaaactgaagcttcggtttgaaaaaacaggagcaaaattacaaaccttgtaaaatcataattgcaactcgaaatagggacaagaacacaattacccctaataataataggaggtaataaagtgtagaaaaacacattaagaaattacatatattgctggtttaatatgaattttcaaacatatgaatgcacttttaaaaaatataatcagcttaggagagaaagaaaaaattggtgaggataagcagcatctacccagttcaacaaatggttttactcattcatcgtgtgacatatccaacaatacaaaatcatttgttgagttgtatccgacgtcacatagcccgccgcgctccctccctctcttcgatctcattcccctgaaatcacgcaaaatcacgcctaactccacaaatgacgccgctgtcgccaccactcagattcggtgcaccaccttgcccgtgagcccatccacacatcggcgccccctcaaccctagcgtcattgttccccttgggctagcggaggcagtggctggttatagctttataggactgttgatgtgaaaaacacacactggcctgagagatttgctttactctagtgcaggtccaaagaattgcttctgatttctaagcgtgccagttggtttgcaaccaacaagaaataaaagagaaacaagaaaacaaagttaaatccgtaaacgatagccgatgacatatcgttcaatattaagccgatgttatttgcattagataggcaatgaagagtaaagcagggtaaagttaaatctactcgatcgggtgtagatattaatgatatataatctatttctaaaaatatgtttaaaccaagtgattgggatagatcggacagtttgccgagacagtataaatcacttatgtttaaaagtactttgagatagagattatatatattcatagcatagccgattaagtaaatctaagatgtatcggctaatactccgataccactctatcttaagatgttaaaacaaacgaaatacactaaatatcaagcttaatatattttaatgcaataagatcttaatataaagggcagatttagcatatcgagtaatcatataaggaacaagatgactaaaccaggtaagatcggctgaaaccccaattctatctctatcgataatcatagaacaagctaaatattatgattctagatattacttagtagatcgaacctaaccgatgcagcataagcataaagagaaacataagatctgaacaagatgatgaaaacctctttgagatggtagatacactatataacctagatcaacgttgatatctaaccttatcgactgccttctgatgatagatgttagccgatttagggttagatagcaatattgatagagattatatagcatatgtgataactcgacgatttacataaacaagattacagtatcataagatgtatgcactaatcccgagaacgtaagctgccatgacaagttttacctcttgctggagatcgaacccgatgcagcccaactcgaaagcaagaactcatcgaaaacaatgaaagtagaaaaggtggcgatccgccgaaagtgttattgaactgtcgttaaattgtttacaaggtcttgggtcatatttatacctaaaatacataatatgtccttgccggacacgactctatctctattataacttaaaatacaaataagtcccttaggtggactcttgccaaacatatctctaagaaaactaccagaatatcctaattaatagatacaattgccttcttagaactcaatccatacgtggcaatacttgtgcagcacatcaatcgatcccgtagatgattctagaaccaccttactaagatcggctacatcggctgttcttcatccgatccaatgtcagccgatgcagacattagccgatgctcctgtagccgatatgcactccgtttctaggaaacgatctctcaccaaatccgcttcgactttagcttcgaatctgatgtataatttaccgaatttggtcgtcaacaaggaccaaggaccaaggtccaaggatgcagcagcggcatatgtaggatggattttgtctggtcaggcgggcggccgtgaagtggcgagactcgagagaaggatgcggcggtcgaaagggaggctccagttagcggtgacacgatccaggcaacaaggtaaccttgcctcgaccgagtccacacccctccgcgcgccggtcgcaatccgtcatgatcaggttgtccccggtgtcctctctctcctacatcatctccgtctcccctccctctcatgcaaccatggtggtggggagttcttcaagcgcggcagcccacaagcactatatgattcaccatatcatcttgtccaagattcatgcttcatgcaggacacggagggagtggaggaagaggtcagaggaggtagtctgttcggcacgaaaatctcaggaagtgcgggcacggagcatggtccctggcgaatccaagtctctttgaggccttaagcagtaacgaaatccatgtactgctataattgcaactattgtttctatattgcagtgtgcaacgcagtgctgtttgtgtatgcacataacaagaatgaaattaaggttggatacaaacaaagtgtggaacctctttcgttctaagctggcatctgctgaaggaaattgtggcctccttttttctgattccttttctattttgtgctctttttttcatgtaggggagcagctctggtgcgacagggaagttggcagcacatacgcatttcattgagcacatcttgagcgttctagatttcttgaatgttttatattgtgatcagaccaataaggtattcaactggcatacagttttctcatttgggctcaagtgattggattggtttcttgtatcttgcaatttgttgtgttaaaaaaatattatagttttattgctaaaagcaatctatcttttctgtcatccagatgaaaacagttacttgtggtatctgtaggcataattatggaagaactggattagcatggataataaatggactacattaattggcgatggtttttggtttagttgagttttctatgcacggtatcttctggtaactatgattgaccttttacattttaaattaagtgaaatgaatcattagggctgctatggacacttgagtacatttgaatgaactagcaaaaagcctgtgctttgaaagttgctgctatggacatccagtgtttattcactcaaatcttgcggacacacgagagtccaatttttcatatatttatttttcttttttttctcgatgtacaaaaattacaattttaataagtaatggggattgaatttgtgtaacccaagaattctccgaaatggcacactgcttgatgagatccacattgtctgaaacttgttttgcgtgatactcagtatgctaatatgaatactaggttttgatagtgtcttggcttaactatttgtttgggtaaatctaaaaccactaaaatatagtaattttgctttgttgatccgtctagggaaataaatgagataggacattacaatgatgccagatacgtatcattgccagaggctatgtataggattcttggtttcccacagttcgatatttattcagctattttgcagctccaatttcatcttcctaacatacattatgtcacgtatgataaggatggtaaaatcgaggatgtttgcaatcgttcatcttcttatatggcattaaacaatctcgatgatggtttaaatttaaatttgttggatgggtagtatgaactgtctatatgccctatccttttgttacatattggaaaaaaaagctatgtgtagagatcagatggacttttcctgtgcgaaactctggattacgattcatgtcaggcatgttttttcaaggataatatcacacatctcttttattttttgccttgtgtttgataaatagtttattttagtatttgtttgtattcatattaaaatggatattccattttaatttcttttatgtatgactcttctaaccaataaatttatttgtctaatgcaaggtagctaactattcaaatttcttagtaccttgtcgggttgtatgatacatctctttatgcgtgtcttgaaaattactttatattatttttatttattttataaataaatgcatttgtaggatattgatgagctaaggcaacaatttttgctacatctactaatgtaccaacaaaatgagtgcaaaagcaacatttctagcgatacatgagaatttcttaaatgtatcctaaatgctaaacattagggtagttatttatctatagggtatattctgtatatgtatcaaatgctttatttttgtacttgtttatacccgtaactaattaatggaatagctctatacttttaacatttttttagaactttaacatatttttaaacgtatatctccctcgtatattgtatattgaagtgattatatgttactaattcttgtcaagatttattctgcccacacaatatcatattattgtaatttgcatgaaatatatttgatata

SEQ ID NO: 22979 - DNA, 1063 bp, Oryza sativa
attcctgcagcccttcagaattttctctgatgaagtccgatccaccaactgctcagtgctgttctcctcgccgacaacctggtgaagctagcgggggtccaaaaatctagccgactgctcaatccagcagccaaaagccaaccgagcaaccaggacccaggaagaggaaaatggtcctgagtgatgatgaggacgatgatattgagaagaccggcaacaaggagacagctgggaagcggccaagacaagctaacccatcgaagaagaaaacatccagccgggcagtacccacgatcagaaagtcatcaaggtatgaatccgttgtgatttctccttcattcttcaaaatgatgtcaatagcatttttgcaacttataggaaatcatccgacatcgatccatttggaaaaaatcctgaaccgactaacaaggaggctgtttcttctgctgctagtgaggccgaaccgactacaaaagaccgtatgactggcgatcagtcggcaactggcaatgtagaagctgataaggagccccgactggaaaccagtcagcgaatgctgaagcccgcgctaaccaggagcctccgactagaaaccagccgagtggtgagcaaaacgaagatatccctgagtcggaggggcaagccagtagttctcccttaaatgatactaacgctgatccggaagttggtgcttttgataaggtagaaggacccgctcgaccaccaccgaaaataataacaggtaacaatcctctaagtaaacttgtatttagaaaaatcttccccaattgcttgacttctcttgtgcctgtataaaggtccgacgattggcgatgaagaagaaattcttcgaatccaatcggctgaagactcccgaccacctatcctagtcaagtggtggaatgacgagatgcagccacatggcattgtaataaacaagcagaaagaagacgagaaggtgtcattgttaaccaggacacttaatcaggccactcgtcttgtgaatgtaagtactctatccgtagtcctttatatcaaattgatagacttaatgaaatgaccg

SEQ ID NO: 22980 - DNA, 11833 bp, Oryza sativa
ccctttgcaccctaacgctgatataattattccacgcagatcgcaagattaaatctcatgctcagtttgaagtcttggtcaacaagattaaaaaacttgaaggggctagaagcgaagtcgccaatgctgctactccactgatttaagccatgttctacaataacaacggtccgagcacaatcgatgatgttgaaatttttgataaattgagagctgctccggacatgtacttcaagaatattaaagaggctagaagcatgggagcaagcatggctctagcgatgactaagtccttgtatccgaagatcgacattgatgccgttgatggctttgcagacggaacaagtgaagaagatgcccttgatcttatcgatgatgcctagaaagccgccgacaagatcgctactgatgttgttgagagatttcaagataacaatcttggtccgactgggtctcatgaatccgatgatgaaaaaactgagtctgactgatttcaaatgatgtaatctttgacgatggagcctcaatttgtacaatactgatgtatttatgctgtgcttgataaattaaacttagcttttgatttcttaaaagtttttgtcaaaccttattgagcctagaacccgctaaagttgttagaaaactctcagtcctgattaactaagccaaaaaatcagacaaggcaatgataaatcgagtaagcaaattgaattgataaaaatcacactctattattattatgatagcccccgactagtaacttcaagaaatagcttgatgttggcagtcaaggaggagaaagtatatacaaataattcttaagcataaaaacgacgaaggtgctcgatattccacgaattgtcgacgttagaaccatcttcacgcttgagtcgataagatcccagccgagtaacttcagagattataaacggtccttcccaaaaagaggataatttgtgccgatctcgtgtagattgaatcttcctcaagaccatgtctccaaccaaaaatgcgcgtgatcgaacattgcgattgtggtaacatcgcaatccttgtaaataccgagccgactggatcagggctgcctcgcgagcttcctctagtcagttaagatcatccactcggtcttctccgtagcgctcctctttgaaattgcgaaaccttagggactcaaattccaccttgctcggcaacattgcttctgcaccataaactaaaaagaatggtgattgcctgttgacggtccttaaatcataatatctgaccgtcaatacctgcatataatgaaataaaacatggtatccaacttagtggtaggtattattactaatcatttccactagtgttggtgaaatatgtttatgcaggtaatttaaggagaaaacacatccgtcatgtgacaaaatgcacatccgcgcaattcaggacgcgtttacatggattagagtcccaataagtcaataaaaaccatttagaattgggccaaaacatagcccaggttgttgggggcccaataagcaacctcccggccgaaggagaggccgggaggagagattttgggttcggccgaacccaccagttcggccgaataaatcctggcgcttcctgccatctgctttcacctggacggctcgaatttctccccgaaggtggttgcagggtgttttggtcatttcccatacccctaaccgtcatttggagcctatataaggagatcaccttctcatttccaagacaaacaactttgagctgaattacaagaggctctattatatatttttgtacactagaataaggtagagagtgaggagaagctctggaggagtgcccggaagtttggcgctcattcgacttctacctcaacgagtgtagctttctatgaggaattttggaggagtaccggagctgtaggtacacactactccgggttcggagaaccttcttctataaagtaagcattcgtgttcctttcttatgttatttaattacttagtctgagtaagatatatttccatctttgcgggttcattgtctagtattcgtactaagtgctatagtactaggactctgcataaaaaggaaagttcctgtacaagtattagagtagtaattaataacttagacgtggtgtctaggttagagattacctgatgcggacatcactacctcggatgtacacaacaatcctccaacggtcattcaaggaccgataacaggagctcgtgcgcgacaattgaatttagagttgagctcgttcctatgttcttctttgtatgtattcgagaatagattgctacctaataattatattgggattaggaacaatggaggggacaaggagacacttggagaaggacttagagccatggaggatcatcgaggacgtccaagtcaaggtggaggcccaaaccaagtcgatctcgggtgcaattcgaagtccaggatcagtctgcactaaaacgggcacggcccaggtcgtatatgtgctcggattggggcgttctttatatggatggaaagctaagaagataacatttccaatggttttggtcccacgtccaaattctttccgagtcaatgggaatcgaccgaacaagttgacgtccagaatctgtcccggtgctgcgtcaccatatttgggcctttgggccgtgtatcgtgttggaacccattagggttgtgtcgagagggggttgcacgaccctaaactatatatatcagtacccgccgtcatctttaggtttttgggttttgcttagattattctgtcaagaacagtttcgctgctagatcggtttgtggaaccctaaattcgagtgcttaatccttcatatgcaatttggttgcaatctatcttgttcttgcttgtgttcttcgattcgcatgcagggattagccttctcggcgaggtcaaccgggtttcggcacggctgataaccagaggagacgtggtgctccgattgtggggctcaagagcgtgcgcgttcaagaagccggatcgatttgtgtcgtgactctttgtgtcgtgactccgcccaaatcgttgtttatcataacctttcggaagatcgggaaccctagtgcacatcattacctttgtttgttatgtatcccacggatttgtcagaggcaggcggcaggtggtgacagccctgaatcccgtccgagtaatcctccacgtttggatacatcatagagctatagcagaaaccacgctagcagaccagcaggggtcggtgcccgaagcaacagatatgaaattaccttgcttagcatagaaaattaaaacacatacatatagttgttgtccttggatcgtcttagccttaggtagattacacacgttccctgagtacgatatccttttggggtcacccgaaggtgaagtgctacaacggtattccatgcgcttgcggatttatctgtggtcgtaagaaataccaacaagcatttctggcgccgttgccggggaacggttgctaatttatccgagtctaggtcatcctcgtatctttattcttatttcttcttcttttattccttcccttgatgaagcaacccacaattcaaaatctttctgctcctcgggctgatctttgtgagccgtcctgttcttcaaaaccaatcctttccgatggctacgaaatcggtcctagctttatagccattgttcgagagcaaaccttctatggtggtattggtgaaaatccatacgtccatctttgggactttgagctagtgtgttcatgtttatcgatcgtaggcatgacacatgaggctctaaagtggaagttgtttcttttttctcttagagatgaagcgaagcaatggcacactctgtctgtcaagaaattccacggtgaatgggaagtgcttaagtgcaaattctgccttgctttctttccattaacccgtgtaattaatcttcgattagacatcctctctttccgacagaacgagaaggaatctctcggtgcaacctgggccaggttctcactgttaactaagtctggcccagacttgtctttacccaaccatatgttgcttcaacattttcgatacgggttagacaaggagtctgccgtaaatctcgatatttccgccagaggatcgttcgcacagaagacaaccgacgagggaagagaactcttagatctgatcttagagaacgattcttttggccgaagcggagccatctcggaggtcgagattatccatgaggatcctctgcatgtggagtcggaacccgactcaactgctgaatcctcattcgagttgctgcagccggaagaagaagaaattcatcctcaggaaattccattccgattcaggggtgatctttatgaagactatggaaacaccctgaataattccagcaccaaagaggctcatcccaagcatgaggcgtacaaggaggtgatgtttgtatcttcgttcatttcttctgaacccattgtccatcttcatgaaactgaacgaccctcatcacccttgatcaagcctaagccttgtctctctggccctcataacattgttcttgtttatcatcaagaaacaacccggttcttgcacgatgcatctcttgagaaagagaaccttcaggccacggacaagcttgagacatcgactctagaggacgagagaaagcattccacttatgagcatgaaagtttctctttcaaaatcccccaggattcatgctcacagaaggaatccccagagtcctgttcgattagtaccacttccctgtgcgaggaccacaaccaccttccggtcctcatttctaacatgtttagaaggatggttgtggatgcttatatttatcataaatactgcaaatctcgtatttgtttgtggcactaatcttgcagaacgatgtcccgttggtcaagcttgtgactataaacaaagcactaccgggagataccccggattatcatggtaagttttctttctaataaaagcaagaaccaatttttaggatagtatgcaccttcaggtattcttggtcgctaaccattgcaggttgagattaagaacgagggtcatgcgatgcctaagaacatggtagctacatcaactgtacgctttggtgatccttggtattggaacacactcgataggagaatccgacatcacacacttggtttttgatgtcttgcgacacaaaagtcgaagtgtgggggaggtcgacaagcttttcatgacgagttccatcaaccaaggtcatcttggtttgaagttggtgttagtcctagcttgcctgaaaaaaaaagaaaaaaaaagaagataatgaaaacaaaaagaggacaaaagagagacagaagaaaagaaaaaaatgggagaagaagaaaagagcaagagagctgatgagatacatttggatcaaagaccgcattatgtgcgtgtctttgaaatatggttatacatctcactagtagcaatcatgttgccaggctacacctagtccctctatcgagctcatgtgtcgccttggctcaagctttatccactcctagctgtgcacaacttctcactcccgcagcactttcgcgcatacaagcaagaggagttgccctcttcttttctaggcatttgctgctccactccagttggcagttctacatttgcccaaaaaagagagatatcctacgtctctacagcattgtgccaacggatcacgccttcaaggcacaaggttcttgcacctgaggtgtgtgcatgaccaacttgcttgcttgagttggcatggtcaaggtgccttcctccgctacaatttgcattgtgatggaggagaaaacgacaatgatatgtgaccatgccactgccctagagatttcaaattatccatcattctggcagtaagtacaatcaggtatgcgaaaaataaaccaaggttcaccaaacctttacttaatagtaccactatgtgaatatggcttgatcatacatggttatgtttcttatgtctatttgcatatgctctggtttgggtgttttcgtgagacatctataggatttttaaattaagcatggtgcttaggtgaaaatagtctactttaatcaaattggacatggagtttagtttgactaatgaatttcagagttaatatgttcatagacattggatatatatcttctgtggactaacccctgcaggaaagttttcaaattgacgggtgagtcctcaagttcaattcacaatggaggtaggtcagagccgggaacaaatcaattgctaacatacaaaggagacagatatcacctatcaaggtgcacggtgcgtatattactaatcgctcctttagcatgttcatgcaaatttacctcagccctgtatgagttgtgcttaaacgaaaatttggtgaataataaaattttgaaaaaaaaggtgttttcagaataaaaaaaagagtgtctctcggaaaaaataaaataaaatattggcaaacttgtgggatccacgcttcttaagttttgaatccaatttcattttagtgtggatgtgaacaattaatcttgaggctacgataaaatcttttcaaatcattgtagtgcttcgagtatttgttgtccactaaccttttgcaggaaataaaaagacaatcaaggagcagtgtacaataacttcaaacacttatatcatgctccttatccatgagaaaagatatgcacagggaaccaagtagaacaaatgcaaaacttgttgcattcttacattcggttcaaatcttggtaagacctatctggtaagaatctcatacaccatgtgcatcctcatctcatgtctccatcctgccaggatacccatcatatccattgttgccataaaaaaagagaaaaaagaaataaaataaaataaaataaaataaagttggctccttggtcttccaaccaagtgagtcctttgtgcttcactcatgtctttgtttttctttttgtgtccaataaagaacccccatacaaagatgtcacatcctgattttcgtcttaggatttataaattatttaataaattattattagaatttatattatatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagagcagttcagcaattatttaaataataaattaatccttaaatggtctgattataatcttgttacgtactttgagtgtccaattagtttcaggattcatgaaattatttgagcattggaagtatttttaacaatttaaagatcattttggtgattgatttatttggaaaagtaataaaaatcctcctcctcagcttgggcccttttcggcccattccttcctcccttctctctgttcctcagcccagcgtaaagtctaatctcctccctctcgctacagtgcttctcctacctccagccggctggacagaggccgtgttcatcccgataccggcgccaatctccgccgaatccggtcgcttcgttgcttcccttccaaaattgattgcaaaaacggattcctctctatctcctctatcttatccacaagaaacccccatcaaattcgttatctatctcacgaattttggccgtttttattcgggtgaactcgagataaatcctaatttccttcaccaaatccatctgttcccgaggcgatctctccctcttccgactataaatagaatcccctcggcctcctcttcggtttccccctgtttcccgaagttttccctaaccctagccgcctccccacgctcgtcttctctctccgtcgccggcagtcgctccagccgccgtttgccgtcgccctcctacgccgccacctccctcggctccgcaaggtcgagctctaccccgtccactggtttccctctgccaaatcccgccggaagccgctgtcaccgtgaaggccgagttcgccacccctgtttgatctccggccgagcctcctcgctgttgcggtcgtcacccgttcaccccgaggccgtcgtcggcatcgcagcaccaagccttagcccgtccacccctccgttgccgccgctcatcgccggaaagccgtcgccatcgtcaacccaaggtcgccgtccttcggagctcgtcgccggccatctccctcgccgtctgtcgtcgcgtaagtggtggtaagggtcgccttgatatcctctctctctcccggtgccctccgtttgcatcattgtaccgtggttcgctggtaaccgccgttcttgtgctcgccggcgtcgatctggcgtggtagccatgtcatcgctgacatcagcgctatcttggccatcaaaatcaatataaatcctgttatcccttttcaatagcatattagttttttttactatatgtcgtctactaaattcattccaataatttccggaggatgttttagtcttttatctcagatataaattatttgtaaattgtttaattaatttggaatagtcttttctttaataggctttaattggaattaatcttgtaaaattcataactaatccatatgaaatcggaatgaggtcgttcaagtctctaaattcatctaaaatcatgatctacatgtttgtttactttttatgtactgtttatttggtttttattaatctttttctttgttttgcgtgttagcttgtcgtttccgttgttgcgaaggttcatgagtgcgtcggaagtgttcaagaagactaattgaagaccgattattgcaaggcaagtcacacagatcctaaacaaccctttgagcattctgaacccgtttaaagctaatgttttatttcaatttatgcattattttagaatagcatcgggtggtgagcctttcccaattaattaatggccgaagatgactttattttcctatgggttataatttgattagctagaaccttatatattggtttggttcagctaaatgctatatatatataattgcttagccatgcttagaaacattaactcattaatgggatgaatcatattacattatttcttatggttatatttaatggtagctcacgatggtcaatcgtgctatgataattaattaataactaaaacctgattaatggtgggttgtgagcatatggttttgaaggtcgtggtcatgacaattaaggatcggttcacaagctactgttgtgagacattaaccgtgccaaccacaagccagcgtgggcaatggctttaccttttgtatagcatggttcattacggggcaccagactgagaagcggcgagaagtccgtgggggtcgctggggagtccatgcctctgttttttttttttgagggggtgattatgatccaggaatggtgcactatggtgagttgtgttgtgcgaggggtactgtcacagttcctttccgagataccgtggtggtattgaggcgcatggtaacatgtcgtggagctgtgtcttgtgggtacagtggtacacctctggccagagtaaaactattcgaatagccgtgcccgcggttatgggcgggttaagcagtctttttcgtgattagtctcatacctctcacaataattattaatgctataattggtaataatttgtttacctcctggtttggagttagatctgtgcagccgggtttggttgttcagaatggttgggcctgagcagcatgggtgtgctgttcagtgttgattaaaattgatgattactctactgttttactattcttaaatatttgctaaatgctgcttttgcaaatgagcctatattatgccatcctttggtatccttgtgcatttgcatatttgttgtgtggcttgttgagtatgtcatatgctcaccttgcaataatcaatcaacctcagttgaagaaaaaggatccagaaggagaagacatttggcttataccccagttgagctgcctgtgggagtggagctgaagccatcgctagactgttattccgctgttgtttttcttttggtttgtaagtatgtaacgttattattatgatagatttgtatattaaattatcagtttgtgtacctcggctgattcctggacgaggaatctatgcacaaattagttcggaaattactagtgaatttctgagcgtgacaaaagacaagtgtgggggtgatcttgcacatcaacgctataaccaaagcaagatcaccctagaagtgatgagccatgacaaaccacacaaggggaattgatgtagtcaaacccaatgaggggtcagttgaacctccagttcggctgaaccacctctatcgtgaatcgtcctctgttttatacagagcgcaggtttgcacaatttttcctttggaaatccattctatcttgagtttaatttgattatcaattctaaaatatcgaagataattaaactcaagctagagatggtacaattagagtttatggtctccctgaaaataacatgcatgcctattattctttgctcattacttgttgcttgtggtgacatatccaatagggaccccatgttatctaggtaattaatgaatgaaatatagtctgatgatagaaatcctgctcttcatgtggcacacttgggaattttataaaaagaaaaaaaaacatataatgatgctaaactcctcattgatatttttattcccactagagccataggttgatcattcatgattagcttgctacatacgctgcttgtcattacattgagcgttgtcaagttttgtgaccctagtgaaatgcttttcatactttcatggtcaagatcacatacactccaaatacacccaccaatgcttgacttctacactggaagttagcattgctcatttgtcattcatttcatccatagtccacaaaataaatactccatgtcatttatgcatcttcctccaaagttctttcaaaaagagagatagagagagaggcatggctatgaaaaagaaagaaaaaaatgctcatacaagtatggagcatgatgatgaaaaaaaaaagaaagaaagaaaagaaaaaaaagagatagccatgcattctcccaaatttcaaaagagaataaatggaggaggaggtatacaaaaaggagttatttttattttcctttttccactcacaaatttaccacacacatatacatgcacattcttgactagaaagtatgactagtatttccatggatcctttatttgactttgcaatatatgtgatgcaagtaatgctcttctcttttccatactctgagctccacataagccttattagatggtaggaaaagaaaaggcacaatcatatgcctttgtggggaatcatacaccttgagtgatcaagagaataaattgaggagcaaaccgaagttataattttgtgttacttgagaaaaaaccccaagttgttcttcatgaaaagttagggtgacttaagtcaagattgttccatttctcaattgttcaagattgcatagtagacactacaaagatcctcaagtacaggtatgactttgaataatttgtttgcatgattgttagtaaggaagtcataactctattgtagagtccatagccttcactctagacgagcaaaggttaagtgtgggggtgttgttgacggtccttaaatcataatatctaaccgtcaatacctacatataatgaaataaaacatggtatccaacttagtggtaggtattattactaatcatttccactagtgttggtgaaatatgtgtatgcaggtaatttgaggagaaaacacatccgtcatatgacaaaatgcacctacgcgcattcagg

SEQ ID NO: 22981 - DNA, 14888 bp, Oryza sativa
  unsure (1)..(14888): unsure at all n locations
atggcctgttccatggaggtttcacctgatttgtgggccctccaatcggtgtgctcgcgcctgattggctggaggtgtgtttctttgcatgccgggtgtgttttcttcttaaaatccctgcatacacatatttcaccaacactagtggaattgattagtaataatccctaccactatgttggtttccacattttattccattatatgcaggcattgacggtcaaatattatgacttaaggaccgtcaacactgttgctgtggaataggcaaatgttgtcccatggttatctacggaatcggctcaactatcggttgccttggtctaaacatagatgcgactcggtccagagagattcgaacaaccctacattcataaccaggtatttagaagtgcatttgttgtcttttagattacatatttactatattgcaaattgatcgtatgcgataacaaaattaactctaaacggtaaaattgaaaccacttctacttgaacaacaacttgaatagaagtatacatgtttaataatttattcaaatacttgtttatttatcaccaacaaatataaattttgtggaattttagctctccgttttgacctcctgaaatttcaatataactttcagcctaactaatttcatcttttcaccagatttaaaatacttggaatttatgtgtgaaactttgaaaaatggaacctataaaccaacacctatcaccacaccatattcctgaatttttgaacaagttttacctagacaaatcgaatttaccatgagagggaaagaaaataaatcctggaaattgaaagaacgaatctatactcagtttttcacccacctctctcaccctcatagacagccatgtcttgggtccacttgtcactgaccttgggtgcctcttaaaccccacaacacacccatgggcgtgctcccacctcagaacttaaggggggcagagaaaaccccttcttcttcctccccattcattttttttcgaaaggattccctttcattttcactgcctgttctttcttttcctcctcaagctgagttcacatctaacttctcctccccaaaccccatccaatagcccaagatcaatccatgcatgttagaccacaacaatccccatcatccaagctttccatccatcccaacatcttgcacatgcatggagagttgagagagatcgagaaggaataagagagtggtggtttcagcctacagggcagcaacagcagcattttgttttcctccatttggtgagcttccttttcatccatggtgcctcttttgaattccctccatgttgaacatctatagcataacgttgtccactgtagacccccgattttggaaatcggaaatcttctgtgtttatccgtaccaatccctggatcagtagttggtacacacatacatagttgaatcacaacatatcacgaatgaattcaggctaaaagagttaaatacttacattagggccaggtagcccgtcaactatcagataacagcagcggaagaccaaataatataagggcccggttaacatgccacaggcagtcgactggggaacgagacctagaaccagaccgcactccgatcatcttgttggatacgcaagcgtaccgacaagggcttctcttcaacactctcctaaaagatgtataaatagcaagagtgagtaccaaccgtactcagcaagccaccacaacaacaatgcatatgatagagggtatttcaaggaatagccacggttcttttgcgcaaagcaagttttgcaattcttttcataagcctaagacctagcatagactgatcaaattttagtaccagtgttcacattaaacaatgacggttctgtccaccatccattgtgatcccaaggatagcttcccgccattgagtcgtcatggttttctgaggacgtccaccttccctcctctcaggaagtggctccatcagcataaaaatcatcatgcaatatcccatcccacacaagttaagaatttagagtctagccaagtgtaatacatgtcccagtgctcaataaccgcgagcacggctattcgaatagatttggtttactcacactgcagtggatgtacactttacccgcactccgcactancaacacatgagcctcgtcccaacacatgagacgcgtcacggcanagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcaatcctaccaatggcgacaccgatgtagggcgacgcctctcggccctacctcaacggctgtcccacagtagcgcacctacctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacagtactagccttttccagataccacccaaatcctccgtccgccccagtcgaaaacggttgtttagttttatttctcctttcacaaatcatgtcatcaacatcatggcagtgtggcgctcatgtctccacatgccgcatctcaattaccttcccaaaggtaattgcccaagcatatagcatttgataaatatgggtatgcatgattctagaatagcacttctaagcaattgtcataattgactagggactcatacgtaaacatggttacgaaggaataaggggtaaacaataatcaaggcatggcataatcacaagtaggatgttcatcattgcatgcaattttatttgtaaataaaataatttcgcaattgggatcaacatgttcaaagaatagtgatgacttgcctgcgcatgatagtccttattcttgatataattattgttcaaccttcacctcctggaagttgtagatgttgccttacaactgaccgatacacaatttctataatacgcgagaaaaaccaatattcaagcaacattcaaatatgcacaaacaaaatatatttgatgaggtcgaacctagggttgctcattttattcgcgcttgctgatggattccaacatgctaagggctaaagtttcttaatctttctgttgtcatggtggtctatttaggagctagccaacgtagtataaatgagatacatatctggctaatatgtggtttagtctagctaaaggctatggaaggattatggctacacatgcatcgatctaaataaaatggtcatatactagaggttctgttgtcgtcggatggatttgggatcaagcaattaatcgcagggaaccatttgtattattattttattgatggaggctttgctttaattatgaaaatattttacttgtcacaataaattagaaaaggttaataattatccatgctttgtatgttagagttgtttaggttaatcatattatggttacagattatcccatcacataattttacaatgaataatcctaatttacaattgaactataattatatgagatcaagatttataactagtatttatctaatattcatgtttgtcatatagtccctctaatttaatatatgcaacaagcaaattaatactataccgtatagctataatgggatgtacagtataggtgtgtgcacaatatcttaatattgaatcatttatttgaatagttgctatttcctacgagctacacagtacatgtgattttaagtggatttatgagtgagttaccgtctatacaacttaagggtcgatttccaacctacacatatactactgtataggaaatgccgttaattaatttcgtgcgggtgattttagtcacactagctctgttattatctctcataaacaagttaaagactcatctatgtgtgttcaacttttagtcgcaaagtatgaggctaaacattatttatacaatttggacgtcacgagtataattatatattgacatatattaataaatggcactagtatttcctatgctttaattaatttgaaacaatgctcctaattagtttacataggttttacagtgagaaagcgtgttaaagacaattatttgacatctactttacagtacaatatcaattttatttattagcacatttttaagttaactattatgcatcatcttgatattaattatttaataattataaatatattttatcaaataaatagtgaattatataccattggaaagcttatgaatttagatgaatttaggttcaagtttcactcaaatcagagctaaaatgaataagttatgctagtgtaaagattcaaatttgaattaattctaataattacgaaatggtactgttcctaattcatttatttataatacaaccttatccacaagctatagtgactgacaggtggggtcttcctatttcttttcttttattttacttttctttctaaaggaatccatacgggcaaatgacaggtgggcctaactcctttgactagggtcaaaccggccattaaacccggtagggcccgcttgtcatagactcgaaactataaactctccataactagatttttaacgacccggacctacatgtaatagacttaactaataaagattaagaaggggattactatttactaatcacgtggggcccactctaacctctcttctctattctcttttctctctctgctttctctgttttctcctctctctctctctctcacggccgagcggcgcggctaccggcgacgaagggaggcgggagggcttactggaccggcggcgacggcggcgaggacacggcggcggggtgcggcgtggcggcggcgagacgccggggcatggcagcggcggcgcggcggcggaatgcggcgtcggtggaggggaagaaagagcaaaaaggggagaagatggggggaatggcgtggggagggaagggaaagggggggtatttatagggctcgggggaggggtggccggctttaaacgtcgacgggatggcgcggcgacgcggggctcggggcgatggtgacgcgcggcgttgggatggcgagcgcgacgacaacagtgcgcggcgcgggcggggctcgaggcggtgatggcgacggcggtgacgcgatagcgcagcagtggcgcggggatcaagggtgacggcgttgcgatggagcgcggcgcggcgataggacggcgctcggcgcggcagtggcgacgggacggcgatggtgacggcacgcggcgcggtgatgatgacgacgtgatggcgacggcgacgtgacgcgcggaggggtggggctccaggcgacgcgatcggagacggcgacggcgcgtgacacgatgggacgcgagggggcgcggcagcgcgcgcagagcgaagcaacggcgcgcggcacgtctgagcgacggcgacggcgacacgatggggtgcggcggcgcggggcgcaaggcagcggcgcggcagggctaggcgcgacacggcaaggcagggcaaggctaggcgcagcgcgggcagggggagggcggcgatgggacagggttgagcacctagggggcaatgaacagtgctagccgatttatttggattttattagatgttttttctaatttagaaaatggactattgccacctattttgttacaatgtgtttcacacaaaatctatgttattccatcaaaatttatattcaaatttaatattgaacatatccttattattattatatatttttctgagttttcctattttcttacttttaaggctttggttgatttataaattgagaaaagttgcaaattaattttttatttactcctaagcatttgggtgaccgtattaagtgttcaatgtgaatttgcccaaaatttaatactgtccaatatttaaggtttattaaagattctataatttcctatatttgggattttggtatttatctgttttcacacatattggtttatcttcttggattggttttaccaccacatggatttctataatttagcatttgtgattcaattcaaattatataatatctaattattttttcccagtaaaactattctatagatagagttccatttatttgaacgattatcatttcctaagtgtttatatttcatggcacgcatcacatgttcaagtatttaatatttgatccataaattaaattagtaattaaccttccctttttatggctttgttttcttgtgcgtaaatatttatagggttcataataaatatcttattattataattattacttagttgtataactttagtttaattttccattgtgacaatttatagtttggcaagcaaaagcaaccataacatccagcatgatgcaaaaattttaaaaagttcaaaattctagtgattttgattgtcttgaattttcagggtgttacatccactccattgctgtagctagaaggtagctgcaactcaccccgagttcatctcttttgatttcggttgaagcagccctaggcaacgtctcttgccgtcagcccgaggccttgctccgtctcttgccatcagcccgaggccttagcctcgcacaaccctacgtccaggctgttgccatgtgagcgaaatccggtggaagttggagaaaaggggagtgaaactagaaatcgatttctgagatagctattgagctgaatgagtatgaactttaaaaatccataactaattcatatgaactccgaattcagtgaaccaaattcctatagattcataaaaatgaccaacttttgtactggttttcccagtaaaaatataaatagctatatgtctcccttgtgtggtctagctcttaataatttcgtaagaaattattggtaaaagctaaaattgcaaaccaattttgttgagcttatattttagtaatctttgctattgtgaagtttttggtaaaactacctcttaaatcttgtttaggactttatttagcattcccatgattttaacttgtaaaacccatatatgaataatgacaacacatatagctatgaaatattttttcttagaacctgtgagtgatgtactttactctaaaaataatcattattatgaaatcttggtttgaaatgcatgtttcttgtaatgtactaaaggaaacattaatatttacagaactgccattttcagcaccttagagcttgtcattttcatatctcccaaaccataagtgataatcttgtgattctttcatctaaattcaagttaaaatatgatctacccactgtatttatttcataatttattgatcattttgcatgtgcatgtttatttggctcttattcgcatattgcttcttttcggtagattcagagaatacggagagtaacgagccatatccagaggaggatagtgactaccctcagcagcaaggcaagcacctaagcatatagaacctatgctttctctaaaaatgatttgtttgcaatctatacgtatatatatatatatatatgcatgcattgcctagatattaatattgtcggtttatggtgtatgggtagaacctatttatgcatttagttcttgtgatattgctatccttataccctattaccactagtcgggattacttgggatgtcttattcattaatgcttagccatgcttagtgctaatagaactatagggatggacaatgttgttaattgtggtatatagacaacttgcattattgggcataaaacttgagcacttacacaaaataatggttgatgaaatatgttggacttggacgggtgatagggcgatgatgggaggttggtttcccctgatgcaagtagccccgtctaggtcattaaggaccgaacattttgacttctaatcaagcaccctacgtacttaccacatatcttatttgggaccggcttgttcttactagttctactgtgatcatttataccactgtcacatcctgatttttgttttaggatttataaattatttaataaattattattagaatttatattaaatgttcactaatttacaagaagttaaatgtgggaaataaaatttcctaaatataaagcatggctggatttaatttttattaaattctccatggttaattatactctctggaattttcttggatttttcggagctcaattcctaattttaatcttacaaacaacatttcagtaattatccacatattaaattaatcattaaatggtctaattataatcttgttaagtacttcgagtgtccaagtattttcaggatttttcttgaaattatttgagcattggaagtatttttaacaattcaaagatcatttcagtgattaatttaattggaaaagtaattaaaattcctcttttccttttcgggccgaaacaggaaaagttctatctttcttggcccaatctcctcttttcctgaaggtcgtgctcgcgaaccggtccttaattgttatgagtacgatcttcaaaaccatgtgctcacaacccaccattgacaagttttaattatcaattaattatcataacacgattaaccttcgtgagctaccattaaatataaccataaataataatgtagaatgatccatcccattaatgagctaatgtttctaagcatagctaagcaattatatatatatatatatatatatatatatatatatatatatatatatatatatatatatatatatatatatatatagcttttagctgaaccaaactaatatataaggttcaaactaatcaatttgttatccaaggtatcaaggaataggataatcaatgcaaactggccataacaaaggaataggttcacaccacccggtgacattcgaaaaataaatacacagttgaaataaatagagaatttaaatataggatcaacatggtcaaaggattgtgtttgggatctatgtgacttgctttgcaataatcggtcttcaattagtcttcttgaacacttccgacgcactcacgaaccttcgcaacgacgaaaacgacaagctaacacgcaaaacgaggaaaaagactaataaaaaccaaatagatcatgattttagatgaatttagagacttgaacggcctcattccgagttcatctgaattagttacgaattttacaagattaaactgattttagccttatacagaaaaggattaacgatttatttcagaaaagaaaagggctttatgacatcatcaccggaacaaggcactggaccacacggccaccggcgctagaggactcggccggaccaaccgagggcatctacgcgaaggggatgacgagacaaactcaccaaggggcggcacgacgacgaacgacgatggaagacgaccagcgacgagctccgaacggcggcgaagtcgggacgacgacgacggcgactttccggcgacgagcagcggcaacggaggggtggacgggcttctcctcggtgctgcgatgccgagggaggtggcggcacaggttggggacgaggcgactgctaggggcggctggagcggctgccggcggtggacagagaagacgaacgcggcgacgacgctacaagcgacggtggagagaggtagaggtgccagccgaaagaggagagggaggggactctatttatagccatgggagagagatcgatccaacaacgagagaatcggagccgggattttctagggtttggtttggagagataaacacgaatcgagctagattccgcgttgattcttcgggataaagtccgattcttgggggaaaggatagaggaggataagaggaatatttcccctcaactaattttgaaataacacgagagaggagaccggatttggaggggaaatcgacggcaatggcggcatcgggctctgtctccagccggctggaggttgaagatgccactgtagcggcagggaggaaaagtagactctgtagatggtagatgcacgggcgtcatgacagaacacacattttcattgcatgtaccatagaatcgtaatgttggtgttagccttacaaatatatcatattaaaaaatataaacattatgagtaggctaccaaatccaattgttgaggctgtctgaatcttatcgttcttactgatctgttcacagttgtcacggtcttttggaacattgatttcattttggttaacagcggcacgcttgtttgtcaacttggtatcaattagattagttatatcggcaaaaggacctaagggaggtatttgtaaaattaggaggaaaaaatatctcaatcaagcaatgactatgactatgtctgggtggatgaaagtcggacatgatcttttcaacgatcttgaggcggaatccctaccattgttatccattgcaagtaacttcttcatattttaaatgcaactctacaaaaatcaatttttggtatcaattaaatcctcataagctcataacaaattcgacttttcctctctaactataactgaaatatatagattatgatgtggggatcatgacgtgaaagagctaccagaaaggtagatgggtaaactgcacagcagaaaattaagacaaaaacatggtgcatgtactgaaatggatttcttaataccataatatatagaagacactaagcaataacagagaatcaaatcaacttcaccattgcacctatatgcttgaatatatgaatgataaaaccgatcccaaaaataaggaaataagaatcagggtcatgcggagaagagacattttattcagtgcccctattctgtaatgattcttgttcagtgcttctaaacatagctcaatcagctatataggcacacaatactccaagcaaaagagcacatgccaaaaaaaataatttgtcccctgtctacatgagcaatgcaaatttcgaagctgccaccactacagttataaaataaccaagccatttaaggacaccaaagctacatatcaaatttatttgacacaatactatggatcaaaagagagtagtcaagaccttcgatcacaagcggatccaagatacttaggtctgcacaacaccagaaagttagatgtccacacaaatacacacatacagacatgaaaccccaatctcacacaagaaacccgcaagaaaaacagccttcacgcttcaaactctcatgagagatctcattccccgcttgcgctagggacacgagctgtggtttgccttctgcaacagcaaagctgtggtttgtctactgcaacagcaaaaaaataatcaaaacatgcagccacatcctttttaatcagcaaaaaataatacataactgaataaaattgacacaagagaaggtttgcgtaactcaccttggagagactggagagaaggtcgatcatgatggagaacgatggtgatgggcaaggtagaattttgatttgtaataaatttagcacattatctacctaaatgaaatgaaaccaaatcagcgagagagtttaaaaaataaattaccactgacctcctaaatacagtaatcacacttacagcaaaaaaaacttcattcagtttggatgtttcatcagcaacttcacaactcagacactaccataatgagatggttttaatttttcacaaaatgatctcatctacaatgtataggacacctggtcatatgcacgttagtagtacctctcccacaattcaaggcaacaccagaattggacaacgataattaaaaatttatgccttcattggattgactcatagcacatacaaaggttaggccctgcaatttagtaacaattgactgttgatcatagaaagcaatgtcagaacctttttttccagatggtcaatttcagaaagacttcccccttcacaaaatttctttgttcagagatcatagtacaaaagttgagtgcctttaattaattgcacagaaaggtccatctacaacaaaaatgcagaacaagggataaatggtaggatatagtgttatactgaccagatgtatgtatgatatttcgtcacaacctgaccatgtaagtggggtgataattctgcaaccaccattaaatctaattgtcattgtcattaaggtgagtcagtgtaggtgctgtttttacttgctagcagtatggtagagtatgactaacattatggtttttatagcatgattgaaaattgaaataattaaataatggtgaacttttggggctgcatgaatgtctaggctgaactgaatttttgcctaactttttgggggaaaaaaactaaaggcatttgatcgagcactacgggagcaatggcacgaagcaatgtagtacatgtcaagagcgttgggcacagccgtccatggcctgccggcctgctcgacccctgccttgacgtggtgggaggcgacggtgattctctgtggcggcgtgacggagatcacacggcaggaagagtgcgcacgcataggggggcacgcaggagagcagagcggggatcgactgcgtggcgtggatggaggcggtggcgtttgggggagagcgagggggcgggaggcgaggagacaggcggaggtaggtgctggaggccgtcggcaggcgatggcggggcacgacggcgacgagcgtcgacggcaggcgatgcagcgtggagtgcgaggtggagaaacgccggggacggggatgtggggcggcagactggacagcggtggaggtggatatgacgacagcgctcgatccaacgatgggcgcggcgaaggggattcggctacggtggaggacgcgggatcggtggcggtgatctaggaggaggtgcgggacgggagggaggtgtggtgccgccgcggattgcggaggcggaggggattcacgacgagatgatgagccgtggctaatgtgaccatggttactacggatacatccgttgatcacatcatagaagaacaataagatatcaagttcgagtcctccaaatgccagaatccaattcggccatctgctacactgctgacttcaaacggccgccgaatctgcatacgacctccgttttcggcccatgagtacttgatggaaagctctcggagtcctctttccaatggatccagcctcattgtcaaattccatctcagtcggcagaaactgaagaaacaaggtgctgcaacacctgtaatgggcctatgggcttgtaacttcgtctgggacctcggcccaagtggggcccatgtggggtgcgccccaaccaggtggaggacgacctagaggacctcccacctccttaaatagctaggtagccctttagagtttatagggttttgatagattaaagtttagccattgctacttgcttgcagcgcgcatgtcggctagaccgtccgtctacttgttcttcggaaccctaacttatcatttgtattaaattcctatttgcaatatcagattgcttttatcttgttcttacttgtttcttcgatttgcttgcaggaatagggttgatctgcactggcaagatcagcaacccacggagaggtgtatcgatcgctaaggctcaacacaacgtctcatacggttgtagtcagatcgtcaacgtttctcctaaattgtagttatcacaactcaccgaaagatcgggccaacaacagccttgagtgtcgagagtaactcagggttcaacagtggcgaaggggagcggcgcgagcatgtttttttctttcctgattgtggatcgcgatccgtaggaatcgcgcgtgggtggtgcggaggaggagcgtgtcgccatgaaacgtgtccatgtacgttcctacgttagagcatctccaacaccaacagcatcgctatttttgactctccatttgtctatttagccaactagccaaaaagattcctctccaaacctgctgcacactccaacagactctccatttcagactctccaaatcctaacggctagttccctctccaaaaaatctgcactctccatccactccaacagactctccattttggactcttcatattccaacggctagtttttcaaacctctatatatacgtcacccctcatactacctctctaccactctacacttcattttctttgcttgcttctccaccaccacttcataatgaggcgccgtagtgtagccatgcaaattgctttggagtcatcgtcgtcggatgatgacgatgtgtttattatggcaacaacagtcatgatagagcatcaccaacgagcccaacgcaatgtaggaggtagaagaggttctatttcggggcatgtagtgattaatcgcgatagaacggaaagacttgcaagattaatgagggactatttttgtgataatcctacatatggtccggttttgtttcgtcgaaggtacgcaataatcattttacaccattttaaatattttgttttcatcgttagttgttcctattataatgatactttttatatttgttaacttgtaggtttagaatggctcaatctttgtatatgcgcattgtgcatgcagtacaaaatcatgattattattttgttcaaaggagaaatgctgctggagtacttggactacatccattgcaaaagattactgttgctttacgaatgcttgcttttggtgtgcccgttgattttttggatgattatcttggtatggctgagacaccattttgtcaagtcttagaaggtttgtgagagctattgttgaaatatttggggatgaatatttaaggtctcccaatcaagatgatactaatagattgcttgcaattggagaacaaaaaggctttccaggtatgcttgggaacatagattgcatgtggaagtgcagggctgcagga

SEQ ID NO: 22982 - DNA, 27128 bp, Oryza sativa
ggattggatcaaccatgtgattaggtgttctcttcttaagcaggaaataggaaattagagggctcctgatgaagtagcataaatgcatatgtgcacaatctccgcaaaaatcgagctcaaaggtacgcatctccttcgatttggagaactgtaaaaaatctgatgcctccattttatgccatctgttatgtcttttggagcacaaaggattttggtctgtgttttttcatttatgtgagatttcagattactgcatcatcttatttatcaagaactataaattactttgttccagaagtccatttcataatctatattagctattattttttagatctatcttgaatggacttcaggcttgatcaaaatttctgtctgttctctaactgctattcactggccaaataagggcatctatcgagttaatgtggactgatggcatatattgtacattagttgtgcgactaataaattcagttgagttgctgatttattgtttcacaaatgaatttagtttcactctattttcttcttaacaaatcttttttctgttaattgcatatacatgttcaaatcccttgtcatggagatataaagctttagtgaacagtcaaggcagagattttgcatctttagtgtattgtagatcagttgataactatggatcattcatacatgattctggtcgctcaataatttgtgtattgtaaacatgtttataattcctgcaaatttctcctacatgattccttattcatgcaaattctgttcttctccctctaattggcctcaattcactgatgtgagaaaacaaaacatgatggtattcagtatcgaagctaaggtatttttctttccttttttgcagtcataaaactggattgcagacagctacctcggttctaaattcatccagggcatcgcttcatataagttactgcaaggaattctgcactacaactttctacacataggagcaagatggtaaggcacaaaatgcatagtaacaaataaaggataatgactatcgctcttgggctataaaaacttttatgttaaagcatctcatatgattaaggaaactgtatagctataaaagttatcacaactgaaaaaaggcattagtgtcccagatattctcggcttgtggaatacaaagttagaagaaatatttctcaaacattattgcagtgtctttttttttccttgaagaaatactaacgactactagattacttagaagcagcaatcaaagatgaaaactaacgcgccagttggcaaaaccaggttaaatcaggttatatgtaagctcaagtgatcttgcagttatgttgagaaaaattattagatctatgtgtgaactcactaatgtttttagggtgatgcttgatagtcgctgaattaccaattttaaagttcaattcagatcaaatattaattatttgaaaaaattggttatatagcatcgaaagtttccgtttttggttttatagcaccgaaagttaccggtcactttaatagtatccaaagttcaccttgttcccatttttagcactttcgtcaatttttccgtccgtcttgatcgttattgatccagccacacacatgatataacatttctacccctcattgatatgcattatacttgtacttgtgaggggtaaaaacgtcatatcgtgtgtgtggctggatcaagacggacggaaaatgatcgagaattgacggaagtgttaaaaatgggaacatggtgaactttgggtgctattaaagtgaaccggtaactttcggtgctataaaaccaaaaacgtgaactttcgatgctatataaccaattttgcctaattatttatagaatcgggtttgtctgaaacgatataaaacaatatgttttcttgaacttaataggctcacttttacatattctgcctatttgtgacgacatggtagagcagaaataccgagagatcacctgggtgaggtagacaatggcctttatggcgcccaggttctactgtggcccaacatgttcttttttacagagggtgtactccgtcaccgagaggagttgtcaatctgcaccatcaccaactgggaggcctccttctgtgtcgccatagaggagcattatcaatctcttccgccataggctcatgtgtcctcgatctgagccgccattgccagatatgtcctcgatctgcatgagacaaggatgttgctaatagctgattaacgcaatggggtacaaaattatgttgttcttggaggagactatactatgtatgtcttctccctgctgtaatgtttgagttccatccatctaatttagagttatctaactcaatgttccctcttctcaatgacaataataaaagggttaattagatcatgccattataattttcatggttttaaaatatgccattacaattcaactatttggaattataccattataactttagagttattagataaataccactacttacctcttcaacccatattctaaatgttatagacgaaattactcttttcttcttccttcgtctcctccccactctcttctgttcatcctcggaatctgacggccggagagctgcagctcgaagcagcagcggcaacagttcgagggccccgtggtcgccctgacctgtcccctatctccctgctgccgcagctgtcagggctgccgcactgcctagagatggtctgtgacgctgatgctacgcatggcgtccaatctgcatcaacgaagaggagcaacagcaatatctgtaggatgagtgattctccggtgctctctgctgtatgatactattagtagaaacgatcttagccattgatttattaggctataatgttaagtttttctttatatgatttgtgccttctattctttttctcttcgagaaatttgcatgactagatctcgcgcataatgagaaattatttttttttatctcttgcctttgatttgcggtgagaggatcacttgtcatatatatcaagcaactcatgcacttgaatagcgctattcagttttttatactcctatacgatttgtttggatgaagatgcatgaatacatgttcacatcaaaactaacacggtagctgctaattgggtagccaggccgcaagattgcttatctgtcctcgatcaggaccgaaagcctcgtgccgccgccttgattcatcatggagaacaagaaagcccaagtttaagttttagctgagtcaaaaatatttgtctgactttttctccgatgtttttattttattattttattagacaattatacccttacatggttctactaccatttactaagttggtagtagaatagatctgatcccttagatttaaaaaaaattgctccgattaattctattatcaatagagagcactggagaatcactcttgtgcattatttgtagaattttaattatcgtcgattacctatcatggggtttgcaacaagataattcccatctttatttaaatttggtgcaattgtttttctggaactttgatgtttaacacgtaatgccactgatcaactttatttcaaattcactaggaccttgtagatgactaatcattgcaccattctccatttagcattcgaatagttaataatgtggtactgtcatttgtaccgtggagattgaagcttgtggagcagctgaaattcagtttatgaaacaatgcttctgtccaagcttgtgacgaccaaggtgttatttgtagttatctgtacaatgaagattgaatcggaatttattaacaattcttgtgcttgcattgcttcatcataattcgccttcttttgcatgatcataatgttactcatgtctctgtatgccatgagttaacttttttgtttagctaagtggtattccgattagaggggcactattttatttcttaccgtgatattttattcaactattttttattgttcttgttatttaattaggaacactataaagatgtgatataattattgtgtattaatgtttttgatacaacaaacatacacccgatgattatctaacatcattgttcttggtgtgttttgaattcataaatatattttcttcttccattgcaacgcaggggcacccactagtaacttaaaacaaaaggaagtaactttatcatgacattaaaagtagattcgttatggaggtaaaaacatgagtctatctagaaattaaatttaatcagcaaaaattatggaattgactaaaaataataataaaataaacaactcacaacattatgaatatataagaagtaatttaatcaaatcgaaaagtaatttatatatatgataaaaataacttacatatataataaaagtaatttacaatgtagatatttcttttctcaaaatatagtaatgtaagatcttgttgtaaagatttaattgcaacaaacacaatggtgtaatcggattataaatcgaataagtaatttaaaagaaaattctataagaagaaaaaaaatacatgtatcgcttggtgtattagagcatctccaacatagcctctaaacatagccctcaaacaatttttaagagttaagaccaaaaactgttttgagagttaagaccaaaaactaagatccaacaggacccttactaaaacccccaaaataggaaggcacacaaataatctccttaggtccccagtgctggggctcatttgtggacccatggtggagaagcgcgggagaaaattcccgctcttccccctttttctctcccgcgtgttgtctctggcggcgatcgcaccccaggtgcccctcgtccatggcgccctctccgacgatgtcccccactgtccagatcaggtttcagatttttgtgaagtgttttattttgttcttgagcactatacttggaaattatcactgttaattatcaaatgaagtacaattcatttatcgattgtgattaatagaatatagcctactcagtttgcattatctgaacatggaaatatgaatgatttttacaaccttaaggacagtatcactgtttctttctttgcgatccatctaaattttgaatataaactatagcatagttaacaggaattatgatccatgtgtcctttactagtaggatatgtcattaccacgtttggcctttggagtcctttttgttaattatttctgcaataatttatattactttcatatttgttatttataatcgaaccattcatacttgtttcatacttgtaggatgtgttatttttaatttatataatggatcattggattcacatagtccattttttatgagcaattttcattttcattggtgaattataaatcttggttgcatgttgttgtatatggcactgtgcccacaccatatttccatgtttgaaaattttaattactagtaatatgcccgtgctaacgctatgataatattttatgtagttcaaatattgcacatccaaatcgccagaaaaatgcttccacattccgttgttcttaatacaaaatgtaatacacataaaccacaataaccacttgatggtttgataactatacatctctgggaatcgcatgggaggggtaacaaatctagttaagtagcaaggaattcgggaggggttacaaatctagttaagtagcaaggaattctctcaataataatctattatacgcatactatgaccactgattcagaaaaatattatccagatccccacaaaacctccacaattctgattgatccaatatgtaggagagtaataaggtatctacagccattgcatgcttcagatttatttaacagcccaatagcccattatgcacttcattgtgttgaacttgaaatgccttgcttgtgctacagagaggtgaaacgaaaggtgtttcaaaacaaagaaaaatgctaggccttgatcagcataaattagttcatttaaattttagcttgctcaatgttttacatggcaaagagtcagcataaacaccaacattaaacaacaccatatcttaaggggaatcatgcttgatcatcaagtggggaataatacaactattgacaatcctgccaattaggtacaacacaaaatcatgcaaatcagtgtatcatatttcaaaacgataagttgaccaaatcatgtaataccagtcaaagtacacaccatgcagtcaagctgacctcaccgccccagaggtcgtcgcctccccagcacttcaccaggacagccccttcatgtgccctacgaggctaagaccatgatgtaggcatccacctctgttgtcattggctaccttgtaaataacactcactgtagctcaatagatgccaaaccacactgttaaacataaacatgaggcacatgattttttttgatagaaaattggaaaagaaaacattccgaaatagcacaaattatttgtactgataaatcgaagattatttgaaaagtacatagaagtaaggaatgcactggaaaagaacaacatcatctcaaatatgggacctgatcacttaacatgatatcaaatcgagcagttcatgagcagaaagatttcgatgagcaagagcagtgaaatagcacgccaaagtccagaaattacatctgtacatgctactatcagcatgtataccactgtaaattcagacagtacatgctactctgaacatgtccatatgctgtcaaaatgctgaatatgactgaaattctgaaaccaacgacatgggatcaagtctcaacccatcgtcaatagagctccgacattaagataaaatccatacatatataaccctaaaaactaatgctaccctcagcccggtatactgaaaaatagttacctttaatatatgatgcatcaaccctcactccattctccagcaaaaagcatcagccacaaccatggttccacagatcattgtctgctgcacgttgtcccaggtttttttaccaggctgcattctatcttttgaaagaaatattatgtacagtggaaaattactatagacaagtaattttacctctgttcattggtgattttaccgtatgctatatacaagtaatctccaatatgggatctttcatgatatgcaaacctgaacaattaaaaatcaacagcttcccaatcagctcctagaaaccacagttcacaatagtacactgaaacaacacaaaacatgaattgtaaacgtaaacgtgggactcagggaagtggacataaactattttcctaggataagatgcatagattattttcagttttgtttgcctgtttcactttttttacatggcatagtctcagcatattttccaatcagcactatcgtatatagtcatgcatctgaattttttaaaaaatgacctctatggtattgatatatgctataacaggcatataacacctgaatagttaacgcaatcgtaggacagagctaattctgtacccctgtacccttatcaatttgaaaacaagtgatttttttaagggtgacaacaagttacagcgctggttatatacttgtgatactccatgcaaaaaaaatgaagagaatggcacctaatttatacacttgtcctcatccatacaaaaaatgaagagaatgccatataatttctcccaagaaagtaaaattaatccaaggaaccatattctggttaaatattactaactaccaagacagtgatattaatccaaggaatttgagtttttttgacaaaatttattctgcaaatatatgttgagaacacagtattcatgattcattctgtaaccaccattaaatctaattgtcatagtcattaaggtgagtcagtgtaggtgctgtttttacttcctagcagtatggttttgagtatgactaacattatggtttttaaagcatgattggaaattgcaacaattaaataatggaaactttttgggctgcatgagtttctagactgaactgaattttaagcaagggtaagcaattttcccttgcttcaacaaatttgttccattagaaattactaagagggaatcgattgcataattgtctacaaattgcattaaaaataagaagggtgatcagatgccctttcttttcttaacatttcctcttatttttctccttccctgagagcacatgggaattcttttcccatgattttacaaaagtacagttatgagattccgtaaaaaatgaaaacgtaaaatgatctagattaaatcaaaatacccatccaaacatgccaaaaagaaaatcaaactttaaagattcgtatgcccaaagaatctaatcactgataaccttgtgaaaagaagttgtttattatggaataaaccagctgcaatgcgagcgatatacgtagggtaaaaaatattaaactcacaggtgtaactgtaatggcatatcagtgaccaatcctagagaaaagacacgtgagcttcacccatgatcatcaacaagtaaagattgcaattgttcacagttggttcatgctgtaaacaagaatctatagaaattgtcgttgtccacgagctataacacacaagctatcatactacgagatgacagatatgagatatgcacaacattttaatatcgatgaatcgcctcgctggctcgctgctgcaatttataaacccttcccgcaaaaaaaaaagggtgattagaacaaatagccgcgaacaataaaaatagcaaacagacatgaatcagtctattaacgtaaacttaccggagcgaagactacacgcggtgatcaggatgccggtggatgacgctcagtgacggagatcgagggcaaagaagtcggaggtggcagcgatgaagtcgtcgacgacgggcagcgaatcttcgacgacgatttgtgagcgacgacggcgaatcgtgggcggcggcgcagaggagatcggtgaggcggcgcctatctggatgctggtgcgagcgcgggggttcgttcccatcgatccggcggcggcgcaggtggagctgctgcggggggtttgggattgggggtcggcgcgacgcggggagagcgagggtgcggcgatgatggcggatgcggtttccgtgggattgggatatgggagcggtgcggcgattccgtgggatgggagcgacgcgcggtgggaggtcagggaggtatggttcgatcattttcgtccgttagatttgatgaatgaagtatgaagaatgtaagacccagtaggtggattataaggtagactagtagcatgcccgtgctaacgccacggtaatcttttgtactacttgcaaatttctagctgtattcaccaaattaattagcatttttttctcacacatatatgagaggtatcggagacatctctgaattttattgccaccatttgtttatctgttcacattattttcttgtgatcagggtatcagacctttttttagacaaaaggctttcgcccagctttactaaaagcacgagtatgatacatgtattgttggggtttcaagcttaacttgcaacagcatcggacaaaggcaaagttgttggctcagcaaataggcagaacaagccagtctgagttacagaacaaaggaacaagctaacctaagctatctctctagggaacgttccatctcggcacaaaaatgatagcaaacagttgcagaaccgctggatagctaacctaagctatctctctagggaacattccatctcggcacaaaaatgatagcaaacagttgcagaaccgctggatacttatagctagttggaaaatccatcttcttgatcattagttgagacttgatcctcacatctcgtgaattttggcaagcaagaatccctttaaagcatccaagtaccctgccagtttcgaagggatgaaaggtctccattgttgcaaaagggaaacaactctataaggcaaatgcaatatctgaaagcaatttgtttttaacacccaatcatttcgggttagcgaaatggcccatgttcctacagagaacaaatacaagaaggtaatattctgattttgttttcaggatattgcagcatggacatgacctcaattctagaatttgggattctatctcttgcacatctctaaaatagcaactgcaggaactttgcttgagcacatttgaacattaagtgatcaggctatattgcataatatatttgaacattaagggtgatgtcttgcacttgttgctctgtacaacagattttggagaatggaattgtcgagctgtgaagtccatgaaggcagaggttccagatttggtctgtacagaaggattcatctcaacacagtgcaaattaggagtcaaaaaaaacatcatgacagaatacctgttcaagtggggaggcaatgtccattgtgttcaagcagaaggcacgactggcttcgtcgatggcatgccatcaaaaactgacacatgatgtgatactccatagaacttaagtggaaaataaatagctagaaggatgcaaaggtcatccctcgcaattgcttattgaagcgtatacttaatgggaaatgcaatctgaatcatatttttctatacagtgcactccaagtaagatgtgaaactgtaagtaaagaaatttgctgccaaagcgttgtactcgtacataagaataacaaatggccttgttttctcataactgcaaaacagattttaatttaaagaaaaatggagaaatcatagatcttcaattcctgttttgtaagctaaatttgagactatttgagttttccctcgggagaaaatgcaagcatacctacctacaaatcaacaatcatgaaaataaattaagattagcatattaatttattatatttggcttaaacacacaatcatattcagtcgtaaacctttatctgactttcatgcacaatactccaattgataagatgattaagccaagatgctactgtagtattgccacatgcttgtctacgtgggtcataagctcctaagacaagcatacgacatggattcccaaattaccactctaaattgacacttgccatcttcttcacccctttattccatggatggcaaccgtatactttcagggtgacaagatgcatccatactgatgaaccatatcacaaacatacatgcatcccccacgttatcagatctttaagaaagaaaaattttgatgtgaacatacaagcagtaggatcatagtcagttaaacatattattcatgcactaccatatcctttttcgcgaacgcatgcactaccatatcctgctatgtctatctccccaatggccagacatccaatctaagctagacatattcttcagagttaagaaccaacaaatttgcagtaaaactgcccagagtgctaaacaaatcatggatgtcacactgatgcaattaatccaacatctttaattgtgccaatttaaattattgagagagattaccctgtggttcaatatattaccaacgcattacacaagtagtaattggtatggctctgactgatcgggttagcctccaggaatcagcacaattccccgccgtcatgcatgaaaagataaacacaagctggatgtcaaaaggaaaccaaaccaatccacctcagaaccaaatctgaattcatgaactcacatattccagtcacactttgaggtagcggagatccttcttgtagaggtcgtcgtctggtcgtagatcaccaccagccgacttgagcaatcccctcctgtcggaagcagacaaggccagcaatgagcagcaaagcttgcggaaaccacagataaatccctaaaatgccaaaatccttcggctcaaccaactggtatgaattaaccggactaagagaggaatttattgcttactctagccatggttggagcggatcttcggcgctgtactcgtcgattgcctcgatcattttcctgaataggtagatcaatcaaacaatagacaaagaaaatcacgagacgaatcccctcccggcctccccgactcaagaaatccggagcaaaccaaaccaaaatcgagaaccaagagaagcggcggcggcggcggtgggagtcgcggaggagatcggcgcggtggagaggcgggggacggtggtcaatccgggcgacggtgaactggcggcgcggaatcgggtgacattgcggtgaggcggaggcggggtacggtgatggggatcggagactgccagatccagagggtctcaccgtggatgtgggcggcgcgacgagcggcgcactcggcgccggcgggggttgaagacgcgacggggaggggtgagggcgtgatgtgtgggggggtttggcaggggagcgcggaaacagaggccgtgatgagcgatcgcacccggaagagaggtagagctgatctcgatcgttcgatcggggtagaggaatatgagccgttggatttgatgaatgaagtgtgaaggatgtaagaggtagttggtgaattataggatagatgaagtatgaaggatgtaagacccagttggtgaattatagggtagatagatgaatttgaattgtggtgtttgaaattgttgatgagggcatcatccactattacccgctggcaaagacgcaataaggggccaagttgtctagttgtagtcgggcggcgaccgtgtgaacctctgaataatctcaccttgcttagcttgggaggaggaagccactttaaaagggagagccacccctcccctattggactaatcttttagggagattggcctttccccgagtgggtgtgcctaagaactgttggggcaaccttaatatattgggtctcggcaactgttggggcaaccttaatttattggagccaaccccataatttattgggcctcggccaaccccacctggggcggatgtatcatttggtatcaaagctgggccctcagccaaccccacctgggcctgggccagatgtatcatttggtatcagagcagagttaggccattgtatcatttggtatcagagctgggccctcggccaaccccacctgggccaacttcgtggttttagccgtgaaacaccgcacgaactcacgtttttggggaaaacactctataaaagtagtaatttgccagcggacaccgcgccgattaaaatagtgtatccgtgatgacgaagttttagtgggcccgatattttacgcggagtgaccaaaatgcccctgtgccttacccagtagcgtgctattgccaatttgccatctcctgtgccgccgccgtcgtcatctccttcatatcgagggtcaacagcttgtccatcactgtaccacctctgcagctacagtccatgccgttgtctttcgctgtaccaccaccgcagcatcatcagcaaacaccaccaccgattcagcttcagcaccacataataccaatgatgccacagtcccagctccaactacatccacagagcaaggaggccaacaccattcaagcgccgccactagagtagtacgacacgaggacatctagtggcggcggcgtgtcgtcattgaggttgccgaagtgggaaaacatcaagaaggagagaaacaagaaacatctcaaggacacctagacatgcccctactaccatcagcttgacgctgatgcagatatacctatcaaaagtacattgttctttacttgcagatcagaatataaggtgaactcgtttctctctaagtctatgcgtgaaatatatgagaatttgatgctacataatattttgcacttgattactttcagacatgagagatttggaccattggctggcataaacaacatggggtccagccgaaggtgacgggtgtagcagcgcacatgtggaagatcggatgctattctgttcgtgaagttcatggcgaattctgcattgatgagaaggctttcaacatgaatggcttatatattaggaaaggttatcaagtctactttccatcaaatcaaacggcatgtcattccgagctttctaccaacggcaattgcaagttgaagacatcctgtgcgggcagaccgggtgacgcgcaagtaacaacaatggtgatgagcgtcggctttgcacggcatggttggatagagttatactatcatatggcccatcttgggttgggaaggagtccatctattatttctccatggattgaagctttccaaaaccaggagtttcaagataagaaaggaaagattcagttcggactcggtttgggccagcctgaatataatggactaaaacgcttgtttctctctcgtccggagtccgttttggacgtgtgagcactcgttggaaagctaacttcatggcccacgtggtggatagggcccacgacacaaattccttctggtttcaccgcaagagccgaaacaaattgacggtgctgtagagaaatttccatattgtgatgtatttgattcttagttagtttctaacccatgtaatggctatatatgcctttgtgcacgacccatgagggggacaacatttattctaatgaaaattgcagcaaatttgctcttgttcttctcctaggttttgtgccgccgccgccaaactagagagagggattgggagttctgccatagattgttcttacttttccttgcagggaattgagggggcaatagattcacttttgcgtggttaagtggatcaacctatcaaagcgtgtggttttgcgaattcatggtgaaaggtgtgttgcacgggcaacgtgttgttcatccagttcgtgaggttttacggtgtttccggatcctacgtcgagaaggtcgggctttcccccgtatcagacgcgctctatcggctgcagcatggccaacgccgcctcgtcagctccagcgaccaccaccgtgcttaccgcggcgctgcacgtggagcacggtaaaaacaacggcaatgcgaatgggtgggcgagtgctaacaacaacggcagtagctccccggacacgagaaggttaatggatgaacgttcgccaactacttcattcgcgaatggcgccacggagaagggatcgcaacggaggagaagtcggaagggagcaatattattcctcccattccaattttcggttttcctctttttacgtggtcctttatcctttttgtttcactacctttttctttttcagatttctttttttaattccttttattgtttctttaacagaaatatttttatatgaattatttcatgaaaactttctatatatacatatagattatgtatgtaagtttttatatgtagattttatgtacataaagtttctatatgtagattatatatatatataaatttctatatgtaaactttatatagaaataaaaaaatgttgatcatcaccgaattattttttttttaaaaaagtccaatccaaacaaattgtaacaagaaaacataaagcatgcgtgtacttagtattttaaccgaagaaacaaactaccggcacgttagtcattactaatcacgattaagcatgtaattaggcatgtaattagttatgaggaagaagagatgaaacggcacttggaacattcgtgagatactactagatgctaatcacgtgcatgcatatatgcagcggagaagcgagaactgttggagtccgttcgcttgtcgcgaacgctcgcgaatcagactcaccccgccagcggcaatggcaacgtcgtggcggcgacaattaataacaacataatctctattacttaaaaaatccgtagtgatgatggtgaagccaatatacacgtgtgatacaacgctcaaacatcctcgataaaaaaaacggaggggcgcactcctccgcaccaccattgtgcgactggatcacgatccggaatcacccaagaaaaacggcgccccgcaatccggaatcagatcacttccgcaacgctctcatcctgcagactcgcacacgtttcctctcccgagcgatgtaagatccgccttcctctcaaccgctgctgcgatcttctccgtatcaactgcatgcagccaccgccgatctgtcgtcctgacgccgccttcgtcctccttcctccccctcaatgagcgcctcctcgatcccttccacctcaagcgcagccatcgccgtctctccctcccgagtcccgacgaagctcacctctgcctctaccactgtccccgacccaacccgctccctcccccatccagcgccacaacaccctccaaagtccaaacaagccatcaaaacgaatctctccgcctacgccccagcttacgccctccgccgatgctccttcctgtgtgcaccctgcgtcatcgccgccccttcctccgtgtgcactacaccgcccacccccatcgcccagcgaccacctcctggtgtggcaagcatggacgcgaccagccaagcttgaagtggcggtggcagcgacgtactgacgacactaccggatgtatgtcatttaaaggcatttggtggaaggcatttctttaaaactgcctcaaatcatctcttttaaaggcaattttcataaaatgccaaaaaaatattcctatacatggcaaatttaattaatgccttcaatacttttatcattagaaggcgttttaaagaaaaacgcctcaaaaactatgtgctttcaaggcattttcattagcgccttagaaaatctcctatttcaagcgtaatcacggaacgccgtaaattttatgttatttgggggcattttgcaaaatcgccagggcaacagatagaaggcactttcgagagaaatgcctcctaatctatgtcacatatgcaaaaagaaccctaaaagaatttaaggtatagaaattagtcctttcaccactcaatcaccaatcacgcggacgctaccatatccgatccctagctttctcagatcagatcgagcgaaaaaaaattggcaaagcgcgcgactcctggccgccgcccggccggtgacttgccgccggcgaccgcaccgcaccccgccctcccgtcgcccgtcccgtcgtgccgccgtcgacggtcgaccggcgcccatcgccgcatcagcgcatcgcgttgcgagcgtcctgcgccccagccgcccggtgacctcgtgggggtgacttgccgccggcgagagccctgcgccccgcccgtcgcgccgtgacaccgtcgacagtcgaccgtcacccgttgctccatcgcggctccacacacaagcgctgcgattccccatcgccgcttcaagccctaggcccctacatcgcgatctgtcgctgcctcagacaaggacgatcgtcggcctactgcagcaagtacaaggtatgttcctatcgctacccacccttctcacctcaatcgtgataggatttgagaaatttgcttgatctattggttaggagatgtttggtgttgtgtagatgttttagattagacctaaatagaatctgatctaatcatagtgacctcaatggcgatttatagtgtgtgttattgaaagggtcaattaggcctagggggggggggtgaataggctaagtttaaaactttatgcggaagctaaaactgagatagggtcggaaagtctgatccacagtcagactatctgaaaatatcagatagtctgatgttggatcagactgtctgatccactaaagagatacaccaagcaaatctagcacacaaacaagagtagtgcaaacagcgactagatctatagcggcacaattaagcaaagctaaagagaggatgaagagatatcaccaacgatgaagttcacggagttgttcccggagttcaaatccttgaggggattctactctccgttgaggagcccactaagagccgggtctttgctaacccttttctcaagaggttgcactaagcactcctccttccactaagggatatctctttccttgcggaggcgagatccggccttcacaaacttctcccggccaaccacacgtagatcggtggctcgggagtgacacctagccttctaggagtcctcaacctccaagagtaacaaacaccacacaactcttggtcaaaccctagtgctcaagatcgagtgaaacacacattaggccctcaaacaccaaattcacaaccaccaagatccacaacacaaagaacgaggactttcagttattattggttggatcctaggattcacactggaattttggtcctatgtgcagaactgaacttttgaaatatcagagtgcaagcatttgaatgtataaatccatttgctagatacatattactggaacttcatttgatatactttgcgcagtttgtagatacatgcctacatataaattctctgaaatgctctgacatttttatatagactttggctgtaatataaattctctgaaatttgtatgtcttgattcttaaattgctgtgataagttcttttctaggaagtacagtactgaattgtgggttgtacaatacttaaattataaaatcatccctagtatatttttgaattaatccatgagttgtttcgaagagctgtagctgtacaatctgatctatatagtaaaaaaaatgttctactcttgatttagaccatatgctctgatatagatgacctaatatactgcctatatatgcatataagttcagaaacttctgtagattgttctgaaaatctgagactgcagtagtgcttgttctgaactttggttttcaatatagtatagatttggttttcaatttttgacatttcccagaacaatggctgcagtataaattatctgaaatggatattttcaattctctgaaatggctgtagcactgaaatctgaatagtaggatttgttctgggttctctgaaatctgaatatatatagcccgctcaaaaaaatatatagcttgctcgatagggattaacatgcttatatttacttcagtctttcctgtaagcaaaattcataacccaaacaacctaagtctttcctgctgatttcatatgtgttgttgctatgcatgatatcaaggcaaagaagtctttcctgctgatttcatttgtgttgttgctatgcatgatatcaaggcaaagcctctttttaggctggttgcctgattgtaatggtttgataagagtatactggacgtttctttttctttacacttttgtattctttaacagagcacaaaacataattggaacatcatggataaagggtggatgaaagcatcgagatctagtattgaatataatatcggggttaataaatttatagacttcgccttgtccactatattccacggtactagacaattttcctaattcatagtttgttactccaaggttgcaaaaatttagatgctaaatattatttgtacccaattctaggtgttaactgctgttagacacatctcatctgaccaatgagacatatctgcaccaaggagacaaatacatgatctaacatacaaggagaacataggacatgaagatgtacattctaggacaagtagtcttggaaaagccagcgctggtttttaagtgctatcaagttcagtaatagccaagtgctaacaacttcacggttctagcttatgaaagtaagtctcctatcccaagttcgaatgtcttttctcaagaccatggcaacaactctgttgtttcataataagaaatagaactactgatttggatatattatttttttactaggatttaagtggatttgtaattgtaaaatgtagcaactcaattgtagttgtttatattttgcaatgtagaagttttagaaagttgtgaagtcacaagttgcagttaaggtgaatagtcatctatgttatttcttgatctatgattccttttatggcatattggcatattggcatattatgctcatttgtttctttcccttagaacttttatggacaattataatttctgcagatacctcatttgacttgtaaatgtaatacagatgtgcagatctgcacttgtatttgcagatagcctgtctatttcaaatgaattcgtatgttgcacttgtattacaggctatctgaacatcctatttgaattcgtattttgcaggggaagcatattattttcgctgtatggttttcttcacatggcttgcaagtgcaacatagcaccaataagaattcgaagctatactatcaagattttgtacaaagtgcaatatagacacttgtgattgtgtgatcatcatatgctggaggatgaaaacaaattgcactttacagtagcatcatgtcattcttgttgattatagttttgtcctgtgactgagaaatcatcgttgttattagttttttatcataaatttgatttctctatttgagttgcaatctcatattggtatgctcacaatttgtatgcgagcacattgtggaaaagaccactaattactaatgatgcaatgaacgccatggatcttcttgctggcattttaaaaaatgcccccaatctgctagctggcgtattgaaaaatgccttcatatctcctgggtggcattatgagaaatgccactgaatacctaagtaggcatttttggaaacgcctcctaaatatctttggaggcgttttctaaaactgcctcaaatcacttttcccgtcgacagtatatttggcactttttaaaatgccttgaaagatcatttgaggcgtttaatcaggcatttaaggcgttttgaaatgcctgctaagctatgtcatcctgtagtgcgaacgcctcgccggcagccgtcgcccccacgcatctttccaggttgtcgtcgtcgccgctgctccttatgcccgcgtccaccatgctgcctcgatctcctcctccatccccggtgcccaacccttccctccagtcgaccctccccatccccggcgccgtcgtccgctactaggggcggatctacagtataagcgtcggtgtcaggcgacaccgacgactttcggcaaaacatataacaaaactgcttatctatatactataacactatgttctaagtataattagcatactatgacaccgatagatacgttatgacaccaacaaactgattttctggatccgccactgtccgccacccatctcctcctcctcgctgcacccaagtcaaacatctcgatgagcgggatcatgtggatggggctctccatctcggtgacggcggtgagatcctgcggtggcttctcctgaaggagcttgcggagaaggtgcatctcgagctcgatgccttcggccacgatcaccatgaccacaactacgaccaccaccatggctacgacaacttacagctcgagttctccccttgggttaggctttttttttttggggtttaaatgtttaatttaggctatcctgggcgaaatgtcgatttatgtttgattcattttcgcgtgattgagaaatttgggggatttgattggtacgtggctcagtgccatgggatgctcgcttctggtcagcatggcgtcgcccgtctgtctcgtcctgctcccagtaatcttctgttctgtgagtgtcccccaattgaatgtttgcttttttttttcttctgattatatgtgtgcgctcacgttctgtttctctcatttgcattttacagtccaggggaaaccatcaaagaccatggtggattgccttgccaccttcgtggtaagtatgtaattttcagtggttaaaagtttttattagtacaaaacccaaactagcaaaaacagatcattgactacaatttactcgagtctgaatgtatttgtctgctatggtaccagaaccagcatagtataccaatgggtaatgcagtttgaaattacagtacagcaaggtaatttaggtggttgttgaattccttaattgtagactaacaaatggccacatctatactaactgaatatcacgtcacatctgtgttaatatatattttatattgtgattgggtaaaaaaaagagctttacgtaaggaattagatggtgaggctgactttgaatggatcaagtactgtggtttttatttgtacattttttgtgattttcttttgctatggcgtccatttgggtgcagatttgagtcttattgttcggattagattgttcaaaatggatattccaaatggataggttgattgggattattggaaatgtaggaagagatgcagtttcagatcaagctaatcctgaaaattccacgaggtatgatttacgtctttacaaattttagacaaattgacactctcttcgttatatttttcctgtgcaggtcatgagacattgcacaatttggttgatgaagccctcttgctaaaggtattgcataatcaaatcaagatgcaccttgattttttttttgcataagaactttaattgttcctaaaaaagccatgaagttacaagcttacgactttggtttttttatcaatgaaaatcattctatgaatatgtcaacgtgtatttcattgccattaattatttcatttttcctttaagctgagatattgttcaattttggagctctagacaatgaaaccatggcttcatatccttgaaaaaactctatcggttgaatccagtaaaaatgtgttttctctggcattttaaatattgcaatgttctgatgacttttagttactaatatatgatgcataattctatgcccggttctgttatttctttttatttggacgtaacttgcttgaatgatttgatgtggctaaggagaaaatttctaaggccctgtttggtttctcaggaggccaggagttggagccatgcaaacttgccttatgctaatgtcttcgggagctttaagattaggccctgctgcattgatcaaattaagcaggtcagttgaggctctaaatttgcttgcaatccagaaggtttccaccaattatagtgataaagcatcaaactcttatgatcaatgtttctttgttccgagcttactgccatagtatgttaaataaatatgctgcgatgatttaattatccaatcctgcgagccgacggacgcgccaccgccgcctgcaaatcctacccctccgcccgtgcccctacccccacccgcactcccgcatccgtccctccacctccgtccgcactgcccatgcctccatcctccaagccccctaacctataataagaaggttaagttagtttctcattgtttcatattagactgtccaagccccctcccctataaaaaatgtcaagtcagtttctcattgttttatatttggctgtattagttatgttttggtttagtttgattcatagcaaaatgcagtatgcatgctggactttgcaaatcctaattgtagacagcaaaataatgtatggactgttatttggtcttctatgttacaaaaaaaacccaaatattgtgcacctcatacgatatattatgcttgctaggtaactaatagcactggaaactgaaggttagtatgcatgatttggttaatagtgacctgtaattataaatggaacatgtatgctcaagctagatgagtgcgctgcataatctttgctgcagtaaattatttatgcccggtcttaaatcaaatgaataatatgttaaggctgaaaactaaaaccgatatgtgaaatataatttctggagtcatatgcgtagaaaatattccacatatataataccttattcatattaccttgctatttttaacatagagcaaaactttcagtaactgaatttgcgtgatggcattaaaaatgtgttgcacaattcagggtgatgagacaatacacttttttttgtgctgttactgtattgtatttatgctcccttcactaagaaatgtaagacatggattgtcatggtattctccataattgaacttgtctagatattgtgtagttctttatgcatcaggtggtattgcaaaaagagaaaaacataattaattcttcaggatctatgatgctgaattggttagtccatgttttgcactgttattatcactgatatggaattgttctctcagaactcttagggatcatccgaagattgaatttgaaagagcagtggactgatgtgctacctcactttattacttttgcatgctctaagatcaacaatctctcatgatagatagcatatcgcgtaatgctggagatgtggatggagataagtacattcattacagatgaactcgtggcagaaatttcttgatggaaattttacatttatcagaacggtttgtatgcaaattatgtggcaaaaattaacagatgtttgatacatgtctttaatgtactgtatttgatcatttcaattcagtctctatcctttgatttaaaaatgtagtattcatctgtaatctatggagataattttcattttgtaatatataatagtttgttctctgtatatagatcatgattttttatgatgtccagaagattgttacatgtgaataggaaaaaaagggaaatgtcctgttgtttggagtgaattggtgatggttcatgacaatgccaatatatttttacgggagatatgtgatggggagatatgcagctcatccatgacaaataccatatctgggtatgtttgatgttctagattttttgtttgtgctttaattagtatgacatcattaaattttcatagcagtcttctatctatattgtctttttatgatttcataaacaccatgaaattgttttgtacgtcagaaagcttgcactctgattgtagtggtaacaggtttcttgaattggaattaatctacataacaattttgatttgtagtctctttgatttgccagatttttttcaatgttcaacaaattttcacccaatgattatttaacatctttttacttgatataatttgaaattggtactccctccgtttcaaaatgtttgaaaccgacatgtttgaccgttcgtcttatctaaaaaatttgtgaaatatgtaaaatacatgaaagtatatttaacaatgaattaaatgatataaaaagaataaataattacttaaattttttgaataaaacgaatggtcaaacacgtactaaaaagttgaacggtgtcaaacattttgaaacggagggagtatatattatttcccgttgcaatgcacgggcacccaactagttagttaaaaacgcattgcatcaactcgtgctgcgtacttgtgcgtgcacatgagcatgcaagtaagcatcgttgtctatttgtctgtacaatccgttctaatcgaacaatgtcacatatcaaatcttgtaattttgggatcaaaacaaaggcagacatagctgttggccatgaaccacaaatacaacaacaacagaatggccgctgccgccgacgacatcggcggtggcaagatgtaggtgcagtacgagacgccccatttccaacggccgtagctgcagaaccagaacgttgtcgtcggccagccaaatgtgggcggcgggcgacggtgctccgatagcactggcaggccctccgcagcctgcagcaacaagtgggacatctttctcggtctgcttccagtgatgacgacaaagacgacgacatatatacacctagaaatatgaggaagcatgggcatttcggtcactgcacgtaaaatatcggtcacttagcgtctcgtcagcacgtatacattattttaatcgacgcggtgtctactggtaaattaccatgtttatggagtgtttcccccaaaaatgagttcgtgcgatgttctacggctaaaaccacaaagtcgtgatgtcctatagcaaaatttgtcttcaaaataaggactattgctggagatgaagtaggtctgagatagtgtgcggtctcacgtccatttccttttgttttccaaaaaaaaatccttccgtgagtgtaagggcgcgtcgtcaggcttactgggcatgtttggattgatgcccaaaatacgcctataagagacaaattcatgggcaaagccaaatttatggcataagtagtgttttaatagaggttaaaaatgtccatttgaattgaagccaaaatatacctataagagataaatttatgggcaaaaccaaatttgtagcataagtagtgttttaatagaggtgtttggtttgctaccctaccacaattttggtagggtaacgtttggcaagaaaacaagttggcgatcagtcgcgcgcccccctccccgcgtgactggacacatgtcgcgcgtggagagggggcggcgacgctccgcgcgggtgaggaagagcgagttttccgttttttttttgttttttttcgtttttccgtttctgttcggttgtttttcctttttttccggttcggttggtttatctttttttttctggtttctcttctgtttttttcccggtttttttaaattttatgaatacaaaatttgtattcgtatgtataccaagtttgtatttgtacgtatacaaagtttatatacgcgtatgcaaagtttgtatacgtgcatataaattttgtatacgttgtgtattttttattttttaatacatatgtatataaagtttgtatttatagtatacaaagtttgtatatgtcctatgtaaacttcgtatacgttatatatatatatatatatatatatatatatatatataaactttgtatatgtgtataaatttatatacattaaaaatatatttatatatatacgtatgtacatactatatatacacacgtatatatacacacgtggtgtatatataataactaatataaatattcgtatttttccggtcgtcacatctaattttcgtctgtctttttctatgcacaatccgattcggttagcaatagccatggaaaaaattgcaaaaaaaaaaatggcggccaccgacaccaccaccaccgccgccgccgccgccggatccgcccatggatgaagccgacgccatcacagccgttgggagggcgctgtcgccgtcgaggccgacggggagagagagagggggagggacggccgtcaccgccgtctccgccgcaccccgccgtcgctgcgccaagccggcgagacgggtaggagaggggaagagggagcgcggccaccgcgaacgccgtcgtcgccgccgttgggacggcgccgtctccgccgaaccccgccgttgccgcgccgagccggcgagaagggagggagatgggaagggaagcggcgccggtggcgggagaggcggctgactggggggaggggaagaga

SEQ ID NO: 22983 - DNA, 4509 bp, Oryza sativa
ggggagggatggggagggttagggttagggttagggttttgataaggctgtgggccgaccgggatggaaataagtctattttaggtccctcgggctggaaataagtctatattaggtccctcgggccgaaaaaaagagaagttcatttttagtgcttcattttttcagaagcatttacaattatagttattgaatgtgtttatttctaagcaaacctaaaaggaaggattttctttctttttccaattaaataattattaaatgatgtttgtattattaaaattagcaattaagctctgaaaattccaataaatttccaaagagcgtaactaatcatggagaatttaataaaattaaatttaacaatgtcattttatttctcacactttacttgtaaatttatttaattatacacatacctccttaaaaatactaaatatttcagcgaatttgtattttaattaattgcatattttttctgatacgtgcgcttcccggtgcaatacacgggtacttttgctaaaccaaacaacaattttggtcaatatacacactccgtaatcacccggtacaacgcacgggcacttttgctagtactatatacatacgtatagaagtagtagattagatacagagagactagagaaagagggagactgattgcgcgcgcgcctccctgcgcggctgatcgcgtatcagccgtcccgacgtttggtagggtagcaatccaaattggcccactgtctcctttcccccttcggatcaaggctgacggcgccccggtccaagttgcgcagtgcgacgtgggtcggtgggtgcgtgtggccccgcttgcagcgtgccggcccccggtcctgcctgtctcgcccgttccccctgcgccgcccctcgccggcccgcgcacgcgcccaagacgcacttggtggtccgcgtcgcgctcgtctctcgcgtgcgctgcgtctcccctcctacccctgattcgcacggaattcctcgaatcgcccgtgagatccgcttgattcgatctccgattcaggccccggggtctagggttttcgccgccgttcgagcggagcagagcggggcgtgggagatggcggggaagggagccaaggcgacggcggccaagtcggcggagaaggaaaaggggaagaaggcccccgtatcccgctcatcccgcgccgggtcccaggtaagttcgactgctcatcctctccccgcccccgctcgtcgcttctccgtcgttcgtggtcgctcaagattcggtccgcctgctgccccttcctgtgcattttggtgttcccacaggcgccttgggttcagctattgctctttctaccgctttggttggaattgcgcgttttagcttggtgaaattttcggttggagattacagttgtttgggtcttggaaattcgacccacgggagatttcaggctttcaacagatctggaaaaccatatgttatgtctggtgctattatttttgggctgtgagatttggttttctcgcttgggtgcgagaggacctgcacggactggtgggtttcggtaggttgtactgtgggtttagttgtctcaaatactgtccgaaattctgggtgctcggcttagtattctcgtgttggaatctctggaaatggtagtcttatcaaatgagcctccagtttcttgttcactgtaacttgttatttctcgaggtggcaacatttcagggatctcaacatggttggatgaccatttaggatacattttgctcccgcatagaccaaaagctgattttgtcttcatcttgaattcattgtagcaagttaatttatttgatagtacctcccttcgcttcctagcacaaatgcacaatgcatatagaggttttctcccatccctgggaagtattatatatatacctccccaccacttgaaaggcacaagacttaaaccggctgaactgattagagcaaatggatgttttcagaaatgtcaggttttagggtcctttgggaggtatattgtgtacatagtgttgttaatcaggtggtatataccttttagtagaggtattataacctcatgactaatgctaaatacctatacctcggacaaaaagtcaggagccaatgcaaatgtgaatttcctgtcctatccccagttgtgatcactactgggaggtataataccctctcgcatataactagaagattataataatctgttaatctgctcaatcatatgtaggagaagccagctccaaacaaggatgtttaccaactatttgctgagaaggttagggataacaagcagctggaatcaagatgggcaattatgcaagaaactcgtgttgagtatttccgtggaaaagattttactaccttcatgaggaatcatccagaagttagggaaattttagggccagataaagatttagaagtggaagacattgttaacactctgctgagcaagaaccttgtgataaggtgtgaccgagtttggaaaactgtcagaccaggaaagaagaaattgtcatcgtggcctgcacatttggagatacatcgtgtaagtaccactgctaatgaagaacattgtaggttgaactttctgttgatcttgttgatgtactgttgtatttttgatgatataatgttcctaatatttctattacccttatccacaatagtattacatttttatggcaatcacatctttgttctcttggcttcaagtgaaggttttcttgtgtcttggtgatttctgttcttgcttttaattcctatcatatttatcctgtatttagtttgaaattagataacgactgtatcaggtgaaacaatacatgtatcaactagcacatttgctccattttgcatcgctttgaagctttttttttttgtatcttgcttatttttgaccatgtaataaaccagttatgcctcgcaaattcattttgcttgaaaataatgagtggtgatttcatgatagccttttttcaggatactattatcctcagtagttctaatgtgagcttgatttattcttgcaggaacaagtgttcactgagaatgatggattttttgcttggatgtttctcaaaaggaggaccttgtggcaaacgattctttcatttgtttggcctctctttgctttggcagtttgcttatttccagtttacccataccaatgcaagattgtggtcttgtactcatgtgctggagctttattgttcattgtctctattcttttgtgtaagcacttctctctaacactgtcttttatgctagaaatattagcaccattaactaatcaaggtatttttttttcacgagtacaagacagacaaaacaaaaaataagcttatgctctccctagtgtctattaataatatgtacaatgcatggatgcccttgtaggcttgtactcgcatatgctgttactgcgttacctatgataaatgagacataatttagtactcatgtaactgcaatattttgctatatcatttttgtagttgcatcatcatgttctggagtaaattttattggagtttatgtgctgcttttaaggacgttttgtggcattatctagtagacctaaaattgcttgtgagcatgcaacgttctatttgtatttactgtttagtagtacaaacaactactgcaacaatgagtaggctaagcctgtctagcagtctatctcaaaatcatgcttttagctaaaaactattaatcgctgactatgtttgacagcttgggagtgtgacaaaaatgtgatttatatttttgttagactggtaggtttgaaagccttggaaaaatgattactaaatgacctctaaacctttgagatatgcaataattctttgaaaaaaagagagtaaaatgcactagtcataccgcaacatgtgaggtgtgtgcaatttagtcattcaaaccttgcaaattgctcagaaaagtcactcatattgtttcaggggtgtaaatcacatcaaacacatgccacgtgtgctgtttgcttccaacatggatgatatgctagcctaacattgtgcgctcatgagccacatgggcatggcaagctataaaaatgcaaataagtccgttgtttttcgtgcagctgctgcatgcactcatgagctacatgcagttgcatgaaaaatacaggactaatctgcaatttttaattttgtctaagcacctaaacttgtcctgtccaggtggctcatgagacatcatgttaggctagcatattgtccaaccttggtagcgaacagcccaacatgtcatgtgtacgatgaggtttgcacccctgaataaaaatgagtgactcactttagtaatttgcaagatgaatgactaaattacacacttcacaagttgtggtaccactagtgcatctaactccttaaaaaaactgttgcttgtgatgaagtagattgttgttactagaaaatactccctccatttctaaatatttgacatcgttgactttttagcacatgtttgaccgttcgtcttat

SEQ ID NO: 22984 - DNA, 581 bp, Oryza sativa
aggatttttatataggttcgggcccctgagttgtcaggtaataaccctacatcctattggccgaagccggtattgctcttattcaccataatcacaccaatacaatatgtgggtagcctatctaactgttgtcgacatgtcggtctgaaggtttgactcgtagtcgacaacagggtagtcttactcctcggatccgtgcccggcgagatcagagatagcgctttcgtatctcctgacagtatccggagacaccgtaggggaatagccatgcctatccctgaagtcgatatccggcggcgtgtcttggcgtatgtaggcttgtatgttgtggcttctggtgggcgtgtgttgattgtcatgggtgttttccatggtcctttcccctctcctcctagggggtcttgtatttatacccataggtgtccccttgtccaagtagaactagggaaaccaatatggatacaatccgagtagtccttgtcgtttccatgtagaactctggttgtctttccttatccggaactccctcgaggccaattttcgtataagacatggtatgtggtggatcctgccgagattta

SEQ ID NO: 22985 - DNA, 12002 bp, Oryza sativa
  unsure (1)..(12002): unsure at all n locations
caatggggagtcatctttatggtttatttagactgattttgctaggactacttcatgtcaacaaattgagtgaatgatttttggttggatgattgctatatctcttaaattagattgaatgttagaaaatataaatattgtttcctaattttgttaggtgcttatagaccatttgcaaaagcagaactaattagttgggcatatagttttgtcgatctcttagaatgggcaacatcttgcatgagcatgtactggataactggtcaatgtttctaaattctaaattcataaatgcgagctagcataggcacaatttgagcgctcaccataacacatgtcccacaggtggtgtcgaggcactttattttcccctggataatttgatttcttgatctaagtgctaaattgaagtcttccacagcccatttccagctgagtctcttcctaaaattttaagttcaaatgaacccattagtgtttgtctcgtggtaccttacttagaaatactggatgcttgttctaagttgtactgacagattaccatcaattacacactccgtgcacaccaactaggccaatgtcacagaaaattctagaaaaatttgacacatacttccaatagtattacatctacgtgtaaaatcttatcttcaaattcattatattttagctgtaacaaaaaagacaaaatcctgacagatttttacccttaaaactgttagatttttcacttttttgttacggctaaaatatactccctccgtcccacaatataagggattttgaggttttgcttgcaacatttgaccactcgtcttattcaatttttttttgcaaatataaaaaacgaaaagttgtgcttaaagtaatgtagataataaagtaagtcaaataaaataaataataattttaaaaaattttaaataagacgagtggtcaaacattgcaaacaaaaactcaaaatcccttatattatgggatggagggagtaatgaatttgaatatgagactttgcagatatgtgtaatactattaggagtaaatgtccaatttcttatacttcctccgttttacaatgtaagttgttctagcatttcccatattcatattgatgttaatgaatctagatagatatatatgtctagattcattaacatcattatgaatgtaggaaatgctagaatgacttgcattgtgaaacggagggagtagaatttttcgtgacatttgctagttggtgtgcacggagtgtgctgaagcttgtgtgcaaatgatatgttctccattctatatcatattctatcagttgagtaatcatttctcttttttcctgttactaggtaccagaagaaggtttcgaacataattgatgatgttcttgagtggtctccaaagttagctttgtctgggatgatggaaaaacatactgggactaatgcatcagaaactagcaatcacaccagtggaactgggagtagtcctgtccctcccactaatgaagggaataccgcaaaagcagacccagatatggatcgtcagacgaactcagataaagtccaagatggtgatgagtatggtgatgacatgagaacaagatttagtgaagtttagaatcgacttataaactctaaagctctggtaatttggagtacttaccctcggggatttatctgcagaatcatatagataggttactgacaagttcaaattcagggtgctcatgttttgaccatgtttcattcacatattgccagcaatggctgtattacgaggttctcaaagcatattttcgcatggctatgatgtaaacgtgcctcgagtttgcccgagttgagaggttgagaatgcaatgtgtccgtgtccgtgcgtgtgagccgtgtgccaccgacacgtcctgtggcagtgagccaatatgtcttgcctatcgttctgtggctgagcctcagcaggcttgttacattcctcacactgatgacaccttgataagcgcatatgcccattgttcacatcccttgtcccttttttttttatgggaaccgatttcattactatgacggcccggccaggaataagttcatccgaggtctcccttaatgtcaccgaatctgattttcgtccttcaaccggaaaactacatcggatccctcaactattaaaaccggtgcagattaggtctctcggtggtttggaaggcggttttcattgacgtgatgtttatgtggctgatttgactaggtctttatcctatgtggcattgatgtggcgcttacgtggcaattatatatcagaaaaataataaaaatagtggcccacatgttagctacacacaaaaaataacctccctcactcctctcttcttcctttcccctctctcttctctctctcttctttcctggcagcggacggcacgggtgggtggcggagcagccaagcgaggcaggctatccgagatccagcggcggcggctcggcatgcgccacggcggggatgtgggacttggcgaaagggaaggaggcgaggcgacgggagcctcgaccaggggagaggaggccggcggcggggtggccttggccttgggcggcggcacgggcgccttggtgggtggcgcggtggccggagccggggtggtgggtgccgaggcgggggccggggtggcggggggtggtcggcgcggcggcgggcttcttcttggaggagaccggtggtgtggtggtcggctccacccgccgtaccgggaatccatctcggaggagctcctcgagaacattgtctcccgcatctccctctgcgacgtcgtcctcacctcggcgatctctcgttcctggatccaccggtgggagtctgcccctaatctccgccactagtggccccaccgcttgcgccccgatctggagcggcggtgcctaggtggccgtggcgggttcccttccaccaccagctcgcccgagtggctcccccagcctcctccccttcccacccccgcgccagcattgcacagcgtgggcgacttggccgagccagcggacgaggaggacgacgacgacgtggctgcggcgccaggccgcagccgcagcaatgacaccgtcgagccaagatctgcgaaaacatcacgcttggtgtccggcttgtccctcccggcggcatcgtcgagagccagcgccgcggattctgcgccgacctcgaccccgaccacacggtggcttcggcgccgaactcgactgcgccgcggccgtcttcgtctgcgcctttgagctctagcgcaccggtcgctctgctccacctgccacccctctgctccgcccgctgcccaccaccgctccgcccaccgcccctctgctccgcccctgctcgcccgtgccaccatcgcaagagaggagaggggagagagagttgaagagagggagatggggagagaggaggaagaagagtgggtcaagaatgacacgtggggcccacgtgggccctactattttttaattaatttatgtaaaactgacatgtgggtcccatgaggtttattatttttccggatcgaatggccacgtaagcgccacgtcggtgccacgtcagatcaagaccaagtcaaattagccttgtaggcgccatgtcagccaaaaccgtcgagggacctaatctgcaccggtttagatagttgaggaacctgttgtatctgtatctggttttgcggttgaaaaacgaaaatcgaattcattgacaagttaaaggaccttagatgaacttattccgcccagccaaatcactggtcaccaaacactctagaccaggcggggtactggcccagctaggggagttctgcaaattacaacccaacgctgccaattcgtgcgcaaccttattacattccgtggggcagtaacgaaccgagaaagaaagaaagcagctggagatgacattcttaatctccaaaatcacaccccctaaagccgacaaattaaaagaattctcgtggagtgccgttttaagcatcatcgagtccgtttccagctcaaccttcatcattcgcgggtacgaattacaccacaaaactatcatgtacggtcgatcgaattactcccctaaactcgaataccggatattttacaacgtcaactatacaaaccggacaaataacccctctagctcaatccaaagtagttttaatcctaagtggctgtccaattagcaaattttttttttaaaaatagtgtgggcccgacctgtaagtctccctatctatctctctcctctcacctctctcaatctctctctagtctctactctctcttcctcaatcccgattcactctctctctttctctctcttctccctccctttgctgcagcgagcggcggcggccgacagagtcggagcttgcactcgcacgaaggtggcgacaacggtggtggagccaaagctcgcatgagtggctggggtggcgaggcgtggctggatgggcgctccgatcggcgacaggcgctgcgacaaaaggggaaccagtcgatggtgagcggcggtgggtgtggatgggagggtgctccagtcggcagcgcgtcgggtctaggtgtcctcttcctcccctccaggaggcacaactacgaggcgagccactcgacgaaggagccgaggtcagggccaaggaaggcgttggcgtagacggtacagtggtgcggcccgaactgcgccgcctgttggtatttcttacgaccacagataaatccgcaagcccacggaataccgttgtaacacttcaccttcggatgaccccaaaaggatatcgaactcagagaacgtgtgtactctacctaatgctaagactatccaaggataacaactactggtaggctatctaggctagagaggattttctatgtgttttaattatctaagcgaagttgaaagtaatttcctatctgttgcttcaggcaccgacccttgttggtctgccagtgtggttccggctatagctttatgatgtatccgaacgtggaggattactatgacaggatttagggctgtcaccacctgctgtctacctctgacaaatccgtgggatacacaataaacaatggtaatctctaacctaaacaccacgtttaagttattaattactactctaatacttgcacatgaacttccttctttatccagagtcttagtagtagagcacttagtacaaatactaaataatgaacccgcaaagatgaaaatctatctcacttagactaagtaattaaataaaaaaaaagatctcgaatgcttactttatagaaaaagtttcttcgaacccggagcagagtgtactgatagcttcggtacaactccaaaattcttcctagaaaggtaaactcatcgaggtagaagtcggagagagcgccaaactttcaggcactcctctagagcttcccctcactctttacctattttctaatgcacaaaagatacaatagagcctcttgtaattcagctcaaagttgtttgttgtgaagtgaagtgagctcctccttttatagcctctatatgacggttacagctatgggaaatgtcctaaatgctctgcaaccgtcattgggatgtcatcagcagcgtacacgtggaaagctaggatcaaaggtgccagtggtggtttggccgaaccctaggcgccacctcctggcctctcctttggctaggagaccagctgggggactctgatggcggttatgacagttatgacccattccatggtggtttcacctgacttgggggcacttcaatccgtgtacatgcgtctgattggccggatgtatgtttccttgtatgacggttgtgttttctccttaaaatacctgcatacacatatttcaccaacactagtggagttgattagtaataatccctaccactaagttggataccatattttatttcattatatgcaggtattgatggtcaaatattatgatttatggaccgttaacaacacccccacacttaacatttgcttgtcccaagtgaaggctatggactctacaatagagttatgacttccttactaataatcatgtaaacaaattattcaaagccatacttgtacttgtgggtctttgtagtgtctaccaggcgatcttgagcaattgagaaatgtaccaatcaccctagcttttcatgaagaacaacttgagtttttttcaagtaacacaaaatttataacttttctttgctcctcagttgattctctcgatcactcaaggtgtatgattcctcacaaaggcacatgattgtgccttttcttttcttaccatctaataaggcttatgtggagttcagagtatggaaaagagtagagcattacttgcgtcacatatattgttaagtcaaataatggacccacggaaatgcaagacatactttcttgtcaagaagtgcatgtgtatgtgtatggcaaatttgtgggttgaaaaaggaaaatactattaataataataactccttttgtatacctcctcctccatttattttctgttttgaaattttggagagtgcatggttatctttttttttctctttgcctttttttccttttgtctctctttttttttttcatgatattgctctatacttgtaggcaaattttgctacaggacaccgtgactttgcagtttgtcatggctcatcacttctagggtgatcttgctttggttacggtgttgatgtgcaagatcactcacacacttgtctttgtacctgggatgctttattggacataaaaaaacaaagacaagagtgaagcaaaaaggactcatttggttggaagaccaggaagccaactttattttattttattttactttatttttattttaatagctagacctaagataactagagggtggcctaacgactcaggccattgaaaactaacggatcaagggggatctaaggactccgggtagaagctaaaagcgactaggtttactacgtctaagtcatgatcaacttctaacggatcaaggaaaaattttaaacgatggccatttaccttgaaagtgttacctttgttgtctcgttgtgtgatggctccatgtgatgaagtgtcgacgacggtatatgggcccatccatttacttcgaagttttccatgtccgaaaagcttcacccgtgagttgaacaactgcactttgtcctctgctttgaacaccttgtgcttgctctgtctatcatgccatcttttggttttgtccttatagatcttggcattatggtaggacttgtccctccattcctccagcttagagagctacatcttcctgagctgtccagctccctttaggtccatattccaagtccggatagcccagtgcgccctgtgttccaactctactagtaggtgacaagtcttcccgtagacaagttggtatggtgacatgataatgggtgccttataagcagtcctatatgcccaaagcgcatcaggtagcttgttcttccatgccttccccattttattgacagtcttctacagaatattcttaatttgtttgttgcatgtttctatctgcccacttgtctggggatgatatggagtggcaatgttgtgttgagcctcaagctcttgcaaaaagcttcggaaggtcttatcgatgaaatgagaccctccgtcacttatcaccatccgcggagttccaaaatgagggaagataatcttgtggaacatccgccgagcgtgcttggcatctgcgccttgcatggcattgcctctacccacttggacacatagtcagcggccaccatactcgtactcataggactttgggaaaggttccatgaggtcgatgccccatacatcaaataactcgacttgaaggttgtatgtcagtggcatcgcatctagagtagtaatccccctatgcttctggcaccttgtgcatcttcgaacgaatttctttgggtcatcatacattgttgtctaaaagaatccactctgccagatctttgcatgtgtcctgaatgctccatagtgatctccatatggggcagcatgacacttttcaatgattttcatgccttcgtctgccggaacgcatctccgtagtacgccatctgaacagactctgtaaaggtaaggtgcatcccacaagttccagcggctctcgtagatcaacctcttcttattttctcccagtgttacatgccccgcgaccatgaagttgatgatggttacataccacgggtcggagtctgtgactttcaagtttcaacagcatgtcatctcgtagatagtcatttatcggtagctcttgcatgttagtgatttgcatacgcgacaaatgatctgcaacaaaattctccactcccttttttatccttaatttcgatgttaaattcttggagttgaagaatccacctaattagccgaggttttgcatattttttagtgagcgggtattttagtgcagcatggttagtgtaaactattaccttagctcccactaaatatgacctgaacttatcaatgacaaacactacagctaggagctcttttttagttgtggcataattaagctgagctccagtcaatgttttactagcatttgcgatagcatggtcagtgtaaactattaccttagctcccactgcaaagttactagcatcgcacatgatttcaaacggctgcaaccaatcagagggttggatgactagtgctgagatgagtgattccttacagatgttaaaagattttagacactcatcatcaagtcaaacgggacatccttagctagcaccactgcttgttgcccgtaaacatcgtcaagacggagccgttgcacaatctgtatgccttcgtctcgtcacaccgaagtcatcgtgaggcctgtgattatgccgaaatgagatgttgtccgtccgtggtgcttttcccctctttgtcaagaatcgatgcagtctgtccgtggttctctccctttccgtggagtatgacatcgtcgctcgtccgtgtattggagggtcgcttgtctacatcaacatgaagcaagaatggtaccgtctatgatgccagggaaccgttcgtgttgaatctacaccaacaatgtcctcagccgttccgccgacatggcatttacttcttccaaggtcgttgttgtatttcttaacgacattactagaaatataattccaagtaatggcacagaaatactactggtatattatggttacagagtttatccgcaagcgcatggatataccgttgtagcatttcacccgagagtattccaaggtatcatatttgtttaatcccgtgggaagattataatagagagaaccgtactaataatttatatattacttgtaataaccaaagtctaagcaggggttaatataattcatagggtagagtgtcactaagcagaagcagtcatcctcttatttatgattatctaagctaagtggaaagaatatagaaagatcatattcctatacttatagtatacatacatattatacatacatcctaattatattattacttagctaataccctctatccgatgccctcctgttgcttgttgacggtcgttagcgatcagtttcgactgtcaatattaccaaaatagagaactagttatggttgcaatgcatattagtgttagaataataatattccacgtattgggtttactaaccttttgcagagaataaccataaagtggaggagaatcaacatcaaattagatgatcaattaatcggacgatgtcgaggatcagatttatgtatgaatgggccaagaacttagaaatgacacgacgaattgggccaaaattcacaagtctgtggaggagagcatgagaggaggccaccaaccaaaatttgggctggttgggccggcccctggttcggccgaaccttcctcaccgccgttcgatctaggtctttgcctggacggtgtagattggctccgaacgggtatttccgaccattccaaccatcacaaccgtcattgggaagctataaaaggagctctcatcctccatttcttgacatacttcaagcaagagctctctcatattctttctagtttagtttagtattcttaagcttgtggagtaaggatagaatagaaatctgagtccagatgtaagagccttaggttcataccaggtatttagaagtgcatttgttgtcctttagatttcatatttactatactgcaatttgattatatgcgataacaaagttaactctaatcggtaaaattgaaaccacttctatttgattaataacttgaacagaagtatacatgtttaataatttattcaaatactagtttatttatcaccaacaaatataaattatgtggaatttttactctctgtttaggcctcctacaaatccaaaccaactttcagcctaaccaatttcatcttttcacaagatttcaaatattaggaatttatgtgtgaaactttgaaaagtggaacctataaaccaacacctatcaccacaccaaattcctgaattgttgaacaaattttacctaatcaaattgaatttaccaagatagggaaagaaaataaatcctggaaatttcaagaacgaatctatactcagtttttcacccacctcgacttgggcccacttgtcactgaccttgggtgcctctttagccccacaacacacccatgggtgtgttcccacatcaggacttaagggggggcagagaaaacccattcttcttactcccctttcatcttcactgcttgctctttcttttcttctaagctgagctctcatctcacttctcctccccaaaccccatccaatagcccaagatcaatccctgcatgttagaccacaacaatccccatcatccaagctttccatccatcccaacatcttgcacatgcatggagacttgagagagatcgagaaggaataagagagtggtggtttcagcctgcagggctgcagaagcagcattttgttttcctccttttggtgagcttccttttcatccatggtgcctcttttgaattccctccatgttgaacatttgtagcaacgttctataggttgtccactccattactgcagctagaaggtggctgcaactcaccctgagttcatcttttttgatttcggttgaagcagccctacgcaatgtctcttgccgtcagcccgaggcctagctccgcctcttgccaactgcccaaggccttagcctcgcacaatcttacgtccaggttgctaccatgtgagccaagtccggtggaagttggagaaaaggggagtgaaaatagaaatcgatttctaaaacaactatcggactgaaagaggtatgaactttagaaatccataactaattcatatgaactccgaattcagtgaaccaaattcctatagattcataaacagagctcttcaatgttgtaaaataaaaatgaccaacttttgtactggttttcccagtaaaaatataaatagctatatgtatcccttgtgtctagctcttaataaattcgtatgaaattattggtaaaatctaaaattgtgcaaccatttttgttgagcttatattttagtactctttgctgttgtgaaaatgattttgacaaaactacctcttaaatcatgtttaggagtttatttagaattcctatgtttttaacttgtaaaatccttaaataaataatgacaacacatatagctttgaaataatttttcttaggacctgtgaatgatgttcttcccataaaaataatcatacttgtaaaaacttggtttgagttgcaagattcttggaatgctctaaagtagactcaattatttgcaaaactgccattatatgacctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22986 - DNA, 2198 bp, Oryza sativa
tgcgttcgtggcaaaaactcacttcgtgattcgcgcgggtacttttgtcaattaataccaatattggcatatgttgagaccccacgggtgcggtgtttttgaccgcattgaataagttcaaaaagcatccaaacatgaattttggacatattggagtgtattgggtgcgttcgtggcaaaaactcacttcgtgaatcgcgcgggtacttttgtcaattagtgttggcaaaaaactcacttcgtgattcgcgcgacgaacttttgtcaattaatgccaatattggcatacgagggtgcaatgtttttaaccggaatgaaaaagttcaaatagcaccaaaataagatttttggacatattggagtgtattgggtgcgttcgtggcaaaaactcacttcgttattcgcgcggcaaatttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcacggcgaacatttgtcaattaatgccaatattggcatatattgagcctccacgggtgcgatgtttttgaccggaatgaaaaagttcaaaaagcaccaaaacatgatttttcaacatattggactgtattgggtgcgttcgttgcaaaaactcacttggtgatacgcatggcgaacttttgtcaattaatgccattattggcatatattggtacacgtgggtgcgatgtttttgaccggaatgaataagttcaaaaaccacaaaaccatttgttttagacatattggagtgtattgggtacgtccgtgtcaaaaaatcacttcgtgactcatgcggctgatgaatcctgagttccacatgaaactcaaggctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcacgaacaagataaaagcaatttgaattgcaaataggaataaatgcacacaataagttggggtttcggatacaagcagatggacggtctagccgacacgcgcgctgcaaggaagtagcaatggctaaactttcatctaaacaaaagccaactaaccctgaaggggttactagctatttaagggatgtaggaggtcagaagggcgtcctccctctgtttggagcgcaggccccccttgggccccacttgggccggggtcccagacgaaattacaggcccataggcccattacagacaatgcagccccttgtttcttcaattgccaatgactcagatagaatttgacaatgaggttggatccgttggaatgaggattccgagagctttctatcaagtactcgtgggcctaaaatgaaggccatatggagatttggcgaccgtttgaattcagcactatctcaagtggtcgaattggattctagaacgcggcggacttcatctccatctctgcatgcaccatggccgtcgtctttatcttccatatgcagccccaaataagtggattggtgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgtttttcctccctcccggcctcccctctcactcaggccgacaggtgggacccgtgggccccacctgtcatctccaacctccagcccgggccggcaactgccatggccgccgaaaaccgcccacgtcgccaccattcccggcctcctcgagccct

SEQ ID NO: 22987 - DNA, 13871 bp, Oryza sativa
acaaaactccgccgaaacaccacatccaccgtgcacccgagccacagctgcctctcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctctccgccgccaccgtcgagtccagccgcgtcgcgccgcctctccggtcgacgccgacttgtgccgccacctccttcggcttcgtcatctcgagggccccgccggccctcggccgcgtctccgccatggtcgggtgtcgccggaacgccgttcccgccgcctctcgtgccagtcgccgccatcctttccgccgccagccgcctccctgtggtcgtctcgccgtcgccgtcctcggtgagaatccccaccgtcccttctcctttttttttccctcctccgccgctccccgtgcccgctgccgcgacgcgccgctgtcgccggcggtcgtctggccgcacgccgccgcgcgctatcgctcgaccaggccggctgtgccgtgcccgtgccccagccgcgccgcctcgtggccgtccgatcggctttgggccgatccgagccgtcggttcccgtggaccggcggtggaccgcctcggtggttccgatccacggtggaccggcgcccttgtgccgctgaccggtgggcccgcttgccggcgccgcccctcccccttgatgacgtcagcgaggtccatttcctttgtaaaaataaataataattgcgcaataaatcgagtttaattatagaaattcatttaaatggctcaaaacttctaaaattcatatctaattcattcggactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacacggggtcagggtttacctatctgctcgcttgtgccatgtttacttgatatctgttctttgtcaaccttgggtaataaattgactagctcgtgttacttatgtgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcacccatagcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgcctttttaggggtgggggtgaaaccttagcgtggtgtggatggttaggggagggttatgcgaagggtctcgtcacaatcactcgacgtggtgacgtgtgcatcatgggcacatgatgacgcggtgacatgtcggtgggttgtgtcttgtgggtacagttgtgcacctctggccagagtaaaactattcgaatagccgtgcccgcggttatgggcgctcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgccttttttcgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaattggtcctgaacatataaacgcatacattatgaggtagtgtcatattcttgattagattaaattggcacttgttatgaaacgagaccacctgtgggtatttgacatgatcaatggttgtatccgtcgtaggcgtggtcacatcatcggcagactttgtcaattaataccaatacttgcacacatgggtgcgatgttttcaaccggaacgaaaaagttcaaaaagcagcaaaacatgagttttggacatcatggatcggattgggtgcgtccgtgttgaaaaattactccgttactcgcgcggccaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtggcaaactttgtcaattcatgccaatattggcacacgtgcgtgcaatgtttttaatcggaacgaaaaagtttagaaagcaccaaaacatgtgttttggacataatagagtggattgggtgcgtctatactgaaaaatcactccgtaactcgcgcagcgaaagtttgtcaattaatgccaatattggcctacattggcacacgtgggtgcgatgtttttagccggaaaaaaaaagttcaaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaacttctgtcaattaatgccgatattggtacacgtgggtgagatgtttttaaccagaaaaaaaaagttcaaaaaacagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcgttcttccgatctccaccgcctcgcctgatcaacagtagggttcctcatccatccgatgccagcgattgtattttctccgacggtaaatgggtgagggacgccgcggccgtgactgcttaccgggaggactgcccgtttcttgaccctggtttccagtgcatcagcaacggccggagcaactcgtctttccgctactggcgatggcagcctcatggctgccagctcccgaagtaggtagccatcgccaatgacatctttgataaattagtaatttcttttctgtggtttttcatgatgtggacatttttcagttacttgcattgccactcattcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccgcgccccaatgcttgtcatgatcgaccgcttcccggcaagcagcggtgccgtcaggggagcggtccggctggacatgctgcctcggcacgccaaccgttgggctggcgccgacgtgctcgtgttcaatacagggcattggtggaatgagcacaagactatcaaatcgtaatttgagccgtagttaattaattaattattttgtttctatgcatactatgttgtttcatttattataactgatccctaagtctcaaactactgccacatacatgttttcaggggaaactatttcatggttggtgatcggctgaacatgagcatggacatgaaggaagcattccgatggtccctggagacagtgaaagattgggagataagtagtacacgggttccaaatagttattttttcttcaggagttattctccttctcattataggtaagaattgttagtgaacgatacacacagttcacctctttggtgaattttaacaagacaaaacataatccttcatacaatttgaccattcgttttattcattttttttgcaaaataaaaaagaatataagccatgcttaaaaaaatatttgacgataaaccaagtcacgggtaaaaacgaaaaaataaaagacaatacatatttttttaataaaatgaatacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttttgagtaattttatagtacattctacttgaagtatatatttgctgcagtatatggaagggtaggttcgatatttgttaaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctctatcccgattccttcatgacaaaaaaaaaagttatgtccagatttcacccgatatgtctggaccaggaaacaactaaataacacgtgattttcagatggagctaatataaattaaataactattattttaggaaaaaaagttacctccggatttcatccggtatgtccggacatggacaacaatgaaaaaacacgtggttttcgggcgtgctagcataaattaaataactattattttaggggaaaaagttactaccggatttcatctgatctgtccagaccaggaagacaactaaataacacgttgttttgtggtcatgctaacataaattaaataactattattttagaacaaaaatatttacatccggatttcatccggcctatccggaccgggatgacaactaaataacgcatggttttccggtcatgctaacataagttaaataaataatattttaggcaaaaaaaagttatgtccggatttcatccggtatgtccggactgggacgaccaaaaaaaaaacatgtgctttttcggtcatgctagcataaattaaataactattattttaggaaaaaagttatgtccagatttaatgtgatctgtccggaccaagataacaaacataaattagataaatattagtttaggaaaaaaaattccgtccggatttcatctggtctatccatactgggatgataactaaataacacgtggttttccggtcatgctaacataaattaaatatctattatttaggaaaaaaagttacattcatttggtctgtcgggaccaagacgacaactaaataacacgtggtttccggtcgtactaacataaattaaataactattattttataaaaataagttaggtccggatttcttccggtatcccagaccgggatgacaactaaataacatgtggttttatggtcatgctaacataaattaagtaacacctattttagaaaaaaaaaggttacatccatattttatccggtatgtccggatcaggataacatgtggtttttcagtcgtgctaacataaatttaataacaattattttagaaaaaaaagttacttccggatttcatccaatctgtctggagtaggataaccgaaaaaacacatggttttctgatcatgctaatataaattaaataactattattttagaaaaaaaaagttatatccggatttcatccggtcggtccaaaccggtatgcaacgaaataacacgtggtttttttagtcatgctaataatataaagaggcaattgtgcttcagtccttgatttacaattcaattgtgattttactcttactttttagggtttgtgattttgcccctgtttttctgaaatgagtctgcccctggttttgacataagtttggtggcctgaaatttccaaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcacgcggcagagtcgggcgcgggcagggaggtacggcagcggctagggctgtcaacgagccgagcttgagcgagcttgcctgtctaggctcgagctcgagccgagcctataaaatgttcgaactttcaaacaggctcggttcgagctcgatcaagctcgagctcaactactgagctcggtttttaattagaacattgtatatttcaaaggataatttttaaaaaatatttaatttatggtttatcatattagtataagaagaaaaaaaataaaataaacatataatgccaatacaaggcatacaaataacatatttgatctaccaatttattaaatagcaacgaaaaattatatattactaggcccgttagaagctcgagctcggcgagctttgggacaagctcgggctcggctcgtttggagctcgagccgagctcgaatcaagcctaggacgagtcgagctcaagtagctcacgagtctcgagctttctttttttacagccctagcggcggcggcgtcgtggctggcgcgcgcagggaggtgcggcgctcccgcggctgcatgcgcagggacggcctttggaggcgccgcgacgaggatgacggcgaggaagaggacattgccgtcgacgagagggactcgctcgggctgccgttgccggtggtgagcaactgctcatcgtcggagtgtgagtacatggccgagtcagaggctgagctggcgaagaccgaggaggagaagtgcgcgtcggcgtcgtcagcgtcggagtacgaaaagacgtcgcagtcgagcacgaggagcgtcgcattccatggtgctgccgacgccggaggagacgggcataagctgagtgttagtgctgcttctattattgtgcgtttagttagttgggatttgggatgccataaatacaatggtgatcgatcacgatgcccatgcacgctgtgggccaaaatcatccatgcaactgttcgtttatcaagactaaatctctataacgagcaaaaagtgcaaatatctgtcactttttacctccttttttctaatcattagacattagtgttcgttttgctctagaaattatcattgaatgccaaaacatgtcaggggtatatttgtccattcaccacaaatttaacaccgctaccattaattaacaaagtaggggcaggcggctacttcatttcaaaaaagcaggggcaaaatcacaaaccctaaaaagtagggataaaatcacaattgaatagtaaagcaaggatagaaacacatttggccctaatataaattagctattattttagaaaaaaagttacgtccaaattttacgtggtctattcgtactaggatgacaactaaataacacgtgatttttcgatcgtgctaacataaatttaataactattatttttgaaaaaaaaaagttaattctggatttcatccggtctatatggaccgggacgataactaaataacacttggttttaaggtcgtaacaaattccctttttaatcgatatatgtacgtgcccgatccatttttttgttctctccatttgctgcttgctgcctgccggttgctctttgcttgctgctgccctgcctcctactgcctgtcattccctgtctgcgctccttgcccctgactgcttccgtcgcccggatgccctgcaatgctgctgccgcttcctgcactgctgctgccgcgcctgtagcagttgcgcccgggtgccctgaagccacgacccttgactgctccgcatccccttgccgctgcgcgcctctggccgagccaccagtggccggcgcccttctgcggctccgccccttcccacgcacagagacgtcaatcgtggagttggggaatttccaaagacctaggttttgggtgcgcgggaagggcagatggaggaaaggaggtcggaaaatcgaatcaaatcacattcgcggtggctatcagcggcggcggtagcgcatgggacgaaggaaagcgaacggaattctctcgggccggatctgaccgaataagagaacgcgaaaatacaaaaaatactccatgcaaaaagatagaaagacaaatttacccttttcaatttatactgtaaactaatctaaaggaaggtcggatgaatcgacaccgttacatcatttactaatctaaaaggaagatcggatgaatctacaccgttagatcgtttaaactacaagtatatactttgcatgtaccgtaaaaatcctctacatttttaaggtcaaaaagggtgccatacatgtcaactaccccaccatcaattctctacttttttggaagaaaatatgacagtataaatgtgaataccaaatacatacataaattaaaggggtgatatatacattaatgaaggtaataatgctttaatgctaattttctttacttaaaatcacattgcaacgcacgagctagttaattaatatatgcatatatttctctctctccatattatactgtacaatgtttttccattctctatattaattaaaaatgcatacaatttcaagtttatatatagttccgtacagagaactttacagtttaaactagtattaaaatgaaggtcaaaaaatgacagcaatggcacgtggaacacgggtggctcgtgtgctgaccatcgagatccagtgaccagcagtgaccaattcgacgaggagtactcttggatcaacgccatgatctcgaacgccatcgacggcatcagaagccacggtcgaaggaaagcccatttcttgaacataacgtacatgaccgaactgaggagggatggccacccgtcgcggaaccgggagcctgggacgccgcaggacgcgcccgaggactgcagccactggtgtctgccgggcgtgcccgacacatggaatgaggtcctgtatgcacacctcatgtcaatgggatatgatatcaggatacactagtacaaaaccctcgcagggaccggctgtatatgtgctatgtgcctttttccacctccacatgataaaaaaaatataaaactagcatatttaaacactatagttgtcggctcttaaaaaaactggtagtaatattgggtataattttatgctttctaaatgtttcttgaaactaaatgatttgaaatgatgatgagattggtatatgtgatatgattgccttacttccccttatgttgtaagggaatgatgtctatctatttatgttgatatcatgccatgattaatatgctttatatattgcttaaatgatttgcttaaattacgttgcaaatagtttgtgaactaaaatttgctttatgctgaaaattgagactacaaatagccttccattgacttagagctttcatgtatgtaagtttgatggtgctcttgccagtacattaatttgattaatgtactgagtcttgccatgtgttgttttatgttttgcaggattagacttagtttaatttgagtgatgcggttttcgactgcttcttataggatttgaacttaatgggggtaaacccctagtcggtgtgcttaaggattgggtagtcaagcttccgttgttctcttatatatttatttggccggtcggcctatgtaactattaagttgatgtaagtctcttagtccctttcgtcttaaatgtgtttgctatatatgtccatgcttaagatgaaagtgtgaatctagtgcacatcttgggaattagattcacatgagttaagaatatttgagatgttgtagatctttagccattttgtcaagtctcctgattgtgtaacacatctggtcgccgctttcgagtggtttgacgggcatatctcacgccgaagttgactggcaggctaaaggcccagcaatgtcttcaatattcttctctcgatgtgtcggatatttcattatgtttgtttgatgacttgagttattcacttcatctcttaaatataatgggaggtccggagagcctacgaaaactgccgccgcagctaagccgctgccgagccaagtcgagccgagccgccgctttaacccgttgctcgatagctgagttgcctagccatagatgcaaacctaggttcctactggcctaccgtttgtcgtaccggggctttaccgtgaatcgtgtctagcccaccagtttagcctcagccgttgttgagtcgttcgctcgtttattcgaacgaggtgtccccgtgtttcgttcgtccgtccgtgttgagtcgtcctttagtttagagccgttcaaagccacaggttccgtttgcctatttcggttgaccatttgggtgatcccgtgtcacgtagaattgactcgttgagtcggtatctcatgaggcttgcttgccagtaaagtgttaagaatccattaaaattggtttcttttgctgtttcagtagctctttagcttgtatttattgtgtgccttgtttgtcgcttagactctggcagttccgacgctccaatttattttgaagtggttgaagaggttctatcagctcaagggcaaggcaagtcatacagatatcattgatcatattgagcctatctgcaaaacccctgcttttctcttaaaattgcattattttataatgtcatgtgggaaggaatttacccgtactcagccttatgcttaccctgattcattgatagcctgggataataatttgattgtaggttgggctccgtgtgctgtggttgttgcttgaacaaaacactcggctgaccgtgagccgatgttgacgcacccagcttcccaaaagccgttgtaactataggctgttgctctggggttattccagatgcaggttgatgcttaccaccattattagtgctgatggtcctatattgtggaaaaacaccctcaggaaggaaaatcgatcccttagcttgatactcacttgatcatattagacaagcactcctgattggttgatcaaagcatgataaacagcatagtcaatccgatcttgcatattattgagccctttaggatctccttatggtttctcatttttaggcttggcatctttaggagaactcgtttctgggtcgtcatcagatagcatcgctatcttatacctctgaattactgtccctgatctagttaacacaaatgagtgcaaaaacttattttgcatttggttcatcatctgctcgaggtccaccttttgttctgctgtcaacttgtctagcgttatcgggacgatgttgtccgggtcaacattagttgacttgatatccaccatgatgaagatatgtcgaagtcggtcccactgagcatgccaaaagcatgttgatgcgaaaaacacacactggtctgagagattgctttactctagtgcaggtcctaaattttgcttttgggttcaaggcgtgccagttggtttgatcctgcaaccaacaagaaacaaaggagccaaagttagatccataaacgatagccgatcggctggattgctgatgacgtatcgttcatatcaggctgatgcgatatggatcagattggcagtgaagtatatggcaaagaaaagattaaacctacgctattgcccgtatatatcagtaatatatgagata

SEQ ID NO: 22988 - DNA, 5596 bp, Oryza sativa
ttcctgcagccctccgtccattttgcgccgttaaatacattgttcatcctataattaacggcgcggaatggacggaaccctaatggcgatggcatttttgggacaaagttgtttgtatgatggcatttcttggaactcacacttatcaatggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagcaagcccgagggagagggagagcatcagctacagcgcggcgaggcgcgggcctggtgcggcacctcggctgggacggcactgcgctgtcacgcacagggctaccacggtatgcacatgcacgctgcctccaaacctagctcaagcatcagtagcagcgggccaacgacagcagtagcacggtgggttagtgggtgtcgctttcagcacctccatgttctcacttgacatggccacacccatctgctccctgccacgccagcaccacgcgaccgacctcgcttgggcgcccatcctcatcgccgctccgcccgcgggacttcaccctcgtccaccacgtcggcgtcggggacatcgcttgaaggagaatgcgtcggctcgtcgtcctcgtgcgagtacgccatgaaggtggtggactgccgtgcgctctccaagaagggcaagctgggccacgccgtcgcggagaagcgcgttcttgtaagttcaagtgccttaatttggtttggtgattaatgacaaatctaataatatgagactaacgtttttatgagcttttctttgactagtctcgtttcgatatgaaaataaaaatgatgagagttgtcaactaggttatttcccgatgatgagatgtggtagatatgcattctttggtgatggaccttaatcatgataaggataaaatgcatggagataaaacgttatgtaccacttcttatctcctactttttgataggttcatatatatgatttccatgttattgttatataagtgtgagactaacgtttactcgagtcgtatcttatttagtctcatttacattaagaacatggagatcatgaatgtatgtgttttatgttggtctacatcattactacatatgctttctctatgtgtacaggataaacccccattggtcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgtcaattgtggtgttaatgaataatgaatactcaacaaacatattcatatctttcatatgcaactggttggtcatcaagtgcaagatgacaaccgatttgttgggactaatgttctcctttgagctgtgcaaaggaataggtcccaccgtgatgaggctaatagatgacaccatggtttgatgatcaccaagccaaggacatcgccatgttgacaagaatgaagtcaagattgtgatgagatgaaagtcttgacaaaggatggtcaagacctaggcataaacaagattcaactgaatagtcacatgtgttgatcttggttcaagcattgaccccaagttggatggcacaaggcaaaggtataatcgagcgaagatgttttcttagtctttttcccggtcttcgtgtttggtgtagaccggatttgctagataggcgccatactatcaagaggggtctatgaagcgagcacgtggatgatcttgtgccatattagttcatatgaatgtaggagcatttggtgggcttgtctagccatgtgtgatgagttttctcatgtcctaaacaaagagagaagtgagcaagtccaataggagcgagtgacatcttgtgggtatgtctggtggatatcctttggagtgtgagccctttatccttgacttaagttgtgtttcttgatgtatttttcatgggttggatagctccttgaataatctttccatagagtccaagaacatcaaattccgagatccaagtcaagagatatcgtcattttactgtcggtgggtcgtgctgaaaatcggtcggcggtcagaccgaccttgtgtagccggtcagacctcccgaaggccccgaaagcccgccaacggctagtttttttgtgcgttggactgagggccggtctgaccgggtttagaagggcggttagaccggcaagcacgtcctaaaaggtgttttagcctctaacggctagttttggtggttgggggtatatatacccactccccagcagcaagggtgaagttttggcactccattgcattatcttgaacccttgcaagagctctcacacccttgtgcacttagtttatctagtgaggtgttagagagtaagttaagccaatccaagtgcattgcttcattgttatagctagtgtggcacttggtcatcctcggcaagcatcctagacttgttactcttggaggttgccgcctcctagacggcttgtggaggtgttgcccggtgacctctcaaaggagattgtggaggaggcccggtgccatttgtgagtggtttggagttcaccaccttcggagtgaaggaagaactaccctagtgatcgaggcttgggtagtcctctccgtgggccggctcccaccatgcccaccccttgacgaagggggcgtgcggtggcttcgttgttgagcggtggagttgggctcgcctcaacggggattaggaatctggcgagtttccgaacctcgatgaaaaattccttgtctcttgtctcatttatttgttgcatttacatttgtgcaatttacatccatagagacatatttgagcccatatcacctaggtttgcaaaacttaacttagttgcttagttaaccttgcaccttaccttgcttagcaacttaggttagttttgtttaagtgccattaagttttaaaaccgcctattcacccccctctagtcggcctccttgatcctacaagtggtatcagagcttggtttctctttttatggacttaaccgttccgagagaaaaggatggcttctagagatatagtccacccgggtggtgaccctcttatatttgatagcacaaattatgcacaatggagaattcacatgatttctcattttagggccatgagcccaaaaatatggtggattgtagatgtgggcttttctcatgctttggatgaacgtgctcccacaagtgggcaagagaaatgcctacatctcgatgctcaagctactaatgctatattttgtgctttgagtgatgacatttttagtgaagtatgcaatctcaagagtgcacatgctatgtgggtaaagcttaaagaaaaatatgaaatgcccacacttgttgagaatggttgcacataaggacggatgtcgggtgaagacttcacctcctcaagagatgatgaggagctcccaacaccattcacatcatctcattacttaatggcaaatggtaagaatgaggtaaataaagattctcttgatattactattgaaagtagtaatggtgatgatgatgatgatgatgatggtgatgagccttcatatgatgaagttttggacatgcttagggaggctagtaaatacattgccaaagagaagaagaaaaattaaattttagagaaaactcttctctctttgaaagactcaaatgtggagctaataaattcttataaggaactttgtgattcttataagaacataaaagaagcttatgagtctcttctcattggcaatgcatttagtaagccaaaggtggacataggtatcatatgcaatttaattgatgatgatatgccatgtgtagctagctcatgcattacatctaagactaatatgtccacctcttgtgatgacttgcaagacataccttatagctcaaacatagatgaaaactcttgttcttcctcctctatgtatgttgttgctaaccttgtagaggaaaacaagcaattacaagccaaagtcaaagatttaaaagaagacttggatagaaactacataaggaagaacacacttgacgaaatcctaagcaagcaaaagagctcaaatgacaagtgtggacttggcttccaccacaaggagaatgctaagaagacaaggcacatgcctagatatacaaggaagcatgcatacttaagaaaggatggaaagaaaaatgtgagtaagaaccatcctcacattacatgttgtggttgtcatgagaagggacactttgcctcgttgtgccccaaaatgaaggatgaaaagtacaactccaaattgagacaaactggcaagaagacaagtcatagaggtcaaagcctaacttgctacaattgccgcaaaaagggatatattggtaaaaattgtctcataggtaatacttctaagcctaatattatttttgatgattatgtgcttaggaaaaataggcaaggcaatgtgtttgccagttatgttggtttacctagacttgcacctagaaggaggaccatttgggtgccccgtattttggtaactaacattgatggacccaattttgttggggaccaaaatgtgccaaaatgagaatataggtacatgagaggcattgaagttttggcctatgctagaaaatgtgattctcaccaagttcaagaattggagccaataatgaggatgaagaattcacatcaagaaccaatgccatctcggtaacatgcttttggtttgtaatttttttatatagccttatgtatgttgcattgcattctcatagctctttccaaaattaaatttccctctggtatgaaaatcgtcatatatgcatgttaagcataataaatgtggcatatgaagctataggtttggtcataatcacacatcatgtttgcctcatattgcttttgtgcttattgtcaatcatttttttatcttagttcgatcttgagtttattttcctatctttgttgagatgaagagaatatcccattaaggaaaagtattgcatttctggcaaaggcactacaattctaagaatgtgaccaaagtgatcaaagtgcaagaaaggttttcaaaaggtccattttgaccaaaagtcaattttttgagagggctgcag

SEQ ID NO: 22989 - DNA, 5726 bp, Oryza sativa
aataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcgtgggtcaacttatctttcaacatgtggaaggcgttctcttgtgatgtgccccaagtgaaaggcactcccttctttgtaagcacattcaatggtgcagcaatggtgctgaaatcctgcacaaagcggcgatagaaccccgcgagtcctagaaagctccgcacttgtgagaccgttttaggagtcggccaactctgaattgcttcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatctaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaactgacgctgaatctccttggtttcctcagggtttgttcggtatggcgcacggttcggtagggaagcacctgggatcaagtcgatttgatgctcaatgccgcgcaccggtggcagccccggtggcacttccttgggaaacacatcagagtactcctgcaaaatgttagcaacagcagggggcaaagaatgctgcatatcgtgaagtgaaatcaaagcatctttgcataccaaagcataggcaactgaaggtgatgcaatcaactcattaatatcagatttagtagcaagtaagcatttgggtttcaaattgattgtctcaggtttcttgccatcagattgggcttttttatcactctcacatttggatttggcagccttagcaacatcatcacgcaaaatatcttcaggagacatggaatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcgccttaccactgttgttcagccattggatgtagtatggatgtgggtgcggttttgtgctaagtgcaagcttctccaccatctcgctgctagccaagttgttgcagctacctccatccatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgcgggctgagcagcctttgtcgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccctgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaacctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgctctcaggaaactcatggcatgcaaatttttggtcaacagcaatctcccaagagaggtacgcatcaggatcatattttccatcaaaaggaggaatcttaaatttaattttagaaaaagcatcatcattgttgcgtacctcgcgtcggcggcgaccacccatacctcgtcgattgttgtgtagccgtcgacgatctcgagcatctcgatcatcttgttcagtgtcagcaatatattcatcctccaaattatcctcgacgtactctccgtcaatgtcatcatcattacccccaccattgcctccagcattgagagcatcaaaatgcctcacaagagcagcaaggctagtgtcaatgcgggcgaccgctgtctccagccctgtaagcttagtgttggtggagatctgcgtggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctgccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagggggacagcaacaccacaagttagcaaccgtggaacgaggtgtatcggtgctgtagcaacaagacctgtcaagctgtagtcgggtttgtggtggagctgttggtgggctgaaagcaatgctcaagagaaaactagaaaccacgttagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtggaaggtggtgacaaaagggggaatggtgtggtgtgctcgctgtatcctcttttttttttttttttttttttttttgctctctctagggctgagaagagaggcaccacctttttttttaatattttttttttgatatttttttcacaaccaggagcacactagaaccaaccacagaaaatcttatctcaaacggacaaagtatgaagcttgtagaattttttcaaagttctatgcgaataggtcccgaagcttctcgccacaaaaacagaattttgcaagaggaatttggcgattttaaatttgccgaacccggcgaagcaggggagaaacggatgtaactttttttttagatgtccgtggatatattataagcctaatttcgagtccgtatgaaaaagatatgactgttttaaggaaggtcactcgaatcagggctctatttcctttctagtggcggcaggatacaaggcaactcacaaaaactatcggcaacagatcaaacacaaatagaaagtgatttggtgggtgactgcgacggtggtgacggtggtgatgacggcaaaattgatgaaggtggcgatgtgcggtggtggcaagaactcgaaactctaatcgcctaacactaagaccagcaaattaacacaaccgatgcaatcgaaaactcaacaagccttaactaagcagtactagtgaaaaggcacaatggtctataggatcacggaaaaactaatctactatttttttttgttggtcttttctggactataggaaaaaaaaataataatgacgaagggaagggtaaattctctcaccgatgaaccacgctctgataccacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctaactctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatcctccccttcttgcatttgagtcgtcctcgactcaagctcatcttcttctcccaaatacggcttcaaatctgcaacgttaaatgtgggactaaccccaaaatctgcaggcaaatcaatcttatatgcattctcattaatctttgctaacactttaaatggtccatcagctctaggcatcaatttagactttctcaaatcaggaaatcgttcttttcgcaaatgcaaccaaaccaaatctccaggttcaaaagtcaattcccttctacctttgtcaccagcaaacttatacttagcattcatgcgctctatgttttctttagttgtctcatgcagttttaacatcaactcagcacgtcgcttagcatcaaaattcagtttctcagaagatggtaa

SEQ ID NO: 22990 - DNA, 2157 bp, Oryza sativa
gtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaaagtacccgcgcgattcacgaagtgagttattgccacgaacgcacccaatacactccaatatgtccaaaattcatgtttggatgctttttgaacttattcaatccggtcaaaaacatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgagctttttctttccggtcaaaaacatcgcacccgtggtgatgttaccatggctactacggatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagcttgtggagcacgaccctaggcacccctaggtcgtcctcccacccctatatatagctagttaccccttcagggtttcttgggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttattcttgcttgtttcttcgatttgcttgcaggaatagggttgatctgcaccggcaagatcaacaacccacggagaggtgtatcgatcgctaaggcgccacacaacgtctcgtacggttgtagtcggatcgtcaacgtttctcccaaatcgtagttatcacaactcaccgaaagatcgggccaacaatagccttgagtgtcgagaggaactcaaggttcatcacgtgggctctcaacatatgccaatattggcattaattgacaaaagtacccgcgcgaatcacgaagtgagtttttaccacgaacgcacccaatacactccaatatgtccaaaattcatgtttggatgctttttgaacttattcaatccggtcaaaaacaacgcacccgtgggatctcaacatatgccaatattggtattaattgacaaaagtacccgcgcgaatgacgaagtgagtttttgccacgaacgcacccaatacactccaataagtccaaaattcatgttttggcgctttttgaactttttcattccggtcaaaaacatcgcacccgtggggctcaatatatgccaatattggcattaattgacaaaagtacccgcgcgaatcacaaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgatgtgagtttttgccacgaacgcacccaatacactccaatatgtccaaaattcatgtttggatgctttttgaacttattcaatccggtcaaaaatatcgcacccgtggggtcttaacatatgccaatattggtactaattgacaagagtacccgcgcgattcacgaagtgagtttttgccacgaacgcacccaatacactccaatatgtccaaaattcatgtttggatgctttttgaacttattcaatccggtcaaaaata

SEQ ID NO: 22991 - DNA, 7611 bp, Oryza sativa
  unsure (1)..(7611): unsure at all n locations
tgccaatattggtattaatgaacaaagcaatataagagtacccgcgcgaatcacgaagtgagtttttgccacgaacgcacccaatacactccaatatgtccaaaattcatgtttggatgctttttgaacttattcaatccggtcaaaaacatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgttttgatgctttttgagctttttcattccggtcaaaaacatcgcacccgtgggggctcaatatacgccaatattggcattaattgacaaaagtacctcgcgcgaatcacgaagtgaccctttgccacgaacgcacccaatacactccaatatgtccaaaattcatgggggccctgggtgagattctaagctcctagtctgtggaaagttcgcgagaatggaaaaagcacaagacacgggcaatgtatacaggttcgggccgctgagaagcgtaataccctactcctgtgttctggtggatctgtgtatgaagaagctacaaagagctggagagccagagagctcttactctagaaaccctcttctcccctcttttcctctcgtgggatctactctccagatcctcctccccttttcgccccctctctaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggggatcaccctgtcatctcttcataaatgggcggagatttgcaacggctgctgcccgagtgacccttctgatgggacggcccatacctacctccactccgccggaagcaggtgcaacgtgggaacacggttgtcttccggcgacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgccacctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgatggccctcctcgagggaagcggttgggcgtgacgccacttcctaaggcctggtgacaggtggggccggtctccacagttggaaagaaaaccaatcggtcgcaaatcacgcatatcggcattggtaactcgactgtcaataatgatcggtctcttcaagactgccacattactcacaaaaatcgggacaagccggttcgtttttcctggagatatggtgatggcgcttcggtcggcgagcgtaattaacgcgcgcacgatatgttccatctcgactgccacagccgcatatccacctcatgcaccgcaaacgggcgaatgggattagtggaagcgtgggcgcgagaaacgagggggcgagttagtgggcgcgagaaacgaggagccgggaacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcgtcatggcacggggctccgctccgcttgacggtagcgtgctgccgccttcccgcatcgtgagcgagagacaggccgggctgccgcgccacttcatgccggaatctgccaccggccgggagataatctcgctgggcgagggacgcccggcgccacactacccggggcggtccgtcttcttcctccctttcgcaatggcagggctggttccgccattttcttctttcttcatggatgttctggagttttacgatctccagatggcgcacctcacccctaacgcggtagtgacattggccatcttcgcgcgcgcggatccgggatgccgccgatcatatcgtccacagcttcgagggttcggcccctcggctcgcgttcgccctcgactccgacgaggagggcgatgacggcggtgtgggcgacagtggcgacgaggctggcgacccgggcgcatcggagtgagcccccaggcccccgccaatcttcagtttttttcttcttttctttcttccaaggccttcgggcctcctttttgtatagattaacttaatctgcaatcaaaataaagaaatttctgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcaagactggccaggccgggagcgtggtgaccgagggttatgggtgacccgattgtgggtttttgccgattctcccccggagttcaccacgccccggggcacggctcggttctgggccccttttggcgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattagggatagaagcgacgaaggtgttcgatgttccacgggttaggcagctctatgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgagcccggacgtggcgctgatggtagcgccgcaggctctgctggtagcgtgcggctcggagggccgcgcgccgccttcgctcttccaagtagtcgaggtcatctctgcgaagctgatcttgatcagcctcgcagtacatggtggcccgaggggacttcagggtgagctcggatgggagaaccgcctccgcgccgtagacgaggaagaaaggcgtttccccggttgctcggcttggtgtggttcggtttgcccagagcaccgctggcaactcctcgatccacgaatcgccgtgcttcttgaggatgttgaaggtcttggttttaaggcccttgaggatttccgcattggcgcgctccacttggccattgcttctcgggtgggcgggtgaggcgaagcagagtttgatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagccagcaaacggccatgaaagtggtatgatctacagggcctggccgggctaatgaatttgcttggcgtggaactgacacgctatgcatcgccggaccaggtagaccgcatcattgagagctgttggccaataaaaaccttgacgaaaggctttgccaaccaaggtgcgcgaggcggagtgggctccgcattagtcttcatggatatcagcaagaagctcgacgccttgttcccgaggaatgcacttcaggaggattccgttagccgcgcgccgatagagggtcccttctatcagcacgtagcgtttgaagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatgcgctccatacgccgtacttgccgtacgtaagcatccatctgcgggtcagagcaccggtattccttacagacctggttaacaaccagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaatgtgacccccgcaccggcgccctgaagagacagggagccgtcgaactgcatcacccagtgggcggtgtgaggcagctgcgaggggcccgagctggcctcggggactgagacgggctcgggagccggggtccactctgccacaaaattggcgagggcctggctcttgatagcgtgacgtggttcaaagtgcaaatcgaactcagaaagttcaattgcccatttcaccacccgtcctgtaccctctcgattatgcaagatttgggcgagggggtaagacgtaaccaccgtgacccgatgcgcctggaaataatggcgcagtttcctcgaagtcatcagaatagcgtaaagcatcttctgggcctgagggtatcgggtcttggcgtcccgaagggcctcactaacaaagtagacgggccgctgcacctttcggtggggccgattttcttcgccaggggccgcatccctggggcgctcttcgtccaagcggcctcgcggggcgcacttgtcttctgtgccgacgacctcggggtcggaggacgacaggtgcggccttcccacagtggcctcagggccgtcctgggggtcgggggctcctggcgtcgtcggacaagcgggcaaagggtcaaccccggtcgtcaggagccttaggccaccgttcggctcgggggcctcttctccctcctctctcccgggtcgagtcggcacagggttaacctcggggtcagagggcgataggtgcggccttcccgcagtggccctcgggccatcctgggggtcgggggcacctggcaccgtctgacaagcgggcagagggccagctccggtcgtcgggggccttgggccaccgttcggctcgggagcctctcctccctgctctctcccgggccaagccaacacagagtggggatgcgcggaatgagggttgtcctcatcgcgctccacaactaacgccgcactaactacctgcggggtcgccgctaagtagagtagcaagggttcacctggctccggggcgaccagaactgggggagagctaagatacgccttcaactgagtgagggcacgttcagcttccttcgtccaggtaaacggcccggagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcgggtggagcggagactctcgaaagtttccgccagatctgaaagtaaagtttctcggtcgcgcgtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgcagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 22992 - DNA, 23577 bp, Oryza sativa
  unsure (1)..(23577): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctttgcttgtcccgagcgaaggacgaaaggaaacaatgacttggttgttgattaggatttgctactatgctgaatatctcaaagatacaggtgcaaggtatatgtactctctctcagattaaataatctttggcacggtggcttacccttacccctgattcccacgagacactgcttctccttgccttgggcagttgaaagacagaacagcaattagagcaccaatcacccgatctttattcaactcttgttctagaagttttcaaatgattttggaaaagaaaactaagttcctcaattgattcactcagtctctctaagtgtatcagcattatttcctcaccaaaagttgccttgttgattcctactctaacgtttatatgtggagctcggtagggatttattactgagtcaaaaacttagagtaaggtttatatgtgggtgtatgatcttgatcatagagcatgagaagtatctacacaagtcacaagagtttgacaaagttcaatggaatagcaagcaactaaaatgtatatggtgtaatcatgatagcacatttttggctctggtaggaatttatatcaaatgaggaactttcaattttatcatttttgaaaaacaaaacatccgaaattcaagccaaactagtatctggatcatagctactcatatttactatctcatatctcgcaacaacttagacttagatcagcaagtacagcccatttacctcaggttcccggatagttgttggctacttatatctaacctttgagagagtacttaccaagaacccatatatcagagatataaaacagagcaactattcatcatttcaacaaagagaactaccttgtcttacctagcttgactcaaacctatcctatctttttggtattttctgttttgcaaatttttatgttgtttttatttctttataggatgcaattggaaagcaaatatgctattggaaagggaaatatgcaatgtgatacaagttacctcaggggggggggccaagtctccccccaagcttggcttttgcacagggtccttgataggatttaatccctgaaagcgaaagtacgcttgaaggtcatcgtgctgttgctgcatcatgttgttgatgttggcgaactgagcatcagcagattgttgccattcttgcgtctgagctatgtgttccgtgaggttgtactgaatctcccccatctgcacatcaagggtgtccattctcctagtgatttcacccaagtcccaacgagaggaacttgagcgccattcacttggggatggaggcacaccacttgatttggagggttggttgtccccccagtggatgtcatgaggcgcatgccaccggtcctcactagcgcttgcccaggttgagactctgatgctatggcgtgcagcttgggtccatccaggtgcatccccagttggtgcccaacctgcctcatacatctgcacaggtgtcgaggatgatgaacttccttgttcgttccttgtcatgttgcgcgtctccctgtatgttccacctgcaagagattcttctatggtctgcaggggaatgataagttcatggcagttgtacaaatgataccccgcatttggcaacgggatttcatttgtacaaccagggaaaaagtatatcaaagattcatctactccatatttcaaaatattcccttgcactagataggcctcatcaatacgcggacgagcggctgagataaaagcaattgggtcgctaacgacccctagcccttttgctatccgagtaatcagagaagtgcactcaacaggagcagagaactttatactttctaatcattgtcttatcatacatttcacaggagcaaatttgatctttctaaccatggcaaacatgataattaattcatctcccctaatggatctcagatcacttctaggaaacaaagtcatagcaatccatttgtgcatgagcctaagtgtaggattatgaatatcatttgttctagttttcttgcaaattggagcaccagaaatatcttcccaaaacctatttttctcgaacccagaaattcctttttggagatcggttttacaggaatcgtgaaaaccaagaagtgtactcaaacctttccatgtgagcgtgaactccttacggaaaaagtgaaaagaaataccatcttctatttctttcaaagtgcatagaaattgcaaagtaagcaaacgagaaccaggctcatctaccacagcaaatctctgccaaccaatagctttccaaatagaacgaaattcaacatccatacctatttttttcagcaactccggtgagtattctcgcatgtgagcatacttctggtcgctcagcatgtagtaggcttgtctctcccgatcactgacaaggtcgaggttgtcacgccctgaagtttccccctacttctttctttaaaatttgggttaaataaatcgtccggagaaatggttcaaattaacctagagctaattccctaactaatgaatgcaattaataattggaaatggcattgtgggatttttcttgggttccacatgtcgcaatacattaacaagatttttagtggaattttcagagccgtggaaataattttaaccatttaaaaatgagcaagtgcaatattttaaatcccaggaaaaatcctttcttctttttccttttcttttcctccttttttccctcttcttgggccgttggcccagtccaccccgtcgcccgcgcgcgcccctatccttcttgggccggcccacgcccctctcctcctcccttcgggacgccgacaggtgggccccacctgtcgggttgtccccaacctccggccgcccacgcccgcgccaaccgccgccgaaaccaccgcccacgccgccgcgtatcccgctgctcccgcgcccactccgcgccccgtgaccacgtcgccgcccacaccctcgctttcccgccgttgcatgcgcgcccacaaggggcggattcaattttgaatccccatctctctcctcctccacctctccacatcgtcgccgcggaactgccgctccctgccaaatccggcatccccacctctatataatcgtccaccgcacctctctccaccttttcccctctttcgccgcccactcccgagctccctaccgctcccgcaccgtgcacccacccaccgctgcttcttccactactccggccgcctctagccaccgctagggccgccgccgcaccatgccgccaccgccgttgggttcgcgcggccgaggtccacctcgtccaccacccctccgtcgagttccgccgccggagcccgcttctccccgcgcgccggtgagcttccaccattgccgccgccttcggccatggttctcattcgtcgcggagtccctctctccctctaacctctctcttttcctctcttaaggtatcccggagcccgtccgcccatcgccctcgtcctcccgtggcttgccgtcgccgttcgccgttgctctttccccacactggccgagcccctcggtgaggacccgactccctcccttcctctctctctttgtcgcgccgcccgccgcttagcgccgccgctgtccgccgctcgccgtcgtgcgccgccacttccgcgccggtcgccgcttcctcccgcgccgccgcttgccgtcgccagcgaccgctcgccgccgccactccccatggccggccggccggttttgaagccgagccgagccgtgcctagctgccgccgcgccgtccgatcggcctcggggccgatctggaccatcggtcccgtggaccggcggtggaccacccgcatggtcccggtccacggtagaccggcactgatgcggacatcacaacctccgatacacacaacaatcctccaacggtcattcaaggaccgataacaagagctcgtgcgcgacaattaaatttagaggtgagctcgttcctatgttcttctttgtatgaattcgagaatagattgctacctaatgattatattgtgattaggaacaatggaggggtaaaggagacacttggagaaggacttagagccatggaggatcatcgaggacgtccaagtcaaggtggagggccaaaccaagttgacgtcgggtgcaattcggagtccagatctagtctgcactaaaacgggcgcctaggtcgcatacgtactcggattggggcgtctttatatggatggaaagctaagaagataacctttccaatggttttggtccgacgtccaaattctttccgagtcaatgggaattgaccgaacaagttgacgtctagaatctgtcccggtgctgcgtcaccgtatttgggcctttggcccgtgtatcgtgttggaacccattatttgtggcctaaagaatttgttattcactccgatcacgaatcgcttaaatatcttcgctctcaaaataatttggatcgtagacatgcaaaatgggttgaatttattgaatcttttccttatgttatcaaacacaagaaagggaaagataatgtgattgcagatgctttgtctaggcgctatactttcttgtcccaacttgattgtcggatttttggacttgaatcaattaaagaacaatatgcgcttgaccctgattttaatgaagtgatgataaattgcaaagagggacgtacttggaacaaatttgtgatcaatggtggatttgtttatagagctaaccgtctatgcattccagttggttccgttcgtcttttgttgatacaggaggcgcatggaggagggttgacgggacattttggagctaagaagacggaagatgttttggccatgcatttcttttggccaaggatgagaaaggatattgagaggttcgtggcacgttgcaccacttgtcagaaagctaagtctcgtttgaatccacatggtttgtatatgcctcttcctgtaccttctattccttgggcagatatttctatggactttgttttgggattacctagaactaagagggggagggatagcatttttgtggtggtggatcgtttttctaagatggcacatttcataccatgtcataaaagtgatgatgctgttcatattgctgatatgtttttccataagattgttcgtttgcatggtatgccttctactattgtttcagatagtgatgcaaaattcttaagtcatttctggcgcacgctatggaacaagttgggtacaaagctattgttttctacaacatgtcacccacaaacagatggacaaacggagatagtcaaccgcactttgggtaccatgttaagggctattttgaagaaaaatttgaagatgtgggaataatgtttgcctcatgtggagtttgcatacaatcgggcaacacattctactaccaagataagtccttttcagttagtgtatggtttcaatcctcgtgctccaattgatattttgcctttacctactagtgagagggttcatcatgatgctaaggcacgcgctgaatttattttgaaaatgcatgattcaaccaagctcaacattgaaaagatgactgaaaagtatagaattgctggtagtaaaggtaggcaagaggttaagcttgaaccgggtgatttagtttggttgcacttgcgaaaggatagatttccggaattgagaaagtctaagttgatgcctcgtgctgatggtccttttaaaattgttgagaagattaatgataatgcatataaacttgagttgcctcccgagtttggggttagtcccacgtttaacatttcagatttgaagccatacttgggagaaaaggatgagcttgagtcgaggacgacttcaattcaagagggggaggatgatgcggacatcactaactcggatacacacaacaatcctccaacggtcattcaaggaccgataacaagagctcgtgcgcgacaattaaatttagaggtgagctcgttcctatgttcttctttgtatgaattcgagaatagattgctacctaattattatattgtgaataggaacaatgaggggtcaaggagacacttggagaaggacttagagccatggaggatcatttgggacgtccaagtcaaggtggagggccaaaccaagttgacgtcgggtgcaattcggagtccagatctagtctgcactaaaacgggcgcccaggtcgcatacgtactcggattggggcgtctttatatggatggaaagctaagaagataacctttccaatggttttggtccgacgtccaaattctttccgagtcaatgggaattgaccgaacaagttgacgtctagaatctgtcccggtgctgcgttaccgtatttgggcctttggcccgtgtatcgtgttggaacccattagggttgcgtcgagaggggtttgcacgaccctaaactctatatatcagtacccgccgccatctttaggtttttggattttgcttagattaatctgtcgagaacagtttcgccgctagatcggtttgtaagaccccaactcgtgagcttaattattcatctgcaacattggttgtttttctatctcgttcttgtttgtgttcttcgattggcaaacaggaattagccttttcggcgaggtcatccccgtttcgacacaggtgataactagaggagacgtggtgctgcgattgcggggctcaagagcgtgtgtgttcaagaagccggatcgatttgtgtcgcgactccgtccaaatcgttgtttatcagaacctttcggaagatcagaaaccctagtgcacatcaggcaccctttgatccgctgccaagtggggcccgcttgccggcgccgccccccctttcgctgacatcagccctgggcaatattgcgcaataaagttattaaggacttttcatccgagctccgtttaagtccattcaagtctcagtaaattcataaaaatccctagaatccattaaaaatggttttgttctctgtttcagtagtcttatagtgtgttttgcttgtatgctttgtttgtcgcatagatctcggccatttcgtcgatccgcggttcctcgaagacgttgctgaggtctcatcagtgcgagagcaaggcaagtcatgcattagatttgatcatattgtactcaatttacaaatatcctacatttctattaaatgttgcattcttttacaatgtcatctgggatgggtcctattactcagccatatattgtttaccttataccattgataacttgggtatcaaaatgactagatgttggtttaggaaatgcttagctatgtctagctcaactagtacacaaatggggatcacattattacatagactttgactattagcatagctttggattggtgccaccgcgatggtgttagttaattaaaatacactgaacggtgggctgtgggtacatggttttactggtcgcacccatggcagttaaggaccggttcacgggaaaccctgggagacttaccatgcttaccacaagcgggagtgggtaactgcttgatctgaagtatagctcgaccctttcctaggaaccggtggcgagggtgggcatgatggagttgggtcggccggggtgtctggttgtccagctgctggattcaccgcggcgcaagaggggactgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaatcgtgtcttgtgggtacagctgtacacctctggccagagtaaaactattcgaatagtcgtgcccgcggttatgggcgatcaaccagattcaccgtgattagtctcacccctagttagctaatgaactggcgtagttcaggtggttggttgggcctgttgcaacgtgatgtagtgttgggcagtgattggttaatattgattaattactacaactgttttactactttcaactactgcttttaaatgcctgctttattgcaaatgaaccactagcctcctttggttatatcctgcatgacttgctgagtatagtgggtagtactcagtcttggtctcttttcccccacaccagagctgatgatcttcctagtgggagctgtcttgttgaagttggtttcgtcgctgccatcaaggattgcctgtggagtggagtcgccccgcagcagaagtcaagcctccaagtttagtttgttttatctttttccgctgcatttgtaatcttttctatttttgtaagacgtggatctgtatgtcaacaattattgtttgtgtaccctggcttgtcctggacagggatttaatgcacattcagcttagaaattccgattcgtgaatttctgggcgtgatagaggtcatcgtcgctcaggagttgttgcggagcgtcggcgtcttccatcgagacatcggctgatgagcaagtactagactcgtcatgacgacttgatggagagcctgaccccttgaatagacgagacagtcgcctcctcatactgcacaatggagcaagaactagctatctcggcgggggttagaaatgacaagagtttcacccgccggttagtttcaccaaagcaacttgtatgtatgcaactaaagatttgaacttgaggaaaactatcaaagcatgaatgaacttgaaagcaaactttggagagggaatgaaaatgtgttgaaatggggtggaattccctctctcggtcggctggcttttatagggtgcccacaacggtcaagaatgacatgtgggacccactagccgttgcctcaaaaagtgaggaagctgaccgttgcctggccggttcggccgaacacccctggtgggcccaaccggccccactttcggctgttggaatccaacggtcagtgcggtcgtggcacagtgaatttttattgaacaatttattttggtttgctctgaaaaatagatttgaataatttcctcaaaattcaaaaactcaaaatgcaattttgaaattcaaacatgtgttgatgcaaaaattcaaattgttgaaaacaaatatgcggatacataccaatttacctgttggcgaaggtcgcgtcatttaaagtccgacgtgcaagaccgtacctcctttcgattcagtgcgcggattttccacccgtctccggaggtgatggagcaggcgcctttggcttttccttccacacgttatttgatttcggtgcggaaaacagcttcttctgagccggctgctctaacttcttggccggtacaggtgattttaccggtgtcctccaataacggttcctgggcattgttttttccttttccaggaagttctgcatgaactctaccaggcttatccgtcttgggtggctccacttcgaccacttgaatattctgcgggttcggcccgtactagattctgaccatggagcattgttccgtccttagttgaaactcaaacttttcctccttcccattgatatggaaacggatactccccattcccacgtcaatgttggctcctgcggtgctaaggaatggatgccccaggattagcgacgtctccttccccgtgtccatgtctagcaccacaaaatcaaccgggatgaagaaatcccatatcttgacaggcacatcctcttctatccccaccgggcaatggactgacgagtcagccagttggaggcgcatcggtgttggtgccaacaccgtgaagttgagtttgtcaaagacgtctttgggcatgacgctgacgctggcaccaaggtcgcacaaggcctggtcgaattgttgtgccccgatcgagcaggtgatcgtgggacacctcggatctttcttcttctccgggagcttgtggagtatgacgttgctgcagtgttccgtcgttgggagtggtctcttgttgttgagtatgtccttgagataacgggcgtatgttggtacttgcatagcgtccaacaacggcacgttgatgtggatcttctggattacttcaacagaacgtgcgaactgctgacggtttcctactccgctgagggaatggcagcaaccgtgtgtcgcagtactcctgcggcacggttttctctggctgaatctccttgtcagccaagtcagtagatggcgtttcttttgacatcccattagttcctgcagggttaggatatggcggatcacgagtggacttacctcccctcgtcgtgatcgccttaatattttcaatggaggagtcgggttgccccggaatcctctcggattcatttgcagggactaaagatgccaactgagctaactgggtttctatcatcttattaaagctcagctggttttgaaatgcagaagcaaagccgtctagcttgacatttgtcgacgggggatacccatagaccggatatagagggtattggggtacgctggtacgaggatctacgtagtacgacatcaagcaaacaaaagatagggattatactggttcaggccccttaagaggtaatagccctaatccaattaatatgggattatatgatggaaatcacagattacaaagagaatagtggaactcgatgataccgatgagatcgtaatcaaatcggttcgactagatcacccagcgacttagctcttgcaggctccggcttcgtaggctgtggtggatgtgttggcagtcaaattcgatgccctaggtcctcccgaggggtcccttttataccgcaggttagttggtctccaagtaggactcggagacatcggaccctacacgatacagtgacgacccagttctatccgagtagggatccttcccatctgtgaactccgtgatgaatttccttaacgtgtacagagaacgtccgtatacgcgtagatataccatatcgatatatgacgtatatccaagggtagagggtatactttatctataaccccgacaatagcccccgacttctgcttaaatgaactcatatgaccgatcgcgacttctgatgttggggttgttgtcgttctcgactggttgatctcggtgtgagaaccgtagagacaaggagtaatcaacaacaccatgcgaagttcaacggtcatgagtgaatttaaattgaagtccgaaaactgccgcgcgtaacggacccagaaattttcggcagccatctctctcctttccttggaattcgtaccgtcggtagtgcgtctatttaagggagttttgggtatccacgttgaagtccacctgctgcgaaaaactttccagcctccaagcgctcctcgtcttctccgctcccgcaaaaagccaagcttgctcatctcagtctcttctccggcgatctacggcggctatggatctcgacaagtccacttccaccggtgcatccctgaagaagctgcaggaggacggcgctctccccagtcacgagaccatggagagagaactaggaggtattgaacccgaacctatcctgggccgcatggttgcggttgaggactatattctttgtggttttcttcctctgccttccgaatttcttcttcttgtcttgaatttctacggtctttcgttgctccatttgaaccccaattccatcgccttcctcagtattttttccgatctttgtgaggcctacattggggtagagccgtttcttgatctctttcatttctactacgagttgcgctggatggaacctaagaaggtatccggatgtgtcggtttctgacttcgggatggcctgaagtcgcgatacatccccttccagtgcccctcttctcatagcaaatggcgggcgaggtggttctatcttcagatagagaattcggatcccgtcttcgttgtcccagaggaacaaccagacaagatttcgtcttggaccaccaaacccgccttagccccctcccttcagtccttcatcgatatcatcgatggcctccgaattcgagggttgtcggggtatgaagtcgctgccgacttcattggtaggcggatccagccgctccaggctcgagcccacccagcctttgactattcttggccggaggacgggacccgggtttctcctcggggtatttttcttatatttcagattccattccttatgtgcatgttcctccttttttatcgaattctggttctcgatctacaggtttgaacagcgaaaccgtggagcgccgcgtcggtcaagtgatgatcaacggccccacaacggcgagcaacgtccctatccccctttgcgagaaggggacagccgagcgtgaagctgcaatcaacgtgagtgtactcgacgacccctttatccttttcttccaggatcgcattgtgattcatgtagtgcaggctctccctctgactgacgtcatcgggccgctcgtggaccaccaggcggcggcttcgttgaaagagggcgtcacccaggaggtgtccgacgttgctgctgctgctgccgctgccacgaccagtggcagcaacattccaaaaaagggaaggaagttttcctccgtggtttgtaaccgtcggaaggcgcccactccatcggtaagcccctttggtcacttgttgcgtagtcggaagatattgtcctcacaccgtactcgttttacttaggcctctcccacctcagcgacggcagaggatggtgacacttggcgagaagtaagtagacgaacttgaggtcttgttatttcattgaactctggcaggccgtcttgatggcaattacggcaatccttcatagggcggcgcgggcaaaggcggcgcaagacgggtctggagggaactccagtgcgtctcttgcagcggcttcgaccgaggttgtggtcgtgcccaagagtcgtgaggcgacgcccagcggctctgtcggcggccttgtgcccgctcgaggcccgctcgctgacatcctcacctggggggagctccaaatcgagatggagcgcatcctccaggctggtgctcgcaggatagggcgcgagattgaggaggcgaaggcggtggtgtcatcgtcggtgaacgaacgcgccaagctggcgcgtgacctggcggaggtccacgaggacctccagaagatgagggagctggtggtcggcaacgagcagcagcggcaggggctcgagcaacacatgtcggagctcgagaacaacctgtcggagatccgcggctcgctgtggaccacctacaccgggctgaaccagctcgccgtggagtgcggtgttacgaccaccatcccggcgaatcccgacgagttctcgctgatgacttcacttgcgaaactggcgacggcgatggaggagatcccctccaagcatgcggccaggatcggggaggagacgtccaatgggatctacatcggggcgtgccacgtcctctcgtgcgtaaggttggcgcatcctgaactcgacctccagaggatcttggatcagggggctgctaacgacgcgcgtaagggcgtgatggaagaagtcagagatctgggggagtctgttctccccctttttgaagaataggatttgagttcccctgtgctccttagtcagtcgtgcttgtaaaacttttgttggttccaactgcctttgtgtgtgtagtcatcacctttgttttctttagcattttgatctcgagtactttgttgtcgttgtagagatgtcgatgtcgaggatgtctagcagcgcgggtagcctgagttgcctgtaatcgttccggcacttgcgctcgagccgtatgtgccgcaggacgacgtagatcggaacttgcccgtggaagcgggcgtggcgacgacttccttaggttggttttttttgttttcatctgctttgctgatttgtcgggattgacttaatttgtcgtgttctcgagagagaagaacaacttgacttagccgtttccatgctgagcagacctcgagagtgcgctggccgaccgagatcgtcgcatccaatactggaggacgaagttcgaggtggccgaactggagaggactatggtggaagtgaagaaggatcgggctgtggaagcactccgaggtcgcgaggtgtggttcaactcgtacctcaggagctgttgcgcggtcatggctggagtctccagggaactccaggtaccacgcggggatcccgaggagtcggcggccggatatatctcgtggttgaatggggcctgtgcccagctcgaaggtatcgacaagcatatcgacgaggccctgaagcaggagtgccgtcgatagagccgatatgctggagggcatgtgctggcctgtatcagagatcaccgtccgcagctgcacctcgagttcctccacggagggttttcacgttctcggaggactcccgcagagatagataacttggcgaagtcgatggcgccgcttgcggagaaagtgttccagtcgatggactggcgctggccttcctggtagtctttatatcctgtgacaaatatatcagagagacatgtaatatattttgaaatttttacgaactgtaagaagtacttgtgaaatagaatataaatctatctaagtctccttactctggatgtggtgtgtaagagtgtcttctcacttcgcgacttcgatcaatcacttgagtcatacactctccctagcccccggccttgtcatcggagaatttttctcgaaagataaggctcttggacctttgacctgccttggttgaacaagcactgatcctagccaccagccgtgaagttagaaaacccaatttccgattacacggcttggttaatacgcacggtgagaactcttacacgaccagatcttacatggtcttttgtctctacaagatccgacaaggccttatcggctctgggcgtccccagccgaagttcccttagattcctcggaggccttgtcaagacggcgtaaagggacagtaggataggtttcaacgctaggtgtcatcgtggtaaaggatcgtcaggaaggaacaatttgattgtaatctttacctgaaaataaactttattgaagctgtaagatgtcttacaagtatgaatactattgatttatacatagaatttacgtaattgatcaatgttccaagaatttgccaactctcgaccatcgccgtctgcaatcttgaatgtgcctggccgcaagacatgcgtgatcgtgtacggtccttcccatttgggtgagagcttgtttcgccctgcttggctttgaacccgtcggaggacgtagtcaccgatcgaaagtgtgcgtgctctgatgcgcttctcgtggtatcggcggagggcctgttggtagctggctgctctgacggcgactctttctcgatgttcctcgagtaggttgacatcgtcgtttcgctgctcctcctgattctcatcgaagtacttctatactcgtgtactctgatgtcgtagctcagtggggagcatggcccatgagcgtacacgaggaagaaaggtgtctccttgttggacgttgtcggtgtggtacgcacggcctatagtactgatgggagttcttcgacccacttcttgtcgtgtgacatgagcctgtcgtagacacgggtcttcattccttgtagtactatgtcgtttgccctctcaacctgtccattaaactgagggtgagaaaccgaggcgaagcagatcttgactcctagcctgatgcagtaatcctggaagtcggcacagatgaactgggagccgttgtccgttatgatgcggtgaggcaatccatatctgcagaatatccctttgatgaatttgatggcgttgttggccttgatttcccccgtgggtgtcgcttcaatccacttagtgaatttgtcgatcgccatgaataggaacctgtagccgccttgtcctcgtgggaatggtctgagtatgtcgagcccccagcacgagaacggccaagtaagagggatagtctgaagcgcttgcactggtagcttagtgtgtttactgcgaaattgataggcttcacaccgctgaaccatgtcgcaagcatctttgagggcaatcggccaaaaaaacccttgtcgaaaagcttttccgaccaatgtgcgaccggcgacatgcgacccacagatcccttcgtgtatgtcgaggaggagatgtttgccgtcgtcgaacgagacgcatttgacaagtaccccgtttggcgccttcttgtataggtcgttgtcgatcatacagtagattttggcttgacgggttattttctcggcttctgcatcgtcctcgggcaactcgtcgctacttatgaatttaatgagcgggatctgccagtcgtctatggtctcgatgtcggcaacggcgcgctctgcctctatatgatgcgaacccgctagggtttatggcccgatctttcgatgagaggtaagggataactcgattagatgaagacgacgttcacggcccgactacaactgtccaaagacgctgcgccttagcaaccgatacaccgtctccaatggtcgccgcgaacttgtggtgcgcatcaacccggccacgagggcactcgtcctgcaagcaatcgaagaacaagcaagaacaagtaggacaagcactgaaattgctagataaagatgaaagtttcactatcaaacacaatatggtgggttccgattacaggcagacgggcggtttagccaacacgcgcgctgcgagccggtagcaagaagctatctctatcatcaaaacccgcctgttcttggcggccactagaggtataagaagaggggaagaacgaccatagggtcgtgctccaaccctagggcgtgcccctaatgggcccaacttggatacacagcccattgggccaaaagaggtgacgcagcaccatggacagaaaatagtcgggagtaaaatgacaattgcggccgctccagaacagatatggacatgtggctggatccatttgaaagtagacttgataagctttccatgaagtacttgcacgcccaaatcggagttcgcatgaagtcgtggcggccgtcagaagttggcgctgccctgcagtccgaatccaccctgtgcgaatcctcttccctttggatcctctccatcgttcctgagtaaaacacgagtgcacgcgtctccggggtataaagacgaggaatatgaactcaagaaagaactcacctgataatttagttgacgtgcacgagcgcgggtaataggaccatcatgctgtacatggggggacgtggatgtatcgatggtgttgatgtcctcatcactatagcccccgagctgatgtcgggggcgactaggctatcttcattgtttgcctctttcactgatggctttgtcaggacgtccaaaaagttgccaggttcgagtggctcccgtctggacgcacgccttgctagatcgtccggttcgatgttgtcattgcggtatacgtgtcggacctcgattccatcaaatcttttttctagcttcctaacttctgcgaggtacttggataactcggggctagagcacttgtagtctttgtgcacctggtttgcgactagttcggaatccccttttacgatcagtcgcttgactccaagtacagttgctgctcttatcccagcgagtagtccttcgtattctgcagtgttgttggtcgccctgaagttgaggtgaattgcatgcttgaactgatctcccgaaggtgatgtcaagatgaaccctgcccctactccttggctgttgagtgcgccgtcgaacgccattatccatgtttcgttgtcgatttgactgtctgacctgttttcaggcatagtccaattggctacaaagtcggccagaacctgggacttgatggctgttcgtggcacaaaatggacatcaaactagcttagctcgactacccatttcgcaatgcggccaacaacgtctttgtttctcacgacttcaccaagagggaaggaggaaacaactgtgaccttgtgtgcttggaagtagtggcgtagctttcttgacatcatgattactgcatagagtagtttttggatctatgggtatcttgttttcacgtcgtggagagcttcgctgatgtaatagactggtctttgcaccttctctctctcgacaacaatgacagtactaacggagtatggcgtggcggcaatatagaggaataattcttcattaggttggggagcaacaagtacagggggatttgacaggtagcgcttaactgcgataaatgcctcttcggcttcctgtgtccatacaaatttgtcgtgtttctttagcagggcgaagaaaggttgtcctcgttctcccatcctagcgacaaacctacttagtgccgccatatatccagttagtttctgtacttccttgagtcttgtgggtgacttcatgttcttgattgccttgatcttctcgggatttgcttctattcctcttccagagacaaggaacccgagcagcttgcccgatggtactccgaacgtgcacttctctggattgagtatgaggcaatatcgtcggaggttgtcgaacgtttcccgcagatcgtcaatcaatgagtcgcttgtcttgatcttgacaacaatgtcatcgatgtaggcctcgacattgttcccaagctgatcgttaagtgccccttggaccgtgcgttggaaagtgtttcctgtggttatcagtccaaatggcatcttaacgtagcagaatacaccgaacggcgtgatgaatgatgtcttctcctcgtcctctttcgccatactgatttggtggtagccggagtaagcatcaagaaaacttaacaactcacaaccagctgttgagtccaccagttggtctatttgaggaagagggaagtgatccttgggacacgccttgttgaggtcggtgaagtcgacgcacatcctccacttcccgttggccttctgcaccatgactgggttggctagtcattctggatagagtacctctctgatgaagccagctttaagaagcttatcgatctcttctcgtatggcctgttttcgatctggtgcgaatctccgcagtttttgtgcgaatctaagtagatcccctacctggcgcgccactgtcgacgggggatacccgtagaccggatatagacggtattagggtacgctggtacgaggatctacgtagtacgacatcaagcaaacaaaagacatggattatactggttcaggccccttaataggttatagccctaatccagttgatatgggattatatcatcgatttccattcaaccggtgagccatttgtcgatttcttgcagtagtagcaaccttaggtggtgttctacatcctgcatgtgatgttattgacatgcatgcaatagaacgagccgttcaccgccgtgacgcacgggtgcatgcatggcgtcccgagcgcttccgattgcagccgccgcctgcgtcggtccagtcaccattggcgggggaaaagttgaggaatggaatctcaatgtcttgctctacattttatcttttgacctcgtccccattagagccggcgtttgccgccggcgagcttgagatcgagctcagccatggctgtcgctgcttcctgcacgagtggagaagaagttgaacctggttgtaagttttagaaatcccagggttcgacatgcaaaactacagtccaaaagaatctatcctttggatccacagtcgcctgggacccacctgtcatccggctcaaaacaaaccgcaccatccgcgcggaccacgaaagaaacgccgataaaaaaaagaacgccaaaaaaaaaagaagcgcatctaacctccgccctccgccctccgccatccccacgcggccacgccactcacccaaccccgccgccacctcggatccgcgtgtggccgccgtctccgccgctccacgccgctcggagccgcgggccgcgttgccgccgctactacgcgcccgccgcttcttgccgcctcctcgtgcgcgcccgccggttccccactccctccacctcttcacaatctcctcccgttcgcaaccgccggggcacctccgcccgcgccgtccaccgcgcgtccgcacctctccgcgcggagtcactgccgccgagcgccggccctcaatccgcttgcatccgccggagatagctgcggggacgacttcaggacggccaccctctacctcacaagttgagttcgccctgtaagtttcctcttcctccttcctatgtgatcgattgaacaagaattagttgaatgcttgcttgttccttcgctagctctgctgtaatggagtggagcaaagttcaatctttgggtacaatattttcatttgttgggaggatagcaaggatctgataatggcaatatacaccgaaacagtgcattgcgctcaacatttgtgctctatttacagagttataaagtaaacaatagtagtgatgcatcaatcatgaaattctcatagctgtatggcattgcatttatatagcaatctggttagatgtgcactgacattaactttactcttaattatttacttgaattagcaaggtgataaggtcatgtaggtcaatcctgtacatgtatatggggattgttgtttgatgttttctcatacagccatatttcaattatatgtggtctatgcaagctcatatggttaattaattctaacaattcttccttctgcctggctgctctgatcttttcttactacatcgagatacaatcagatcatgacatgtctattctcttcgtccattgcaaaaaaaattttgtgtgtgtttgttaatcacttcatctttttccagattgtatataaattatgcttttaatcactccatcttctgccaaattgtaagttcatacctttcatttcatctggaccctgtgaaaggaacatgatttcctatctagatttgtcttttttaattaacttttaacctttttctactcagtgtattgatgggtcagatggtgcatggaaacaggacgcggttctatccgccagtgaggtgcctgccctgccaactacttagggtgtgttcggacctctaggttcccaacccaaatccctcgttttctgcgcgcacgcttttcaaactgttaaacggtgcgtttttttataaaaagtttctatatgaaagttgcttaaaaaaataaaattaatctatttttttaaaaaaattagctaatacttaattaatcatgtgctaatgaaacgctccgttttccgtgcggaggcactgtgttcccatcatccacatgcgaacacagccttaggagtgtgccagtattctacatggttgtctcctccatgatcacttagcaggtcaatttcaacacttgcctctcacaaaaactagatatatgatattttatcgacaccggtagttgctcgatgttcttgaagaatagcatgtcaaactgaataatcttagccaagatcatccagcgatagatttattaagtttgatggttacgattgacagtttccttttcctattaacttatctgtgctatcaaataagctttagtgatcgtcaacaaaagcaatgtgtacctatgaagcaaagagcacaccagctagagctgatcatttgttttttagggtttactgcgtgaaaagtccaatagagatgtcaatttttatctccttactatctattggctattgctctctagggacaacatatattgttcagaatttttttggttggttcatcttgtttgccatcagattcatttgaggtttatctatgctttgacgatggccaaggaggatcagttccatttgagccaagcgattatagttttttttcctgtgcttcatgtaaaatttaattattatgcttgtttctttacaggaaagttgtgagatcatgaggagtggcatgcctaagttgactctcttgagcttgatatgatgtcctgaacatgcatgttcaggtgagcaaaattatactttaatgcaccagttttggaattcaaactcaaagaaacttgaaaaccctggttgtaacttcactaaacaaatgtacttatttaaggcatgaagattaacatcttgactttagttcaatgatgggtcattgtcattgacgatcacatggtccacagaggccttggtgtcttcgatctgccatgatttccaacaggttaagctttgtcatctcatcttctgaaatctgaacatttttatctctgcatttgtttctgatggtttaaacttgggtttggcactggatgatctggttcttgatcatttggtcatcatgtacttcaaaacttgcacatttggtattgaatgtagactcaaaacaggctctatatctatgtttgaaactacccagtcctaaaaatgcttgtaatacattacaactatctaatcctaaaaatgcttgtagtacataatttagaaattaagatggttctttcagtataaggtgatgtcatcagaattgcttcatgaagtacttgcaaagctatttatcaattcaatcctatgcttattgtaatccaacaatcttttgttcatcaaaatgaccctggaaatattatccttttactaagtgctgggattgaagcaggcgatatatatcgttaactttatattggattatctcaataaggccggccttatccttagttgtttactacggcttggttggaggttggccaaatagagttgttgctttcacgattattattattatgccattgccttgaaggtatgcatcatgtatggcccgatgaacgctgacactataatgtttgctgaattttcttacagtgctcatattctgcacgtgacattgaatccgatatattgcaggggctcagattggcgaggtacatcgaaacaattcaacaaggatgatataacaacttacaatatttcttgtttcctgcttcctatctatgatattcagatgctgattaaatcagttgtttggcaggaattatcaagtcaccatggtgttttacaatgtcaaatggcagatgtccaaaaacgtctcaggtaataaataacttgagctgtatatcgaattatatactctcaatggataaaaaatgcaacaaatatgcataaatgactaaattcttctattcagtgccgtattcagtaattgtttggtggcatatgatcttaaaaggaccccttaacacatatatattgcattgatgtcagaaatcattgtcgattctcatagataatagccagaaaagggaattaattgagtgacccatataacaacattacatgtccttcagttattggatcaaccacacgaaggttaacaatattgaccatataagaagaatttcgcttaagttctaaaagagtatctg

SEQ ID NO: 22993 - DNA, 1235 bp, Oryza sativa
tttgctaagcaacatctgaggggcctacaatgagttgttgcttgcgtaagaagtttcagcatcgaaattcataatatgtgcactgcaggtctgaggttcaaatatctgaccaaagtactaccccccttgccagattcagttccagaatgagacacagtaacaggtgacggaacacactgtcgtggttccatagcggttgcgtgcagagggcaagcagcttatgaagccaccccttgtttcatcagaggtgagattgagctaaaggtgatgaatttagaaacttcagtagctggcatcaactgaacttactagcaaatgctttattctgaaacctgacaagatctcaggaactaacaaaagaaaatccagtctttacgcacggacgttgggtgttcagtgagcagggcgttgcagagctaccattgctacttcagcatgaagaagcagtcagccaacaacatcggcagcaagcataggctgaaaatgagaatgttaatctaattaaatcaaaaaattagttcatgttatgtcattcatttagtgtagttatagtttgtccttgtgtatgcttatactgccatcagcgatcggccaatctatgccattaggatatgcatgtaagaactcagaagtggtgtgcgactgtctattatcaattgaaaatcgcttgatttttttcacacaaaataagcgtctgatagataaatggtctctggtttttttttttagcctctgtaagttgtaatatttgtaaaataatgaatggatacttgaaaactgatgtttgacattgtttcggtgtaaatgaattggagttcaagtttacaaagaattatgttcaaatcgaacactccaacgtgtttgagcaatttaaaacaatctcaaccttttttagagctatatggaataatcacatatttatgaatacacatatttttgttagtaccaagactgaatactctttcaaaattaactgcacgctcactagtaattgaaaacatacgtgaactaggaaaacatcaaaaatccataactaattcatcttaactcattttcaagtgaaccaaatttctatgtattcataaatttgtagtctttatgtttgtaaattaaaacattacaacttcggaactgaaaaagtcactaaaattgtgagtttcataaaaacacttatttttgcacctaggagttgtataatctctagaaactttatgctatatcctgggctgcaggaa

SEQ ID NO: 22994 - DNA, 5202 bp, Oryza sativa
ttgatcttaaagggagagaatatttgtgatatccttatgatcatagctataaaaggggaaaatattctaggatcccacatcatagcattacatatgcatcatatgcgtaagcatgtcattggcatatatatcactcctatttactcaatgacatgcatggatataaatcaattgccaagcttcaatacaatgataatctatatacttcatatccaaatgtggttattattaatgaatttgtcatcaatcaccaaaaaaggggatattgtaagttcaagtgccttaatttggtttggtgattaatgaaaaatctaataatatgagactaacgtttttatgaacttttctttgactagtctcgtttggatatgaaaataaaaatgatgagagttgtcaactaggttatttcccgatgatgagatgtggtagatatgcattctttggtgatgaaatgcatggagataaaacgttatgtaccacttcttatctcctactttttgataggttcatatatatgatttccatgttattgttatataagtgtgagactaacgtttattcgagttgtatcttatttaatctcatttacattaagaacatggaaatcatgaatgtatgtgttttatgctggtctacatcattactacatatgccttctctatgtgtataggataaacccccattgatcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgacacttgtggtgttaatgaataatgaatactcaacaagcatattcatatctttcatatgcaactggttggtcatcaagtgcaggatgacaaccgatttgttgggactaatgttctcctttgagctgtgcaaaggaataggtcccaccgtgatgaggctaatggatgacaccacggtttgacgatcaccaagccaacaacatcgccatgttgacaagaatgaagtcaagattgtgatgagaagaaagtcttgacaaaggatggtcaagacctaggcataaacaagattcaactgaatagtcacatgtgttgatcttggttcaagcattgaccccaagttggatggcgcaaggcaaaggtataatcgagcgaagatgttttcttagtctttttcccggtcttcgtgtttggtgtagaccggatttgctatataggcgccatactatcaagaggggtctatgaagcgagcacgtggatgatcttgtgccatattagttcatatgcatgtaggtgcatttggtgggcttgtctagccatgtgtgatgaattttctcatgtcctaaacaaagagagaagtgggcatgtccaataggagtgagtgacatcttgtgagtatgtccggtggatatcctttggagcgtgagcccttcatccttgacataagttgtgtttcttggatgtatttttcatgggttggatagccttttgaataagctttccatagagtccaagaacatctaattccaatatccgagtcaagagatatcgtcgttttactgtcggtgggtcgtgctgaaaatcggtctgctgtcagaccgacctattatggccggtcagacctcccgaaggcctcgaaagccccccaacggatagttttttgtgcgttggactgagggccggtctgaccgggtttagaagggcggtcagactggcaggcacgtcctaaaaggtgttttagcctctaacggcttgttttggtggttgggggtatatatacccactccccagcagcaagggtgaagttttggcactccattgcattatcttgaacctttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccggcgccatttgtgagtggtttggagttcaccacgttcggagtgaatgaagaactaccctggtgatcgaggcttgggtagtcctctccgtgggccggctcccaccttgcccaccccttgacgaagggggcgtgcggtggcttcgtggttgagcggtggagttgggctcgcctcaacggggattaagaaaccggcaataaaaaattccttgtttcttgtctcatttatttgttgcacttacatttgtgcaatttacattcatatagacatatttgatcccatatcacttaggtttgcaaaacttaacttagttgcttagttaaccttgcacctcaccttgcctagcaacttaggttagttttgtttaagtgccattaagttttaaaaccacctattcacccccctctagtcggcatccttgatcctacagtcctgcgccggctcgaccaccctttcctgcctgccatgttcgatgactttgacaccggccagaactactcccccactcactccgccaccgcatgcctggtcatcgattcccagtcgcgttcaccaggttctacgccgctgaggtgctcctcgcgctcgagtttctgcacatgatgggcatcgcggcagagccagtgcacgcacggtcgagctcgttcgtcggcacgcacgagtatatggcgccggatgtggcacgcggtggcgggcacgacgtaggcatggactggtggtcatatggcatggagttcccctcggccgtcgctgcctcgccgcacgacgccgcgacgcgagacatgatttgcgcgacgaagagcctgccaccgccggcgtattctggctagccgacgcggcgctgtgtagggagagagaggggcttacatgtgggcccacgtggattcatttgagctaagggcaaatttgtctttaatgattgtttctctctcctattcctctagaaataataaaataaagcagtgggtgaccaggagctaattaccagttttttgcgatgccctacagcaaatacacgttctttcgatgtcctctagctaattacatgttttttggatgtcctgtagcaaattttgcctagattaaatatactaaacgagaatcaattcgatgttaggatagcctaacagactgatatcaggcttaatatattttatccaagttggatcttgatataaagggcagattcagtatatcaagtaaacaaataggaaacaagataactaaaccaggtaagatcggctgaaaccccgatactatccctattagcaatcatagagcaagctagatattatggttctagatattacttaatagatcaaactcatctgatgcagcattaagcataaagagaaacataagatctaaacgagccaatgagagccttttcgggaaggtggatatactatataatctaattcaacgatagtgttggaccctatcggctgttttcgatgatagaggctagacgacgagatcacatagtaaagtcgatctagattataaagcatatatgataactcgacgatttacatagacaggattagagtgtcgtaaagatgtttgcactaatctcgagaacacaagccgccataacaaactttacctcttgtcggagatagaaaccggtccagcccaactcgaaagcaagaactcgtcgaaaacaatgaaaagtaaaagggtggcgatgcgccgagagtgtattgaactgatgtttgtttgtttacaaggtatcgtgtcatatttatacccaaaatacataatatgtcattgtcggacatgactccacttctattacatctcgaaaatacgaataagtcccttaggcggactcttaccgaaaatatctctaaggaaactaccaaaatatcctaactaatactccctccttccaaaaatgtgaactatttcttttacaccaagaccaagaagcaattaattcattcaccatgtgacaaaaccaatgaacatgcaaccaataagcattaaaatggcttcttgggttcctatcaacaatttaatttagcacataatgactacaaataggacttagacttttggaaaaaccaaagaatgaaataggtcttagacttttggaaggagggagtagattcaattgccttcttcagactcaatctatacttggcaatacttgtatagcacttcaaccaatcccgacactggttctacaattatctcgccgaaatctgttacatcggttttgtgggcacctgaacattatatcgtccaatgcaatttgtcaccaccacataattttggatgagtgggatccatacatgcataaatagccactcatacctcagtgtgccatgatcacaatttgacaccattcaatataaaatccgcaatgccgaatgaacaaaggagatattgttcgaactcaacatgccaatcaacttcagcctgagacatgcccgtcaaaccacacgaagccgcgaccaaatgtgttacacatctcaggagactcgactcaaattgctaaaactctacaacatctcaattactcaaaattcatactcatgcttagctagtccccaggaaaagcggctagcctcacactttcatcggaagcaattgataagcatcacaaatgtataattatggataaaaggacagcaagatacatattttaaaacggggttcacaagcccatcatacaacacaaaatatagcagcggaagttttgcaaattcatataagcagaagtaaaacccgtggtgtgcaaacaaccccacaagggcaaccaaccggggcaagagcaaagctgcaactactcgctaccctcgccaccctcggcgggatagtagtagggcacaacatcaacaccggcatcctcacctgaaaatagcaacatgagtacgaaaggtactctgcaagacttacaccatatatgatagtacaaaggagtatgcatgtttctacatcaaagaaaatggctaagtggttcagattttgcataaagctaattttgttgagcaagtagtaagttgcaaatatagcatttgtaaaaataacataatctgaaatttaggacagcaagaaagtaaatctgaaattgaa

SEQ ID NO: 22995 - DNA, 1055 bp, Oryza sativa
gtccaaaatttatgttttgccgatttttgaattttttcattccggtcaaaaacaacgcaaccggtggggctcaatatatgccaatattggcattaattaccaaaagtactcgcgcgaagcacgaagtgagtttttgccacgaacgcacccaatacactccaatatgtccaaaattcatgttttggcgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgaccaaaattcatgtttggatgatttttgaacttattccatctggtcaaaaatatcgcacccgtggggtctcaacatatgccaatattggtattaattgacaaaagtacccgcgcgaatcacgaagtgagtttttgccacgaacgcacccaatacactccgatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgtccaaaattcatgtttggatgatttttgaacttattccatccggtcaaaaacttcccacccgggggg

SEQ ID NO: 22996 - DNA, 351 bp, Oryza sativa
gccaatattggcatatattgagccccacgggtgcgatgtttttggccggaatgaaaaagttcaaaaagcgccaaaacttgaattttggacatattggagtgtattgggtgcgttcgtggcaaaaactcacttcgtgattcgcgcgggtacttttctcaattaataccaatattggcttttatttagccccacgggtgcgttgtttttgaccggaatgaaaaagttcaaaaatcgccaaaacataaattttggacttattggagtgtattgggtgcgttcgtggcaaaaactcacttcgtgattcgcgcgggtacttttgtcaattaataccaatattggcatatgttgaga

SEQ ID NO: 22997 - DNA, 746 bp, Oryza sativa
aaacacaagaaagggaaggagaacatcattgctgatgctttgtctaggagatacactttgttgacacaacttgactacaagatttttggcctggaaacaatcaaagaccaatatgcgcatgatgctgattttaatgatgtgttgctgcattgtaaggatggaagaacatggaacaaattcgtcatcaatgatgggtttgttttcagagctaacaagctatgcattccagctagctccgttcgcttgttgttgttgcaggaagcgcatggaggcggtttgatgggacattttggtgccaagaagacacatgacatccttgctagtcatttcttttggccacagatgcgaagagatgttggcaggttcgttgctcgctgcgctacatgtcaaaaggctaagtcacgcttacatccacatggtttgtatatgcctcttcctgttcctactgttccttgggaagatatttcaatggattttgtgttaggattgcctaggaccaagagggggcgtgatagcatttttgtggttgtggatcgattttctaaaatggcacatttcataccatgtcataaaactgatgatgcttctcatatcgctgatttgttctttcgagaaattgttcgcttgcatggtgtgccaaacacaattgtttctgatcgtgacacaaaatttcttagccatttttggagaactttgtgggctaaattggggactaaacttttgttttctactacttgtcatcccca

SEQ ID NO: 22998 - DNA, 724 bp, Oryza sativa
tcgcctaacactaagaccagcaaattaacaccaccgatgccatccaaaactcaaccagccttaactaagcagtactagtgaaaaggcacaatggtctataggatcacggaaaaactaatctactatttttttttgttggtcttttctggactataggaaaaaaaaataataatgacgaagggaagggtaaattcttcaccgatgaaccacgctctgataccacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgaaattgctagataaagatgaaagtttcactatcaaacacaatatggtggggttccgattacaggcagacgggcggtttagccaacacgcgcgctgcgagccggtagcaagaagctaactctatcatcaaaacccgcctgttcttggcggcgactagaggtataaaaaagaggggaagaacgaccatagggtcgtgctccaaccctaagacgcgcccctaatgggcccaacatggatacacagcccattgggccaaagaggtg

SEQ ID NO: 22999 - DNA, 1265 bp, Oryza sativa
ctcttacataatctcttgattgtctttcagatcggaaaaacaaaggtatttctgagagctggacagatggctgatctggatgcacgaagagcagaagtgctaggaagagcagcaagaattatacagagacaaatctctacatatatcgcacggaaacagtttgtttcgctcagaagatcagcaacacagctacaatctttcgttagaggtactcctccccttctgtataatgcagtttctgcagcactggacagattttatgcagctgtccttttccctttttttttttgtaatctagggaccttggcgcgtaaattatacgaatgcatgaggcgggaagcatcagcagtgaagatacaaaagaatgttcgtcgtcacaaagctcgcgtgtcttatttacaactacaggaggctgcaatcacgttgcagacaggattaagggcaatgtctgcccgcaaagagttcagattcagaaaggaaactaaagcagctgtccatatccaagtatgtacggtttcaattacattgttttgtaatagtatttcatcaattttacaaattatgccatggcttgagaagtttaggtccatcatgtttctgttctatttgtagttttcctttgttgttgttaaaacacttattgtaatattttttgatgaaacacattgtaatattgtgttatggcatttttaaacataggctcgatggcgttgccacagagactatgcacattacaagaatctgcaaggagcagctcttacttatcagtgtgcatggagacaaaggcttgcaagaagagagcttagaaagctaaaaatggtagcttgttatccctttgcaatcttcaaatattctttaccatagtatatgtcatagttgtgtttatccatgaatcgtctgcaggctgcgagagaaacaggggcccttaaggaggccaaggataaacttgagaagcgtgttgaagaactgacatggcgccttggactggagaagcggttaagggtatgttgaggctgacgtgacactatttgggcttggtagtttggtacttgatgcttaagtgtaacattctcaatttgcagactgaccttgaggaagcaaaagcccaggaaattgctaagctgcaagagacattgcatgatatgcaacagcaagttgaagaagcaaaggctatgattgttaaggaaagagaagcagctagaaaggcaatataagaggcacctccagtaatcaaagagacccctgtattggtcgaagacacggaa

SEQ ID NO: 23000 - DNA, 2283 bp, Oryza sativa
cttatcttatgaaggaaatgttattaagtgtttagtgaaaaagaggtcatgtggtttttgttatgtgtgctaagtttgaagaaatccctatacgcttagaatcccatttccacaatttgccaccctcttcagaaaaagactgatggtagtagtggaccctgtgtatttggaattcaaaatatatgttttttgtatagttgaacttacgtcaagtttgaagaaatccctatacgcttagaaatcccgtttccacaatttgccaccctcttcagaaaaagactgatggtagtagtggaccctgtgtatttggaattcaaaatatatgtttgttgtatagttgaacttacgtctgactgtgatgttttcaggctttgctgcaaacagaaaggcaagcaacagaaactgcaaagaaagaatatgctgaagctgaacggagaaatgaagaactaatcaagaaatttgaaggtgcagagaaaaagattgagcaacttcaggatactgtccagaggtgaagtctaaacaacgctatcagttgtcattatttcatttcgttgtttgtaatgcttttcttttgttaaggatgatgcctctgtttatacttgtattaactcctttttcttcattctgaatggtctttatgtaaaattgagcacaggctggaagagaaagcaactaacatggagtctgagaacaaagtgctacgtcaacaggctgttgctatttctcctacggcaaaatcattagctgcatatcgtaagtctcccttccaagtattccatgaccctgactacttgcattctgtattaatataattcttttcaaatttcacattgatggtctaatatttcaaatcaattgtgctttgttagcttaaaactccggagaatggtgtagctccgtatggagaagtgaaaccgttacctgtaagtggaaagaataatttgtgcatttgatattcattcaaaagttgctgatatttggtatctctgcataggatatcacccctatctcactcaaccctaaagagcctgagactgaggagaagccacaaaaatcactcaacgagaagcaacaggtgtgtttttctgtttgtttgacatttctgtcctgaagcaaatttcacacctctgtttatttgaccctgaagttatgactattgtgagttatttttcatactgtatttgttttatgcttcaggaaaaccaagatatgctgatcaaatgtgtatcacaagatctaggtttctccagtgggaggcccattgctgcttgccttatatacagatgccttctgcattggagatcatttgaagttgaaaggactggtgtttttgaccgtataattcaaacaataggcactgctatagaggtaataaataatatattgcttgtccattccgctttacctcctttttcttggaagttggaaagctgcatatgatattctgtttgcctattacagatatcttaggcttttgctgtagaaattgaaaaacagaaatactggagcttaaaatttttaatgctgctataactcgcaccctccgtccccccaaaaaaaacaacttctggggatactgtcagattcatccccagaagttgtccttttttgggatggatggagtatagattaaaattcgtttacccttaatgttttttatatccttaatttgctatatagctaagtttaaattcttactttccaaaggcccaggaaaataacgacaaactagcatattggctctccaattcatccacattactcctactattacaacgaacactgaaaacaactggagcagctggactcacacctcagaggcgaagatcttctgctgcatcatttgggcgggtgttctcggtaaaacatatttcatctctgtttgttttactcttaggattttctagtccgaatatcttttaatcaccatttctgaaattaaaagggaatgagagcttcaccacagagtgctggccgtccttttctggctagccgcttgatgggaggaataggtgatcttcgtcaagttgaagccaagtatcctgctctgcttttcaagcagcagcttacagctttccttgagaaaatctatggcatgataagagacaacttgaagaaggaaatatccccattacttggtctttgcatccaggtatgaattgggggcactagcttggtatttgtttataaaaagagagtgaacttcaggtttgttttttttgtgatgcttattttttgcaggcgccgagaacatctcgtgctagtctaattaaaggatctcgt

SEQ ID NO: 23001 - DNA, 18300 bp, Oryza sativa
  unsure (1)..(18300): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgtttagcctgtgagagcatcctgagtcatatctcatatgcatacttagttctttgattattgtactatacatgtcatctctgggaatgcacgtctgtcattcactgaaacggtggtgctccagtttccctgtttctcttgtagtgatacttacctgtactcctgtctatagctgatatgtggattcctctgacgacatacatgctggtgtaaaactgctcatcttaccgtgaattttgtattttctggaaaagtatcattggctccccaaacaatttttcgattgttgatggctaagttttcttaacccttggtaggtagtttatttcttctgcaatgcagtgccctatacattatggactgttagtgttcacttttcctgtactctgcaactgggacaaatatcatatcttctgtaggcaaagaggcattacattatgtataagttgtatgctgagaaaccaaccactaggtgcaaaatcaaacctgatggttctacatgagccagcacttcaatattttggcacccaagtgctagtggctgatgacaaatttaagatagaatacctgtgtcaacctaaaggagacacaaagaggcatactgatggaaataaagttgaatttgattcaccgacgcattgtttggcactgtggattgtagaatattaatttgttgaaaaaagcaatgaaatgacctttgcatttagtatttaaagaggcagtgctggaaacgtagttttctactgttttattattctattcatttgtcttgtgtttaatagataataacttgttatgttaggctgtgttcgttttcttgtgttgggaacttattccttccgcacagaaactgagtgactcattagcacttgattaattaagtattgatttatttattttttaaaaaataggttaatatgattttttaaaacaactttcatatagaaattttttacaaaacacacattgtttagtagtttgaaaagcgtgtgtgtggaaaatgaggaaggtaagttgggaaagatgggggaagaacacagcttaggagctttgggaaccaattaagaacatgggctgagaccctcaccaaaggagatatctgtatgatgacaaatcacctctgagttttgctcttttgaaaagaagttctgatgatctaggggcatttatattaattatggatttgggagctggtcagacttaaaatgacaggcagtggatattttcctacatgaagtggtggaacaacatttgtcaacttctattttattatctgctattctttggtaagcgattctttcgtcattctgcgttatacattcagtgtttttcctgtgacagtgattggttgatagctatactcatttcaaatgatgattgttttgggattactcacaaaacgaaacatcaccagctcattttagaactgaatgtggacagttttcaatcccagtagtcttctgctggccaattctctgccttgtactgtagcatgctctaaattactctacctgcaactattacaaccttgtgcccactgtattcttgttatataattgctaatttcacgcaatttgtgcatgtgtactttaatactggatctgtgctaactgctaagcatcactgaagtgatcatgtgcttctagcttggttttcacatgtctagttcagaagtgcaatcataaaccagttcgactaagtcctcaaaaaggagaaaaccagttctcgtaccagttcagaagaagaaaccagttctggactaatcatgttattaagatacatacagatagaatatttattgcatgttgggcatgctgttgtgtactcatctcactgtactcaacctcagtgcatacccaatcaaaagctatgatacctagatgtttcctttcatcatctatgtgtttagctcactaatcaacattatcgctttgtcagcatgccaatacaggcaagttgatttagtagtgtggccagcacatttcccaaacaatgttctctgttatgataaaggtcttaagacccatagatatatgcttttgttgaattgttgggtatgaatcatcaagagctggtgccatttggcatcaactcatttttttttgcagtttgttagaaagggattggtgtggttgtgtactgacaaatctatggtattcaataagaaattagcatagggtgatagggaggtcactgattggtgcatcatttgcttaattaagtactgccaggttggtgtgttagcctatctggagagagagagagagagagatcatgcaaatcaaagctttttggtagctcatgtcagtttgatacgtgtgcatgcatctgaatgtagatcggtatccttccatttgtctcttcctttgcagatttggggattatttgtgtcctcttttttttttgtcagaagagttcagggcattgccatgtggctggtatatatattcctgctttatcatttgctgaagtccccagaagccacaatacgttaaactctttatatatcagggaggaaagaagtagattaatttgtcggtgttgttaatacatttccctctagtttttcagctgtaaactcctgtgcctagaaaaaaaataaaaagggggtactatcacgtcattatgttaattcggtatacaactattttacttctgatcccacagatgtaactgtatcttgtatataattgttaattatgtttctccaaatacaattttctgttctatgcacagctatatcgatcaatcctcgctattaaaatttggactcatcatgatctactggtttacaaagttctctgtcttctattaatattgtaatttctaggcctttggaatgagtacagtggtttttttcaagtttgttttgataatataatagattgatgtcatcgacataaactttcgcataatagaacttggaatcgtgttactatttttctagagttattttttcaccgtagttttctgtagctagccatgggaatggtgcctacctcgactggcagggagctgttaggagcagacgagcagtgcaccagcctgagtttgaatccctttcagtgcatgttgttggtaacttttttggttacgccgtcaatcatgatgaaaacacctaatgttttgcggtgctacaaagtcgtcaaccatctcgatctagataaatctaaaccaaggtggtttatgtaattcaaaactgactagttgaagctggcttagatgaaatagggataaacatttgtctcgtgggtggaacggaaggtttttgggacagacctacaaagagattcgcacacccacatcgaggatggacggctttcagtgcaaaccgacaaagatggatgaaaactagaaagaaaaaaagtgattggctaattgtattgaaaagagattatgtgttcagttgaaccggccatagcctttataaagagactggtcttgtctcctacagaatcttctccacgtcttactcaaggtagataccaataaaaactcaaaaacctcaacccaagcaaggaagcctgagacccgacgaaattcgactcgaagtcggacttagacggtttgaccgtccatttgtcgccaatcagatcgatcagccacacaccggcgatcatactagccctatgtaggaaatcccgatcttattcaaatttgatcatattttcttatttcatgtctagatgtcaaatttggatgttaacacatgttttctcactactttatcagcaatggatgctaagatcctctttagtaacctaacacatttttttgtttttttttaaaaaaagttagccatgagtccatgacatcctaggacaagagtaaaaaaaaaatcaaaacagataaatcaaacttaaaagaacacccaaaattcataagatcgtcgatgtgctgcccaagttgccgtccacggcgacgtgacaagactacaagagaagggaaccaaaaggtggcaatggcaaaatccttggttctgctcgactgctcctactcatcagtcaccgaggcgaaaggcatggctgttcttgctccaaacccgtaggccatccactgcccattcgtctgcgctcacaagttgcagttaatgctaaacaccaaaggatgcatatacgcaagtatatattccctccgtactcataaataaagtcgtttaaaacaatatttaagtcgaaccttgaaaatatatattataaataactctcgagttgttgagtttgtaaatataaaaattatatgaatagatttgtcttgaaatttttttataaaattatatgaatataacttttccataaatattttttatagaaacaagaagttaaagttatattttgaaaactgtgtcgctgtagtccaaaacgactttctttacgagtatggaggaagtatgctttacaagtaggagtaggtcagatgaatctgatacagtaactatgagtaggattccatcatagagtttgcatgcactggcgtataagacaataccaacacgatcatatgagccaaaaaaaaggaagtccaataattaatccaactatccaagtagtactcgtttagattctcttaaaaaatcagtcgagtattgttaaaaaagaaaataaaatcagtcgagtaattaattcaagtactcgtttgggttctcttgaaaaatctctagctcccttcaaaggttggtgctgccgcttcgtcgtggcactttcctgctaacgaattcaaaaaagcgacaggggaaaaaacacttcatggctgtatttagttcacgctaaaattgaaagtttgtttgaaattgaaacgatgtgataaaaaagttggaagttcgtgtgtaggaaagttttgatgcgatgaaaaagttaaaagtttgaagaaatattttggaactaaacacggcgcaaattggataggaattgggaaaatcaaatcggtgcgttttttcaggtgaaaatgtcaagcagtcatgctgtgtcttgtgcatttcacggcacgatggtgaactcactcgagctattcaattgtgaaagctccaaatcttgtctcggtcatgtgagacatctccggcgacgacgatgggtaaattactctgtcggtttatttatcttttctttttttttaaaaaaaaagacatgtccagccacgtgactgaactatgggtaaattactctgtcggtttatttgtttatttcaaaaaatataaagatgaaatactaagaacatcgtgcccctactccattcccaatatagatttttggggatttcagtcggaaaaaaatacactaatagtttccctgctctctcacaaaaacgaaattcccttatctttcattctcactctccacaagttgaaaaccattctctcccaaatttcatcttttgagcgagactgcaactcaagagcaagcaggagaatgaccctgctagctaaatgggtggcatgatctgataatgcctaggtgaagggtgatcatcttttcattttagagagttaaatacagacatcaccttcctttctattttaagaagttaaatacagactatggaagcatatttttaataagaaaaacgggtcaaagttatacattaaaacaaaataaagtcaatagtgcattgaggtacaactgttaatatcctatatgacaaaagaaaacaaagactaattaatcacacttttaaaaaacaacgtccatggtgcaaattcagaagttgaaaacatacggcaacaaaaaaaattaaattcgaaggggaaaaaaaatgtcgaggaggagaacacggtcgaggaaacaagatggaaggaagcttcacctttaaaatatgcaaaatctccacaaagtcaactttccgcctccgcccgtagacttctttgaccgcatttccaccgcgcgtttgactttggcatctttgaccgccgccatgtcatcgagcctatcgcctcttgccacgtcagatcctcgcagctttcgtttcgcctcctccgctccgagacgaaggcacgaagcatgctgaaggccgccacgtggcacggctcgtccaaacagcagttagtttttaggctatcgctggtcttgcctaatcacgaagcaaattagttaagcgtgtgccagctaaattcacagtgtaaaccttcgtcattagctagcagaccttgtcattagctacataattaattatgtgttactcctaccatgcaagcttaaacagtaaaggctgtaaggctccgtttgaattcatggaggatgaagattaagtaaaaaatacataaaacaagaatattattattattattattattattattattattattattattattattattattattatttattaagttatttatctaatagtttaaaacaaaattaacttctatatagaatttttttcacgaaatatataggttagtaatttgaaaaatgtgttaacggaaacgagataaaatccatatcttaataaaaacaacgcgttacctggattaatatgctttgtcccattgtgtttacgcgataaattactggactaactaactcgccgcacaaacaaaggttgctacgcgtgggacgtgaccatgcgttgtcatcttttaattttcaattttttttcctccatgggcggcgcaccgtcgttgttcaattccatttccacggaataaaatgggagacgaaaacggtggttgatgccgtacagtggactaattaaaaattatttgaagctctttcgcttatcttttggcgtttttttagggatggagtgtaatttatggggcacttgacagttgacatcctaaaaagacaaggtgtgtatatcagtctctcgatcgatggtttgacaatattaattagcgaggtcctcgcacggccgaaaggtttagcaaatgtgaagattcatataggttgcctaattcctatttatttgcatatatatatatatatatatatatatatatatatatatatatatatatatatatatatatatagagagagagagagagagagagagagagagagagaaacttttaaggcttctgtgatttttttagagcaaaattcattgataaaaccttttcgtctccggataacattttgatatcaagaggaaagttttatttatctatagttgatagttttcatagactttttttaaggctccaacaaattttgcaggtatttccttagtgaacacatttgatgttcgaaataaagggtactaaattagtgcagtaactctgtgattttattttatttttttgacaaactaaccgtgtgatttcaagaagtcgaaatgttatggaaatttgttagggcatccacactatgctaaaaagtaggtagcaaggagtcatattacgtggttcactattgtgagggtaggtagtaaggtggatactactattgtgagggtaggtagtaaggtggatagtagtatgatccagtagtaacactactaccaaataacaagcaatcaacaaatattaaaacactctcctttctcactcccactctcttattcacccatccattcctagtaataactaaaacaacaactcccttcattgtaaaatataacaacttaaaattggataggacatatctttctgtccagattcgtacaactaagatgtgtttcattcagtcatatgttgctacattttgggatggaaagagtacatgattttgtgttccatccttattacccacttgctattcccttcattcacaaatgatcagcatatatgatttgtgcacctatgccaatgcactcccacatgccacttaaatttacatcgattaacctgcaacaccgttttttcatatcctatgcatgcaacaagggaaatttgcaccaatgatatattgcttgcatgtatacatgcatgcacctcaaattacaattagttgaatagtacattgaactatgcatgcaaaagaccatttaataatacacagagaaacgaaaagccaggtataaaaagtactatcaaatatgcttaccatttctatataacgttgaaaaaaattatatgatgatcatttatgaatggagagtcttcctcctcattatagtccttctagaatccaaggtattttgtcgaaatatatcctgtctttgaacctttgtatccctaggagagtactacattataaggaggcccttagaagtaatcctctcttcaatgtcctgactagtcgatgcgatgtgcttacaggctacagcaaagaagggtacgtgcagctggttggaagtcgaaaccgcccgcagctgtactctctttatcacacgaaaacaaatctatgactagatgtgatatattttaataaaacgaatctagacattctagtacaataaatctggacagaaatatgtcttgaattcgttgcactaggatatgtcacatccaatcctagttttttttttattttttttacggagagagtagctagcgagagaagttcaaaccgcatggcatacacagatcacacgacacgaacatgctagctagatcaatttaccagttaatttgtctaatgctctattcatcttctagcgcttagactaacaaaagaaaattaaataagttgtacgaaatgtacaatccaacattactgggtgtgctcagtttcaaagtcatgaacaaccatttagacatacaaaacaggtggaaaaatgaaggcgatgcaagaaattttggtcaaggcgtatctagaaattccaagcccgaccggcctaacactctcgactcgtttcagaacattcagcaaaacaatactccctccgttgcttctttaacgtttgacatcattaacttttcaataaaaaattaacaatttctcttcttaaaagaagttactccctccatcccaaaagttactagagtacaatataagtattttttttactataaatctggataagccaaaagttattatattttgggacggaggtagtatataattattatttttttattgttatttgctttactattaaatatactttaatcaatttttttcatatttgtataatcttttaaaaaagaatggtcaaacgtacgtcttcaaatattaaaaaataggggcagtaattaattactgtacttttcctagcccgagctacttgtaaaaacaatatacagccggcatgtcacattagtgtacttgccttgagataaattaatatagagaaaaaaatagctcagctcagctctctgaatttctactactacaacgtggtggctcttctgaactctgaacctttaatatattttttccctcagcgaaagagaaaaaaaaatcaaggccggacgacgtactggcagagcaaagatccgaatcttggggcgtcacatgccgccacatgtggtccttagctcgtctcgttgttcttgcgtcgcatgtgcatggatggatggatcatgcatgtaagctagttgcacttgcaccacactgaccgcacgcagcagtggcacgcctcactcacgtcccgcgtattccctctccgttccttaagaaaagaatctaatacgaaaatatgatatatcctaaaactataagtctaaacagaccattatttagattgatagtactaagatgtactcactccgtcccaaaaaaaatccaatcctagattagaacctggacacatgtgtgtccaggttcatgtgtccaggttcaaacttaggattgggtttttttttttttgaacaaagggagtatgtcatttttagagacgaagggagcatatttctcttgcaaccaagcacaaacagcacaaatatttattatagacaaaacataccggacaatcctctctctctctatatatagagagagagagaggggcaaatataacgtcatcctgtctgtacttattttttccgtgtctgcaggacaaagatattcataccgaatgattcaatattaacgtggtaccatcaataatttgtacggtctttctctctctctctcacacacacacacacacatatatatatatatatatatatatatatatatatatatttgtgtgtggtgcaccagagctgtccttgatcctttatgatattgcttatgctattttaatatatgtatttcttttgagaatgatgaatatatagttgaaaatataatacatgcatataatatcatatgcgtagtagtatatgatttgacctaattaggttgtgcatacgtctttcacataatccatcaaacactagatagatcatatctaggacatccattgtcagtcaaagtcaccattttcgccaccacgacgaatctaattccatttcgtgccagaacgtactctcgtcgaatgtgagagcgaaagcagtatatccacactccatgactccatatccactagccctcctcatggatcaccaaattcccctcctcccttcacaatcagccaacgtgcagtgacacccaaaaatccttggagtccacccaggttcaacgaacctggacgcctttttctgcctccctaaacctctaaaacccgtcccagttcaaaaccatgtccaggtccatccaagagaggttcaaattacactggctgagccgcttaaaatcaaggtggcaaccggccggttgctaccgctttttgacctggtttgcattgtgaggttgttttttcttctccccgagataagaaaaagcgagcgtttgccgtttcggccggatcggcggcctcgggcaacgtgctcgagcaggcttgtgtgtgcgcacacgagtcagtcaagtcgccacatggccggaaaacacaatgcgttggatcgtttcgtggcagacaagttttttttttgagtgattccaaagaggagcaaccagggttcgtaattctgacaaaaaccggctgtattctatgaaatttcgaccttttgatatggctcggaattaatttttggttaaaattttgaaggttaaacattaagtttggtcgaaatttagtcgaaatttatcgaaaaccgatcaaaatttgtcgaaaaccgtgataccgacgggctcgaaatttagtggtcaaccggtaatataaaccctgggagcaactttggtgctcccttaatctcaaaagtatctctaccgatcttgcaatttcttgtgtcctataaaatacatagatatctttatattaggtataaatttggactatcttttcctatgaatttgagtaaaccaaattagacatgttcgcggtatagccgctatgtcacatctgctgacacaaagtgctattcgagctagctgtaccgtagtcgaatgagtgcagccgaattcataagtaaagatacctatatttttggtgacgagactaataaaagtttgcctataattttcctattttttagcacataaaatgtacaaattaagggtaaacatacaataagcacatcattgtattatatcaataaaatcgcacgatcacgctgacactattttgtttcctaaaatattgtgcattgaaattgcgatttttaacacatttgttgcaagacaggataagagaatggaaattgaatgaaatctactcggagcaattgagaattagagactccattttgaggagggaatgggcaaacaacacgccgaagataccgggagaaatgaatccgctatccaaaatcgagctaatatagcactgttactcatatgaatttctagatttttttcctacatatatagtgcaattctatcatacagttattattaatttgtaataggtgtatttcggtcttattaaactccgataataatggtttaacaattactccctccgtttcacaatgtaagtcattctagcattttttacattcatattgatgttaatatatctagacatataaatatggaaaatgcaagctagacttactttctccgtttcatcatgtaagtcattctagcattttccatattcatattgatattaataaatttagatagatatatatgtctagattcattaacatcactatgaatataagaaatactaaaatgacttacattatgaaacggaggaagtagatactaataaaaagggataaaatatacccaaacaatcgagccttgtatatgtattttatctaccttgatacgattgggatcaaagtaatacagtagtatattcttgctttcatgggaggatcaaaaaaatgataacggtataaaaaaagcagtgaagcaagctcgcagacaacacgccggatacaaaggggaaaccgaaataaaaccgccggagaaaaggaaatgaatatatatattttcaatttcgtaacgaaaaaagatatatatataaaaagaagccttgaactccgcctttaaatattcccacctcgcctcgctccccttccccatcatctcatctcacaccaaaaacgaatcagctcgtctccttcctccgcctccgcctccgcgagctcccattccattcccggattgcgccgccgccggtgttgcagcagccatggggatggggccactagagaacgccgtggtggacgcggcggcggaggccgtggcggcgaaggccgcggtcggcggcgtgggcgtggggggttcgtacgcggtgctgcagtgcggggaggactcggagtacgtgaggaaggcgtacgggggctacttcgaggtgttcagggcgctgctggcggaggacggcgagcggtggcgggtgtaccgcgccgtgcgcggggagctccccggggaggaggaggccgcggggatcgacgggttcgtcatctccgggagctgcagcgacgcccacgccgacgacccgtggatcgtcgccctcgtcgacctcatccgccgccagaacgccgccggcaagcgcatcctcggcgtctgcttcggccaccaggtgccacccccctcctcctcctcgtccgccatggatgtctccctctgttcgtctcggttgcgatttggtttggtttgctcgggggaggggtgaaatggtaaatttgctctttccgagatcggcgccgcttgcgattacctggttggagtggcgttgttctagcgacttcttatggattctttttttttcgtcttccttttgcttttttaaaaccatgcgcagtaaaaattcgaactaattgcattatcgcaggttaaacaggttgaatccgagtacaaaatttgtaaatagtaattcataaattggggggtaaacctgcaatggcaactgcagaagttcacaggaggtgagcttagcctttgcagtgatccgcacggactttttttttattttgaaaaagtacttcttctcaaataaataaaaattgcttaaacttaaaatatactctatccgtccaaaaaaaatcaacctcatactgaatattgaccatatccagatttataagatataatatatcttgagtttcttttggacggaaagaagtacaagtataaaatcgtttttaaaactagtagagctataatatttatggggcgtgaatcccgtgggcccacaccgaaccgcacccgtggccagaagaaattcccgtcttgtgcgttggacaggtgggccccactccctgtcacgccaacgcattagcctggccgcttaaataaaagaaaatgaatttttagctttcgctaaatctaattccggacacggttgatgacagcctggcacagtgcgccaaggcggttcacgtgagctgacgtggcggcaccggctgagctcacttgctgttgcacacacacaagacaatctagtaatctaattttatttaatatatattttttcttctctatatttggcggtaatcaactcctccgtggaattgctgccacggaagctgctcggtttgaacggcacacggttggcgtgatgcatctaaaccggtgaaggcggtcagcggtcgcttttcaaatcaaaccaccagcgacagcgcccaaagagtgtgatttttgtgttaggttggggtgggcttacatatacatgtttgaatccggtcgtttgtccgaacgagcgggaaccatggttacgtgaggactctgtatacgttttgttgtaaaaaaaaggatgagtgcgcgtattcaacttactataattgttttgatttttttttaaattttttttaagagattgcacagtctgatctgtgtctatagaaaggagatagaagtagccttgtccctaacttgatcgaagagacgagttgttcttgtttgtgcgagtagggaagcgcaacttgtgctgctgttcttgggggacattgatccccaacttgtcagcgggattggtttctttagtgattagtataatcgtaggatggagtcccgtaccgatcatagcttaatatccaagccaagcatcgtccgtgatttctgttcaaaagtcaaagctttgcaagaaccgtacagagctctgtcgaagaggtcagcgtgtccatggcagcaacagctgcgcaagaacagttataatttactcctacattcggtgtgccgcgttagatctcgcaagctgtctgaatccgaaaatggatcatgccagctcagctcgcatgtactccctctgtccaaaaaaaaaaaagacaaaccctggtttctgtgtttaacgtttgaccatccgttttatttgaaaaaattatgaaaaaaattaaaaagacaagtcacgcataaaatattaatcatattttatcatctaacaacaatgaaaatacgaattataaaaaaatttcatataaaatagacagttaaagttggacatagaaacctagggtttgcctttttttttttttttggacggagggagtactccactgtctgtctgtcggtgtgctctcctcctccacccacatggctgggctctgcgaagctctaccagttggaattagttgaaatgtttgtgatttgtgaacgagctggatgtgatgcgtcgccggccggccccggcatcggtcgatgatgaccccagtgtggcgaggatggaatcgatcgcctgtcagaaagaaacacgtttagctcttaaaaatgccagctttggtcttaattattcacgcacaggaccgagttggctgttgatctggtcccccttttgaagatctctgcatgtgattgactgcagtctgcaacatttgtttttatttttactggaaagtttcagatatgaagtaataatatagttttgccgtacaatggttcagtttcttgccgtttgaaaaaaaaaaaacaatctttacacaagtggctaacagaggcgtgatcactctgctgcaggtcctgtgccgagcgctgggcggcaagacgggccgatcgaagaagggctgggacatcggcgtgaactgcatccaccccaccgcggccatggcgaggctcttttcgccgatcaagctccccgtccacatgcccatcatcgagttccaccaagatgaggtacactttttcgccgtttcgttttcaaggtttgctctgatcaaagcttcagaaatggtcaatgacctgacataacttacatggcaaaatgcaggtgtgggagctgcctcctcaggccgaggtgctggcgcggtcggacatgaccggcgtcgagatgttccgtctcggcgaccgcgccatgggcgtccagggccacccggagtacagcaaggacatcctcatgagcatcgccgaccgtctcctccggaacgatctcatcctggtaagctacggaattgactgaactctctgtggtttcttctgtctactactgtagctggtctgaaaaactgaagatttgtgttgattacaggatcaccaggtggataaggcgaaggcgagcttcgacttgcggcaaccagacaaggatctgtggaagaaggtgtgcaggggttttctgaaggggaggcttcagtcatcgcagcagccgcagcagcagcaacatcagaagcagcagaaggcggcgcagctggtgctatagtaaacaagattagtgagtgagatcagatgggggcattggggagcctagattaatccttattttctgcttcagatttgtacaggaaaaaaactatttattcggagcaataataagagagtaattgggggtggcctaattagcaaaatcccatttgccaatcaattcccatcttccatcctacattttcgtcacgcggcacataacaaaacgtacttacatggatgctcgttcatgtatcgatcgtcagtactgtaggatgcttccaattgaaaccgagtcccttttcaacttttccaagaaacaaagctgtgtccatccacagcgcccaaacctgcaaagtacaaaaacactaactttctctttggcgtcatttcaaaagacccaaccaaccaaacaaaacaagccagtaccaagtccctctcatggctcaacagtgttgtgtttgttagttggaacgaacgaaggacattgtcatcatttgggctacagaatccgctcggtttcttggccgtcctcatcgcgcgagagagtctgccaagatccaagattccggcggctccccggccacgcacgcgcccatctctcgcgaacgtgacgccgttgcggcgttggtgaggacgaccacaacgcaacgcagcacaacacaaacgcggtagaaatgagttgaagagatgtggccagccatggccatatgtggggtgcggggggttagtgtagtatggacaatggaccaccggcggagcgccgttaagctggtggagacgcgcgagcgagacggatccacgcgcagccttctccgtaggcagagggattccgggaccggcggccggtggctcatgcttggcggagggggaccaattgatgcaattgaaatggagatagctacgtaacggtattccgtttaaacgggatgatacttcagaggtactccctcctctccgtctcataaaaattatatttctagctccaagtctttgtcctataaaaattatatttctagtcatgtggggcccaaccaattgattcatctatataagtttaatttgggctgctaatgcttgtaattttattaagtatgctaattatatgggttaattctctcaaacttccttttaatcatttgtatatatggaatgtgtgcatgcagtgggttcattaaataagttattgtggtcatttttcaatcctactattttatcctaaattagctagaaatgtaatttttatgggacggaggtagtatcatctgatgtgtggatatcagccgatacctaccaggtatctgacaatactttagaggtttcatctcttctgaacggaatatcgtcctgtagcatttttcattgaaatttactccgaactatttagttttttttagggggtggcaattaggatatttatagagtggaaataagattctatttgctttactactttatccctattttttctaagggaaaatctgctctaggacactttaggctttattttgttgccaattccaaccttacttaacttgatgccttacaaaatttagtagtatttttgagaggaaagtttcggaagtaacaaattttagtagaatgtcattggtaaggtaatgtttagttcgttaccctactaaaatttggtagcactacaatttaatacgtcgaaagtggtaacaacgtgaacatgccatctcactttgatgtgaagttgaacgagggttccatagcaatgccttcaaaaaggtgaacggcgctcgagggcattgttgtcgctccaccagcaagccgagtaagactttcacctcagagtccccatacaaccctagcatccacaacgaaagccaccaaatttcacatacacaccgaagctacctgcactatgcacactaccacctgcacaatggtcggactggtaccattgacaacctgctctgccacctagccagacccagggagccaggtcgtcggtgctactagatgactaccaactagacagtcccctcacagagaccaccatataacctggatgtggatctacagaaagagaggagcaggaggagggggggggggggggtagggagaaggaaagatgggctgcaggaa

SEQ ID NO: 23002 - DNA, 915 bp, Oryza sativa
gtggggagggaggcgtcgtggctatgccgacaatggcaagacaaggtggaacaggagaaaaacgaggaagggaaaggaagagggaaggaggagggaagaaaagggtgggagttgccatcgctagcggcggcgacgctagtgggacgtggccggcaaacctcctctcggggctggtcggctcccgtgtctatttaggagaacggcacgtgagtccttttttctctgcgtgtatagacaataaattgcttctttttaggcccttctatcatgcaactagtgcttccaaacaaatccctataacaccttgtaagccatagagacaagcattgttcatgtcgttctgtaggatcatcccaattccgtccgtgcaatcgtgtggtctgattgagtcaacaacattttgtttggtggaagaaaactgatggatcacctattcatttatagggataaattgagcagatacctattcatttatagaacaagtggttagtaaaaaatggtttttttaaaagaaatgtacttttagaaaagtgggggcaaatagtaaatgacaataattcaatggataatctgaaaaagaacagggccttaatttcatctaactgtgcagtggacatgtccccttctacttcaataggttctcctgttgaaaattaatgagtaaaatgcaccagcggtccttaaacttgtcaggaggtttcacttaggtccacgaacttgcaaagagcacatcgaggtccctaaacttggtttattgtatcatcccagtccaaagccgcgtttgactgtggtcttgcctacgtggcacgccacgtggacgatgacatggaatttttttatttttttctcttcttccttcttttttctctttcttccttgtctaaaagatgaaaatgcctcgtacacatcatcgtc

SEQ ID NO: 23003 - DNA, 13879 bp, Oryza sativa
ttgcaagttcgtggacctaagtgaaatctcctgacaagtttaaggaccgttggtgcattttactcaaaattaattgatccatgacacataagccccctcatctagaggttcacaaactgcttaacattcagagacatccatcatatggagttgtttaatcagcatcaagaaccgcgtgtaacttattatgatggttatgcaccaaactttcattataatgtctatcagttccgaaggaaaaaaatatgttaatacgattttccatgttttgcacgagcagctacacgagaaaatagcacgagagttttggtagtacaaaattgggccaactcgctgccagccacactactagagataagataggtgtctaggttcgatgaaccacaagcggtaccgaccgtgaccggtccgtgttgtggatagacgtagccatcccaattgctgtggagctcccaaaagttgtggaccatccaagtcaaccacatcctgaatcaatggttcggttcacttctcaatcgacgatccaaagctctagtggagccaaggacgatggagcaccgttgtgcgaggttccagcccactactctcaccgccttacccctcttcttcctcccgctctcccttgccactctatacaagatacccctgtgggagcagcactagcccccatgaactagctacattggggcatggttgtcggtgatgctcctcagcggattgggaggagaagcagtgcagttgatgggagagtggaccggcgcggcggatggggaagaggcggcaggtgaaaggagaagcggcgcgacggatagaagagtgaagcggcacggtggataggaggcgaggcgatgcatcctgagagtaggactgagatacacttccttaccttggtcacatgcattgtaggctatgtgacctcaacaattactcaccctaatttaagctatgaaaaaagtaacgtgcaatggggcgttcgaggccttgggccaatttcttagtttcagaaggactagccacacccatagcgtatcttgcattgccgctgctcttatctactactaccagtagttgttgctatagaagaaacgcaccaacacagtgccaagtcgcagcgactattcatcattaacttacttgggatgacactgtgcacaagatgctgtgcaatacaggggttcaacattgacatatgcttgtaaacgtcgggaatggaagcatatcaagaagggttagaagacatgtcaacagctcaacatgacatagatgtttggttgtgtttagttcacgctaaaattaaaagtttggttgaaattggaacgatgtgatgaaaacgttgaaagtttgtgtgtaggaaagttttaatgtgatggaaaagttgaaaatttaaagaaaaagtttagaactaaactcggcctttatagtgacagatggtgtaatagacaactttccacgagggtaccagagcatatgaacattttctaatgtaggaatgtgggatcatataatttggttgttgatgttagaaacacacttaaaacggaacaacctagtacttgcatacgtaggccttgttcggaagacctacttaccacacggctgcagctgcacagcgcagccaaccaacggctgcaactagctaatagtagctacaacctatagatgttgaagctagcaagtgtagggagcagtagtttttgtgcagccgaacgaatgacggctgtaaaatttgggctaccgaacagacccgtaaaacgtaacgactcgttagaatataattaattaaatattagctattattttaacataaatatatcaatttatatattttaacataaatacattaacttttaagacaactttcgtataacggtttttccaaacatttatagtattttgataggctttgcatggaaaatgaattacaggttttttcaaaagtttagtattttgataagcgtgagaaattgagttagatagggtacagaaggcagcctcagttaccctttattactatctttttcatggttttacttcaatttctatcatagaaacgtacatgtcgcacttcttaaaatggttagttaccctaatgatttgccctcgtataaaaaataactcagtctgctctcaggcgagccacaattttgacactagtttgaatttccacaaaaatttaaacaagatataaacgcagcatgaaaccgtcagtaaagttataagtatgcaaaacccccaaccagccagaatatgggccagaaccagtgacagaagtgcagtggaacgcaaggagaaatccgtccaaagtgagctcacgaacttgtcaaatcaaaacaatatcgcatcaaaacaaggcggcaaacggagactgctgtgattccacgaaacatgaaacaacggagcgtttcgagaaataacgggtttaattccataatatttatgacacccagagcaatgtaggcagttctagcattttaggatagtagaatgtacctactcccagaagtagcataccacaaacccaagcgtaccaacgattatcagagtacagccataagcagtggcaccaagttcatgaatttgccaagttattcatgtataatcatgagagtaacgcgaggcccaattaataaaagttccaaaaggccaccagcctaagcagatgcaccaccacggcggcactcgttcagcatatccaggtagaattggcacttgctgatgtcacttccatagttgttgatgcactgcaatacaaaaaaaccaataattaggatttaggacaacctccatgctagtgcgtagactcttgttagttacaggtagtagcatgcatatacaaattaattcttatcaattcaatctatgttaacactatgaagaaatgaggatgctttcttctgttcacatagaattaatcagatgatggtaaccagagaatggtggggatcaacatgcaagccagaatgccagatagagttttaagagtaaaattaaaatagataaatgaagcatcatcaaattcattctcatggctgcatgggaaatgtaagcacgagtagatggaagcagccaggcaacaaaagataactaagccaaaatgggcaggaaaacatacgtcttggaaggccttggaatggatgctgcatgagtcagatggagtggcgttggccattggggtggcagaggcagcagcctcggagacaacagtctcatgctgaatggtacggggacccattacagcatcaacagccctatgtgccatggcactaccagtaccaaaagccatgcctgcatatatgtgcaaagaagtacttattagaaactgcattgttaatataatgctattcatttcaattaaaatgaagcaaaatgatgataccttgagcaatagtggaaccaattcctcccaggatagagccacctccgttctgggcaggagctggaggaggagcctgccttgctgcaatgaacaaattacagatgtcaatcaaagaacacaagacacaacttgacaagacaaaacactttaaaaccagtacagattatacaggtacaatgagaacataaggcacaacttgacaagacaaaacactttagaacagtaaagaataacacaaaatttgtgaaaccccaacatggacaaatcaatacctggctgcggagggttcctcacgggagcagcacgtggtgcagggcgagaccttgctgcaaaataaatgtcaaagcataaaaaagaatgaaatgggttgagatgtgtcacactaatctagagcatatgcatgtagaagggcataatacatacagttaacaacatcatagtcttcgtacataagaaaaaagaaaaaagaaacaccacttcatatcagaatctatctaagaagggatgaacagaaaatcaggccccttccctcaaaaaagattctatttgctatgtgccccagtctgaaccaaatgcaaatatactaagcagctggttattcatgaggcagtggtgccaagctgcatagaacattatagtacagtactaacttatacaagtggtctgcaaactaattttagtcattcagatcttttaatctttgaacactatatatatatatatatatatatatatataaaatcttaatattagtaaatctcacgaattttaaaggaaatggattgataagagagaaatgctggaatatgcaaggccgatcaatgaacaaacccagaaagaagggacttgcacttagagcagccaaagcagtcaataacatctctatatgccccataactaagccaagatagcatgaacaactacagtggctactcaaaaaggcaaacagtatttgcagcccaaagcaattgaaaaaaaaaagcttaatgcacaatgtgcaaggctgttcaacaatccctataaagaagggagttgtacttaaaacagctaaagcagtcaatagcctctctatatgccctctaactaagccaagatagcatgtataactagaatggctactcaaaaaggcaaatagcatgagctccccaaaggaaccgaattgaacaatcttaatgcatgttcaacaccactttctgatgaccaaatatgaaatagagatagttgtatggaactaaagactgcaggaacacgtagaagatgtacatctagaacatcttggtatcatttcttgttatagaagatgaggtacccaagcccaagcaaatttcaaaacttccacagctatgatggctactcattaagacagaatgaaattctacaatagtgatgaaataaacacaaacagttaactttaatgactaaggcaaaatgcaagggtgtagtttggattgtggatggaaaactgtagcaagaaatagtatgaacataagaatttgatggaatgtctagagctgcttggggagcaccgcatattatggtttacaaggcgctccctcaaaaggcccaagtgggcatcaaatgcccatctgtatgcacctcctaactaagccaggacagtatgcacaactgaagtggccactcaaagaggaacatggaatggaagccattggtttatcatagcacatgcacgatgcaattcgcaatgtatataaactaaagatatatatgttggtttatcatagcacatgcacgatgcaattcgcaatggaatataagacatatgtggagtccatctaagaaaggatcaatggaaatttcctttccctaatatattatggattcaaactttgttatatgcccctgtctgaaccgcctgcgcattttgccacaaaacaattcgcaaccggttattcaagaagcaatcttttccccgttcctgatctaaaaaaaaaaaagaaccccttcgataatcccccaaacacgggtagagtcctatgtatacaccgacgacagatctgaccaatctagcagctaaatacgccaatacaagagggagggcacttcctgatcctacatcccaccaaacgctaaacgtgagaccacgaatcgcccaatcgcgcggcgcagatcgatccgaatcgaaaatctacccaatccaaacgaaggccacagatccgaacaagaacaacaacgggcgcgttcaacgcgagaacccaatcccaaacgccgcatggctactggggctaggggggagagagaggatgggggttacctgagctgcggcgagccatggcggtcggcggcggaggagaagacgaaaccctagatggcggcgcggcgaggaggggagcgagcgaatgaagagggcagcaacgggtcgggaggttgaacggcagccacgcctagggttaggcttttatagccgcgagtccggatttttttttcttttttttttacccgttcttgctctctctctctctctctctccaacctcccaccttcttgcaagacacgccaagctgacatgtggggccagaaatctgcggtgacatgtggggccattacttgtggggtccacatgtcggcggcacgcaagctggctgggagcctttgaccgttggaggggatatgctcggaacactctggattcctccagatgaccggaagcagcacgaagccgtgaacggctacgttttcatttttcgtgctcccgtgatgataaggtgaaaaatgattcgtgattcttccgatttgtacaaaatgaattgagcaatttagtcaaaaatattaagctcaaattagcatgcatttataaatgccagatgaaatatctctaattaataatcttctagaaatctcaaactaatatccatattaaggtttggtccaaccagctagatcccacacacacaaccaaacgcatgttgcaattgcacacaccattggcattgaaaacaaaagagtatgctgcaaaacatcaggaaaatatgctattaatccatgccaaatgctcacacaaaaattgattcgacttgcagttgtaatcccctagacgagggtgtttaattgtacaactcgcagtggctccatgtataaaatctcaatcccctggcctataaccaaagtggctgaggagaccattgtacagttttgcgttggcttcatcatgtattggtaactactgctactatggtttcacttgaacatggaaatgtcgaagatgagggcagagccatccgtggacacggagacgatggagttgccatcagcagagacggcgagggactgcacgacgtcaccgtggccggcgaaggccctcacgcactccccggagaggctgtcccagattcgcaccatgccgtcgatgcaccccgacgccacgaacctggacgggcccagccatgccagggatgtcaccccctcctgtttgttgtccatcacacaggcagaacagatatactgtttgagtgcatatctaagaaatggaagtgacggtttttggcgcaggcagaatctaagaaatgggcgacggtttttggcgcttacatcgtggttgcaagtgcatcggatcgattggcgaccaaggtcccagatgatgagcttctgatccatgctccctgtagccacccaattgtaactgcagaaaatactccaggtcaatgtgagaaatgtgcggtgttcacgtgtttaccatactgctactctatggatccagtaccttggtgagatgccgacacactcaatagagccagtgtggccgtccagtgagccaacaacctgcaaaacgacagcgatgatgatggtaccaaaatgccagactgcatacattttcaaacaaaacaagaaaaaattccagcctatgtaccaacttacatgataaagacacactagcttgagtcataagaacacttacctggcctgagtttatgttcacaacacacacagaattatcctttgaaccactaacaattgtttgggaatccgaagtaactgataagcatgttaatccatccgtatgatagccatggcctggagacaaaaaagatcagaatttgatgttcacgactgattgagtatatatgaattcaatcatatggtaatttacctcgaacaacatgtctgctttgtgcagttcttgggtcccatattctcaatgatgcatcatctgatccagtacagataagtttaccttcagaagaaggtatgtgcattagcaaacaatattttcgttcaaaaactatgttgccactgtagaacttctatgtggacagctaaataaagatggtaggagaaaatttccatgctaaagcatcccaaacaacttgtttactcagggttaactaacaaaattaacataagcaaattgttattgatcaaggaaatatattggtaccatctggagtaaaatcaccacatgtcactgtgctactatggccagcaaaggtattcagaatggcattatggtcagcattccacatccacaaattacaatcttctgatcctgcaattatcaaatgccctcgtggatgccatttaagccactacaataccaaagacatacagttacaccacaggactaatcatgaagtattcatatattttgggagaggaaacaagagtttgtcagcggcaataagttcaactaacaaatgaaatggaacagaatcatctcacctcgaagccagatccagaaccctcaagggttccctgaagtgttcgtgtagctgtattccacacatttatgcgtccatcaaaacttccagaagccaaaagattcccatctgaactgaaagcaaccgtgcagacagtatctgtgtgccctgtattgcgaagctattgcataagttcaataaaataattccgagtatcaacactctgtgataataatgattatgtgatgactaattacaacaataatgtgcatgcagaaaaaaaagaaatccatgggccataggaaatctcaaaattctttgatacaaagtatcgagcacagaaagcttctgggttccattgctgatatgcatgataagagagagtaatttaacacaaaatggttaataaaaaaatgagtaaatgatttgtctgcataagatcaatatataacaattgaaatgctaatatgttgatttagagactacaggcagtataccaaaacattccattaacataaatgaatacatcaacttaataaataaaagaaatggaagtgaaagcatatacctgagagttaatattttttaaaggtggaaaggaacagagatgttcccatgaatattttagacacagcaaattaacactgtaatagtaattaataactaaatcataccggccagctccaaaacatcctctgctgatccaatcttccacaggaatcctctatcgtctttccctccagaagccacaagtgatgcatctgtaggactgcatgccacagcgaatatctcgtctgtgtagaacaagaacaggaagtatcagaatatgtataacaaaatctgcatggataagtataactggagactggagtacaaaaaaaaggagcaattgctgcctgagttatggatggtgtggctcagagaacagtgcatcaaagttacaccaatcaagtactatattgaccaatgatcagcaccaaaaaaatcataaattcattcttttcaaccaacttgcctgtatgagcacgaaatgcatattgggaatcatcctcttgcatatcacctgaaattgaaaggatagataattacaaaccaaatttcacaaatcacaagtaagacagttcagaatagttaaatgcttagcatgtaaatgagcaactgaagaacagattgcaactaaaattctagaaaagagaatgttcctctaggatctgacaggacagctgtagaaacataaatacacaaccattgcagttttctttataaatcaaattaaggctggacaaaatatgtccaactgtcatatttctcacaattgttccatcttttttaggacgcaataatattttcatttgcaagttagataaagaaagcagttagccgattgctaaatcatctaaatgcagttgcaccaaacgagattaccataatgcacctgaatgccaaatggagcataagataaacagtaaaacaggcaaaaagcataatactaaaacagaagtgcactcaaaataagttttccggatactaataaaacagaagtgcactcaagagaagtgatccagattgtagctttgcttaagagaaccaccaagacaccaacatcaacaaagcaaatgtcaaactacgccccatgtaactccaacaattatataggcagtataacagcataatagtaacacagaaatgcatccaaaataagtgttccagcttatgtagcccccaatctattgcccatgattgtaattctgcttaagagtcgaactcatgatattctacagaattccaacagtattggagaggaaaatgttatattctacaaagcatattgagccttagcatgcaacatacccatcccatcgtcatcctcatcatcatcccggtcagggagatctgaaaaacacaaccaataatagtaagcaccaagcaaagcagaaaacagatagatggatagtactactactagtagtaatacaaaccttcctcgtcgatgggtatctcgtgtatgatgtcctcctcattgatgaacacctcctctccatcagagccttcgccggcggggacctcgcccgagatgctcatcgtgacttcacctgagttgggggcgactcctcggccgcaagaaacgagaggggagaagggaggaggaggagcggcgcctgtgtcggcggaggtgtgcccgcgccgccgcgatgcttgcctgcgacgagccgggctggggcagactagggttctggacttctcggcttctcccgcctagtgtcactcgtgtagtaggatggcaatggggcgggtcggggccgggttggtctggaacggccccgcccccggcccaggagtggagggcgggtcgaaatcgatccccggccccggcccctccggggccccgctgcacccgcaggtgaggacgcttggaggaggcggcgcggcgacgggcagaggcggagcggagacggcggcgacgagcggaggcggagcggagacggtgcggcgacgggtcgaggcggagcgaagatggcggcggcgcggcgacgagcggaggcggcgatgggccttgggctttgatccgtgggctgtgggtaggttttcccccataggcccaatcccacgagaagatggaacatcaaaaggtaaaaaaaaaagccgtggcaaacccgtaattattcgcaggaagcatcacttcgccgcaagacggcggcgaccaccgctcctcggctggagggagccctcgtcgccggcgaagcccgcgcggccacctcccctgccggagttggccatggtgagctccacctctctctctgcgtgtggctgcgcgcctcgctccatgttccggtcggcttattccttactcgcttcctctctctcgcgcgcgcgtctccgcggcgctcgcagttctccatcgcggccatcaacgagagcgacaccggcgggcagtgggagccgctcgcgcctaccaaggaagctcaggcaagtctcctccccccttgtcgccccgagcattctctcttcctgcgtatctatctaatgcttcgcctccgtagcttgtgattttgggccccgttagggttttcggttcttcgagcgcaatgtgatggattgattggttttaagtgggtaaacgcagcttaatgttgtggcaagcagactctaggagatgtagaattcgatcaccctgttctttgatgtgatgtgatgtaaggtaccatgtgttctttagcttgtgttttcgacaatttgggagcttgaagtggggtttttactatctatggtttcttccgattctgcgacttgcgaattcaaaataactgttttttgttcctttgatttgatgtttgcttatcccctaataaaaggataatgtaagatttcggttttcattatcggttgtaggtgtaggagggcactcaggttagacctttcaggttaaggggcagtattcttgatgttgagctatacatgctcaattgctcatgatgtagacgaatgcgtgatagcatagtactacattttttttccaaaaaataaaattgttaggaggttaaggtcgttttgaaagctagctgttggtaaagattttggtgtcatctttagttatgctaggaaccgatttaattgaaatacggaataaatatcttctaaactgctttacgagaatcggaagattaacacagacaattattataagtaaataactttgggatggaaatttttaggattactagctaattaccaatcctccttgacatattttgaattaacataagttataaactttatgaaaagttgtatatgtttctcagaaggaaaacacgtatatctatatcatgtgcctagattatctattatctagaaaacatctcaccaactcaatccataggagccttttgatttagatgttctaatgctccttctctattcggaaggagagatatgcccccccccccaacccaaaaaagaaaaaaaaaaccctgaactaaacttggtttggtgcaagtctttttcatttttaattaaatggttaagaaggatatctcagggaaattccaagttattattgttaatagccctttattgaacatgctgccatctgattatatatgtggaactttgtttagttagaggcatgatcataaaaaggtgctccaacggaacaaaagggaatcttccaggggcagatttctactttattttactcttttttaatccttgaataacattggttctattatgtaaacattaatttaggatgattcattgaccactctgattgtcttgatgttgctctgctggtcctggattacaatggaatgcatgtattaatttatagtttgataggtaatatacttgttcatctgcccttttattgatgtgttgatgtgttgggatttgggattggggatggtgttctctgtgctggatttttatggacggatacatgattggtaatttaatgcattatgtatacatatctactccctccttccacaaaagttagacctgttacttttttcaccaagaccaagagaaattaactcatttgcatgtaacaaagatcaaggagtatatgcacgcatgcaaccaatgaacattaagatggctcatcgggttctgattaaacatcaaatttacctctccgtttaagtcttggatgcatagagactataaataggaacaacttatttggattttggaaaaactaaaatatgaaataggtcgaactcttgtggatggagagagttctggctggtacacatttttatttaattttagatttgaagataattatttcggtatctttaaaattagaatatgtgatctgtattgtttcgagaattgttgcgatgcacagtcagtcagtcactgtgctagtacttcctccatatcaatataaggacttttagagttgggcacagttattaaggagaaatgtacaataaaatggatggttgtgattggttcagatgaggaagtaggtggagaaattaaatgggagatggttgtgattggttgagaggtggaaaggtagctatattttgggacaaattttgaatgctaaatgtgctatgttttgggacggagggagtatatcataatataccagttctgatgtagttttacctgcaccaactagatgtgcgtggctatcatatcatgtctgtccaaggaattgattctgccagtcttgtgcaataggtaggtcactgtaattgattgagaacacgtttagtagttaattaacagtatttaactgaaggattcttttgtaaatctcttcctgtgctaaggtcattttttttagttttacaacttacaagctctcaattttgttgccgcaatattactgtgttatgaaattacttttcaaaatgcttaggaatcagcactctctcagaagtaccacgaggggctcctcaagttgcaagaaaaaaattatgtaaaagctcgtgaacttctggaggatgtcttaaaggacccactaatatcaaaaattcaggcaatctctataagaacatttcagatatcagtttgtttagacctgtgctctctataacaccaagttgtttattttaaacaggctgataacattgtcagtgatcagcatttgctgcagctaaggttcttttctccatacctcatttgtaatgttcatgatgtaattccatttttatttgttggttaaaatcattgacatagcgcgaagaattataccaagtggaataaacactcataaaataatgaaatttcttagaactacaacagctcttaatttaagaaagatgcatttgtgtcatggggtaaccacacccccatcatctaattcaccatgttgcaatgattcataaaattccaa

SEQ ID NO: 23004 - DNA, 846 bp, Oryza sativa
tcctgcagcccgatcgattgttctggaaatggtgatgcttctacccctgaagctctaacatatacacctgatcgtgaggcaagtgatgtgaagcaatttctttccaaaatatcaaaaaattgtggacctcttcatattggctatatgttacttgaggaaatagctcagaccaacataccttttcaagattactttgttaagttcattgaactagacaaaattactagaggctgggctcaagatagatctgcacaatgcagcttatttcttgctgaattatactatgatcaagctctttgttctggaagcccattagcatcctcagagttgtccaattcatcttaccatctttgtaaggtcatccaatcagtagctttggaattgccattcagaacctctgatggagcagcaaagtccaccaatttggatttgaatatggaaagccatatggaagaggtgtgttcaagcgataaaactgagaagaatgcctcaaatatgtccagaaactctgtaaattctgtcaactcggtttccagtaacattctttgtgatgaaacatctgaatgtgattcttcttcaaacactaattgtgttttctggattcgcttcttctggctgagtggttgtctgtccctttcatcagactgcaaagaaaaagcttacaaggagttcaacattgccctgtcacttatgagaagtagcaacgaagccaaaatcaatagagagtttgtccttctacctcacaataagcttgtaaaattgcttacagctgataggattcttcgtgaaattaacttggtcaagcttgaatctttactttggcataatgatgaaaacatcaataaa

SEQ ID NO: 23005 - DNA, 13299 bp, Oryza sativa
tatgtcgcatgcatattgactttactgacacgtaaaagcctggtgatatagtcaaattagaatccgacaaatgattgaataaggtttctgttaccgacttaccattgaccctgaaattctctgtttttgcagaattggatgaaatacagtcaagcattgacagtgccttggaccaggcctttttctgcttatatggtttgaagataaaccctgattcttgcagtgaagatgatttagcagtacacaaaaatacaagccgtggtgattatcagacaaaagaacaatgtgctgatgtgtttcaatatgtcctgccatatgcaaaagctctatctgtgagtaaattcatattgagttccttcattttgttgtttcagtttggtaagaagcatcaattgcagcgcatagtgccttggtcattctttattcattttcttcagaaaactggcttggttaaattacgaagagtgctgcgagctatacgtaaacactttccacagccaccttatgacttattggtcaataatcctcttgacaatttcttggatggacctgattcatgcgaaaagattctctctgaaatttacgaaactaatggatctaaggaagctgtcctgaatgtactgttcccaggtgaaaatggctacgaagcattcaagaaactgtccaatgctaggttggctttgtgcattgtacctatagtccctcctctccttttatttttcttttgcactggaacaagtttagttgtggatataccctaagtacatttttgactgattgctgcagctcagagccatactcagaagtttatgggaacctgtatcactacatagcgcaagttgaagatataagtgcctctgacaagtatacaggttttgtgttaaaaaaagaagggggtgaatttgttcaacagagtgctaaccttttcaagtacgatctactgtataacccattgcggttcgaaagctggcagaagcttgctaatctgtatgatgaggtatgtttatttggttacagcagttgattgaacctgtatcattgtatcatgcatatctgttgcataacaagtttttgtcttgttcaaaaacagaggttgacttgttgtttaacgatggtagtaaacatatcagcattttgtactggcgaacaaatacaactttaatcccatgagttgagatgggtcgtagacatagtcgacgctgcctattgatgagtttagcattggctaaaaccgcttctgataaggtgtgtcctcttgttctgtactcatctatgagatgccttaggtgctatttttcttctttctatcttgatgagaacttcactaatattggcaatgacgtctaactcattttctttcaggcccaaatgcatgaaatgttggccctagtttattatgatagcctgcaaaatgtggtacccttttatgatcaaagggctactttgccagtgaaggattcaacatgggagacattttgtcgaaattctatgaagcactttcagaaggcgtttgaactgaagtaatcttacataccttgttagtaatctcatattctgtgtgttgtttgccacaagtaggatgataatgcttatttccttcacaggcgctgagtggctctatgcattttaccttgggaagttgtgtgagaaactggggcattcccctgctgaagcattttcatactacaacaaagctgttgtgttgaatccaacggcagtcgacccggtttacaggatgcatgcatcacgcatgaagttactttatacccaaggaaagcagaatctggatgctatacaggtttgtctaagattcatgaatcagtttttgcttcttttttttttctttgtaaaagtgttacgcacggttgggttccttatttaatagtttgtgtacagtcttaactaggctattgacatgggcactggccaagggccaaggaaagggtgcagccttaaagaggggcctgctcctcccttggcctcactggtctagcttactactagcagtttctggttttcccctcgattgtgacaggctagtttataatagatattttgatattaactctattgatttatgttttttaggttgttgctgattatacatacaaacagtcaaccaaggaagatgtcttgagcatgctacagtccataaataatgtcaagaattcaccctctgatcataatgataaatgtgtccttgatagcacagcggagaataagtttgttgaccctgatctacttgataaagtgtggcacatcctatatgatgattgcctgtgtgcccttggtacttgtgtggaaggtgagctgaagcatttccataaggcgagatacaagcttgcacaaggattgtatagaaggggtgaagcaggggacctagagcgagctaaagaagagctttcattttgtttcaaatctactcgttcttcctttacggtgaacatgtgggaaattgatggttctgttagaaaaggaaggtaaagtttttttgtccttgtgtaatgtcgtaattacccatttacaaatgcatgttgatttatccaaccattacagcttacaatattattatcttcccaaaaaaactctggtttaccttccattttccaggaggaaaaatccaaatattggtggatccaaaaagaatctggaggtcagcttgtcagaaagttcacggaaattcattacatgcatcaggaagtacatgatactttacttgaaccttttggagaaaaacagggatttgtggaccctagagagggcgtacacttatctgcgaactgataagagggtaccccctaataatcacaacaatgatgttgagctatatttgttttgtggatatattataataataagtctatttttcttgtagtttgctctatgcttgggcgatatcgttcctgttggtcttgggaagtaccttcaagttctaacttcagcaatccgcaatcctgagattcgtagagtttctggcgatgcttccgttgagaacctacttgagaaaatgtttggtgtgttcatggaccatgcaaacttatgggctgatataagcactattccagaggtcaatagtcccgagctatcagaaagcaatctttacaggtaattactagattagagtgcaaaatacatagttactcaagccagatggttttcatactttatttccttgtggcagttatatccaccaatacatccatttgcttgagagtgatgtccgactggatgttcttgaaggactaaatgagaagataagaaagcgttttaaaacacccaaactgtcaaacagcaatttcgccaagatatgcaagcacgcttctctggcatggtgccgttgtattctcatcaaacttgcatccatcactccactgcctgaatccatggaaacaactgatcagcctgctccactatccagcggtctagtgctttacatcgacttgcaacctgatgagcttctcatctcgtctcctgatgggcctgctcaattcaaaggcctcgatatgaactggtttgagacttttaacagaattaagaacattccgatcaggcaaacatccgaagataacatggagactgctgttactgtcatgaagagcacctacaacttctatcgggagagctcttgcggaacattcccatcgggtattaatctgtacacagtcaccccatcgcagccacctgttgaaggcctacagcaagccccagacgcaattgagaaccttgacctcagtattccaaggaagctccttctatgggtttataccttggtccacggccgttactccaatatatcagccgttgtaaagtactgcgatgagatgaaggtatgaacatgatgcccagtatttaaccatataaccttcccccttcacctcaactaacgcctacccgttcttgttgcagtcaagaagtaaaagaggagccccgacatcgacagcgacagcttcacagcaaaccacagtttctccccaaggtatcgcatcaaacttccgccatctgggtatcccttctttccgtacccgaaaaaatgcctaatgcatgttgtgtgcttgatgttataacagttggctccaaagagaagagcacccacattgaccctagcgaagctcaagaagcagcagcccctactccagctccagcagcggcgattgctccttcccagcaagaggcaggtgttgcagttgcaagcagccctcatgaggcccagaaaaccgccgccgcggcggcggcttctcaactcacccgtagcagctcatcgagggcgatggagagcactggtcaggatggcggtagaggaaacgacggcacggcttagctttgccccatgtctactggctgctagtaggctaatttctgcagtgtgtgtgtgtgtgtgtgtgtccatgtgaatatgtgtgacctgtgtggctgtgtgactgaccccctcctaatgttgatgtctcacaacgctgatgattaccgtcgcaggaaaatatgctgtacagttattgaaaacctgtaacagacagtagtggcatgcttattgtcactcaatttacctaccaagatataggtggaaacataggtcaagtgcgaataggttcacaacctggaatgttgttcttacccatggtgtactcggtactccttacccattagtgctatgtaaagctgcgctcataaaactgagtagttttttttccccgtaggtgacttgataacactgagcattaacgatgataaattagcatacccatggctcaattgcacccaaagaaattcagaaaaaaaagcaactacaaaaagaagaaaaaaaaacggtacagtacaaccccattaaacgggctggcccatcattaggcagcaaagcttattgggccggtccttggataaactccaatcgcacctaagcacaccgaggtcgccgcagaggcagcagccgtcagccaccacccaccgcgaccgaggaagaagaagagaggagatcaggaggaggggaagaggaagtagggatgggtttcgtgatggagttcgcggagaacctgatcctgcggatgatggaggacccggggaagcgggacgcggcgcagcgggagcacgtgtaccggatgaaggagcggtgcgagcgcaccaaggcggcgtggagcctcccgctccgcccctacggcttctggaccttcgaccgcttcaactcccagctctcctgggatccccagatcagccacgcccccggccgccgcgacccctacgacgacgtcctccaccgccactccaacccacccccctcctcctcctgatcccccgattcgatccggaataggtaacttgcccctcgatttgcttcttggatttctaggtttagttgttcgttgctcgattcccctcttggggaggtccaattaagcgattagggctcgtttagagggtttaaaatgtcttagctgttcgttgctcgattcccctttttggggaactccaaagttaagcttgcttgtcgaacattcaatgttcattgcattcggatagtttgtatatgttccattaggttaggcttggtcacctgtgagttgctaagcttgaggtgttcactgaactaatttccaatctgactgcactatttccaatctgacatcaccaacagccactcaaaattcaatcccctaaatcattttttttagatctctaaaaaggatttaaggtatgagtatagctgtatctccaagagattccaaaaatttaatccccaaaacaaaaaaagtgggccacatcgacaactaccaacagaatggtcattcctctcctccactcacgctcgcacacattgcatcttcctcccggctcctttcaggacattcagtgatcaatctctttgacatcattactgacagttgaagcattgaacaatgtttctattggcctcagctaccatctgagtatttgtcccaaaatgatatttcacttgattattaccacgatctcctgtattttacatggaaaaaatattggttctgcaatcatcaacagtgggggtgtcagcccagaaaaaaaatcagcttttttagtgtgaatggtgttaattaacaacatgaagttttcagcagcaaacaacaagatatttcagcagctgcaacagtacttttcagtactagcaagcagcagtttttagcggcaaagaacaacagttttcatcagccagcaaacaacaaatttccattaccagcaccaagcagttctcagcaacagcaagctcaaaatttgagcagcagcaacgatcagttttcagctatcagcaatagcaagctaacgaacagccatgttccatcattgaattgcaacaaaaaagcactgaccaacagcacttaatcatccaaggtcgaaaatatattgtggagaatggaggaaacaattatcttattaaggagaagaataaatatttgaatgcctagagcaagtttgagcaatactccaaatagtttgggatcattgacctgcaccgctgaacgagtcgatggtaaattgttttgacggacgaactcctcttcatctgggcatcaccgcccagagaccaatgaaatcgactccgaccgaggtgcacgatgattcgatgaaggccagcgactgggcacctccggctgtcgccggctggtcgcatggggcctttgtctcctgcacattaccagagggcgccgggtggccgggagcctgagacagtgcagcgccagtctgacacgagggacaggctgtgttgcgggacgcggtagggtcgagggacgattggagatgaatcggggcgacggccgaatcgattcggtggtggttctggtgggagtgccgacgaaggtctgcccaattggggtggagatgggtccggcgccgccactgagaaaaaatgtcgatgctgtgaaagcttgggggagccatggctgctttccagacatctgcggggaagatgaggctgctggcatgatggattgactcacaggcggacgaacgcacaaagaaaaacctggtaggaaaatttttacccagcacgcgcgaagtgcatgctatcgaaggattgggcgccgagtctcttccctacaagtcgagaacgaaatatacgggtttggaaacgccaagcttttaggggtgatttaggtatactgttggagcgattttttcctgcaaaactcctcaaaactggtattgggaagagtattgggaaactgttggccatgctctaatacatggttgattgaatagattcgggagatgtcgccggaatgtatcgagtcaaggacagggaaataatgcttgtttggaacctgtaggttcgttcaactattatcctgggagtaggttgttgactcatacagtgcagatggatgtcacagctctaggttttctttaaaacatgaagttgagtgaggaagaaggtgtgttaaatacttaatggtttcttaactttgttttggtgtcacattaaggaaacaatatttttgaatttgaatctagcaacttgttagctcttccaaattcatagatgatgcatgacgtgttggtaactatgcctgtattcccaagcggtgagactaagactttaaaattttctaactacatatatatttaacagactcggattttaaaattgagcctaaagtagttattatgttttcagttgacatatccaaaaaaaaaatcaaatgctggaacatatactcatataattgctgcatatgctagaactgccaactttagtaatattttgtttatgtttattcctacaatgcttttacataactttacccaccaaattgttggtatcttcaatagtatcttgttgatgtttggatggaagccttttttttccaacactatcaaaatttctctcctaactagtataaattttaccctgacaaagtttctcgcactatcaaagttttgttaggctagtgtgcttatagtttcgcattatcctagttttttatgattagttggttgctgctattaacttatagactcctgtatgtctttgatagtttgatttacctaattttagagacagagtatgtccattgggattcctagttatgaaaatgttcgatgggcctctatggtctggatgataagaaacaattatagtttgggcgctggagtcagtgtcttactcttttcatgtgtttacctctcatgaattgttcagctcccctaatttgaaataatgggatattatataggtatattttacagcgtatccatgttaatgttgaatggggagtaagtaccttgactgccttcattgctcttttcttttattttgaactgttggattatgatatataaatagatgctagtaaagtccatattaatgcttgacgggaatctggggaagtgcacactgagtctctcagacccaccctcagttcgagtatggttgctacattatcagaagcttgcaaacaaaagaaaaccaagttgttaacttcaggcttatagattgcgagcaaattattgcaatattttgattttccaatcaacctacgaaaattatagagttctttgggtgttcattttccacttgatctaacacatttgttgaacatggcaatagcctcataaatgcaagtagtttgttcatggaaaaatgctatcagctcagctattgaagtttgtctttagacccctgttgtggtgtttagtatctctgtttatgttgcctgatgataggatcttgtaaattttatggttttgcaggtcacccagtcatgtgttgttacctacaaaacctgtagtccatttgtgttcttcgtttatcttttacttggagcgtcagatgatttgatggtttcttaattttcttttctgcagatgccgttcgtgaggaagtgtggtcgcaataagaaacccgtttccatccaaatgacgtctttgaaaattttatccttgaactaccgtgctttggtcatatgctttctgtttggttaaaagctcagatccagaaggtcttagagaggccgttctgtatttccgttcttgattttactgttctgtatggctgtaccacagaaggttttaataatcgcactgaggaattgcttgcgtcattaaaatttgaaaaccattccaattgttgtggtatacaaagcttgctagggcattttcggtgcaatattatgatgtgttctttagcgtgggttgggacgtggtacgtgaaacgagtgatggattagcgcactactctctccttcactcacaaattgatcatcatataacctcatgaatacggattttattggagtgcaattcatgcatcacaggaggagaatacgtgcatgctaagggtgtacttgtgcattatacgtgcatgctaagggtgtacttgtgcattatcttaatcaatgtaagtatgtatattgtacaaacattatatagaacattatataatgatcaatttggaataaagggagtattaattaagtattagcttaaaaattaaaaaatagataaatatgatttttttaaaagcaatttttttatatgaaagctttgttaaaatacatgccgtttggaaagcatgtgtggggaaatgagggagtaaaaattgaaaaggagaaaagaatacaccctagagccaccgtgtagggcatctatttgtcagcgcgtagtagattgaatgctctaagggcaagcacaatgttggctgtcgagttcacaccctccacattgttttagtgcaccggaggggaataaggcaggccgaccaaaaaataagtcacctataataatccccatgactattgcgtggctccttcccatgacttcttcattttttaaagtggtatatgagcttattcgatgggtgcgatctagtataaaaatcttggaaaactcgtgttccgatacacaaacttgtataggtgcttgctaggtgttggaactaattgtctggataaaaaaaagttgtagataaatttatgttgtttagcaccaagatgtgtttactaccccctccatttataaatgactagtgaacttgcacgtgcaaggcacattatcataatatatattattgccaactcgcaatgtgaatcgttggatgagaggatctgacggttaggaacgtgtgggtgtactaaatagaaaactggtgtttttttatattaatatagattgatatagatgtatgtaaagtttttaactctcaatccgcttttttatctcttcgataattaacgggaaatcccgcctaagatgaaagtagccatcagtgacggccaccttcttgaagttgatctccgccatcaagaagctgagccacttgctctttagctccgggcaatggtacctctcggcgtaggcgcgtagcctagagtcatcgccaccgtctccaccgacacactctcccacagcttctgtgcacacatcagcttcaacctctccaatgcgtacctgttcgccgccacgagcaagctctcgaaaaatccggtcgtcgtcgacgttgagccggcaccgcctcggtcggcgacggcaaggcgtccatgtacacgaagtgtagtagagctttgaacgtggccgggtcgatgttgtgcagggtgacgcacggcatggtggactccgccatggacccgaggagctccatcttgaacaccggcgagcgcgcggcgagcacggcgcggtgtgcatgaaacgtctcgctgccgacggagaacaacacgtccgagccgtcggcacggtccgcgatgtcgtcgagctggccgttgaggttcgaccgcgggatgggtatagtgccgtcgtcatcaccggcatataatatatatttaagaaaagtaaaaatagggggaaacagtgtgcgcaaggatatattcatacactgacttgagaaacatggcaaggctgtgtccacacgctgaatttagatacattccatgttcacgttcacaaaataatctggattttataaatacctagaaatccaaatcaattgttaagcatgaacttgtataatatgaatttagtatgaatttgtagagaataaattgtaaccttaaatggtaacaggagtatattgtttacacaacctgcaagggccaaggtcagacactaaactcagacaaaccttacatccattggtgaatttgtaaaatttcagtacttgagctataagaactcataactttaattagctcgcagcaaatcaaaacattgagcaacatgtagctatggtcatgtagttgtcagagggaatatagaactgagagatcaagcaatatgtaagtacaaacatgtgaatatcaaatattattctgacagggaaatatgcttaagtaatggtgtcctccaagcttacaatcgtgattaacttgctccacttaagtcatgcccatcaccttgcctaatgccatccaccaaacctgcaatcctgataaaattgctccactgaagtcatatgcatcacattgtgcctaattccatcctccaaacctgtggtcagaggtgccaccaggtatatattaaggttgtctcctcttgcaaagaagaaaataaaaggactacctattagcaacttgcgagcaatggcaggataatcccagatcaatgccgatataaaaatgaaaattatgtatgctgtagtagtgctcgatataaaaatgaaattatatatgttgtagtagttctagacttatagagcatcatggaatgcgttttggtcgcgtcgcatgcccctggggcagaggttggggatatagcacatcttctgcttcaaaataaaatatcttctttatctaaaataaggtttatctctttggaaaatatatttcaccaaaaattaccaaaattctatcaattcaccaacaactgctaattgggagcatttaagccttgctaatgaaaaggtacacactcaaattcgtagaccagaaaaggagagtagcaattcctattcagaatcagttgtttgtacctctacatacactaagctgagcttatctaatatctaataggttcatactatgaaaatatatccatttatccttgtctattcatagtaaaatagtaaaaaacctaaagtaaagaaataatcttgcatatatggatattaccttttttttttttgcctgtggagtacatgaactcagatatatcaaccaaaggccaatcaatggcaaataaaagaacaaaatctccttggccctcctcattgagcatcttaaagctaaaagccatcaaataaaggccgttcttccattatgctcactccatcccagcatatttgcatatgcttgtattaactgcagagacaattatggcagtttttttagcgtggctagctatagaaatcaaatggtggattgcagtaccacattaaatcagaaattcagatttacctttttaggctacataaataaaatataaatctttcatgttctcatgaataaccaataaaatcaaccttttcaacattaaccacatccttgggagtagtcataatgttgtatccttcaatttttgcacaaattagctttttatgccaaaagtaaaaaaagaatgtttcgttataaccaagggagatcgaaccaaaagagtcaaagaattagaacatctaaatacccaatatactaatcagctccacacacgctcttccaaagcacaggtcccgcccgaaatacttctgtctgatttgtatcacaattgggattcctctgaaagaacatgatccaaatttataactctcgttgatctggcattgctgttccataatggacctctagctttgttttcaatggcatgttgcagaacatatcatgatgtatttgataggtgcatgtacatgctgtcaagaaaaaaatcaaggtctattagaattaagttttacaatgggaataattataagcttccatcgagcctcttctctatcagtgatttggattatctgcacttaaaaagatgcattgtcagcttgcctcagaagtttgaaggtttcaagcggctaactgtcctgaatctgaaatatttctcctcaaccagtgacataaataatctgatctcctcataccctttgctgaatacattgtatttgaaactggtaatggaggattagaagatatgtctcagtacattagcagaaaagtgtcaatagcacaatcaacattggtcacccaggaaaacggttcattaatcaaactgatgaaaaaaaattgatagcatcaaaatctacactctgcaattcgttacagtatccgagaccacaggagaaatcgtctttacctttactggaggggaggaccagcggatgggaagggcccgcaggggcggatccaacgtgggtgcaggggggac

SEQ ID NO: 23006 - DNA, 1848 bp, Oryza sativa
atcctacttctaatttgcatcattggatgaggggatctgatggttaggaataggtgggtgtactaattgcactaaacaactcgtgctttttatattagtctagattatcatatttttatgttgttcagaaatgatcggtgtattttggtaaattgatattccctctcagcgtcttttccttttccatttacctttacgaagtaaatggatcagcgcatgcatgcgcatgcaattgtttgcgtgtagtgcctcattgtatcccttcaccttcgtgtgcactatatgacacatccactaaagtgaagtaatatttttctttcatcgatacgctaattaaatagagtatgggtcgattttctcctcctttggtctcaatgcgaacacgatgaattctggagggagggagtaatgaaactgagtcagatccaagcagtccatccgttttggagccgtctgctgcactgagaaactgtgattttcggatgcatcgctcgctagtgaccggtgcacctcgtacctgccaatctgccatatatcgttggtgggcgagtcaacaactaccttcccactagtgagttgtgatccctggaatccggcacaagacaaatatagcatagcggcgacatacatcatcatctccctccaactcccaagtctcccaacctctcttgcgcggtggcagaggtaacgacatgcacaccaaggaattcattgacgggaaacattgccttgccggcgacaaggacctggtacgccaacattacatttgggatcatttgttcatttcggcatttcttttctttggggttgatgtttcctgtgggtgatttatatatttgagaaatctcttgatgggattctcggatggaacgagacatctagtttttttgggtctaagttgcatccctgatcaaagagatctagaaatggatgaaaattggggcagacagaatcacacaatacaccaaaagcttcagttttccaatgtgatttttttttcaactatgatcttctttgcaatttacaatacggtgaagattgaaatgaacgacaccggagacccgacacagatgcggaaaaccttttccagacgctaagaggaacacgagcttttccaataacaaagctcggggacctgaccagggaggggcatccggcccctcccattacaatataaatttgatcccccagaaaaaaaggggagaaaattggacaaagaccaatcaaatcaaaccgaagtcctaaataataaataacaaataggcctaacgattactgaccagactagaccatgtgattttggtaaaagggcaaaagggcacgagtagtatgtacatgagttatgcacaagttggagatgagttggacaaaaggagaataggaagatgttttgcattgaaaggatcaccactcttgatagtcctttctttagtgtaggaaggtaaagccagagttctccctgatcaaaggcggcatgtcaacatctgttacctcaatttctttcattgactttgagatatcatccaccgaaaacggaatgctgcaatcagaagtaccatggccaacgttagagaacaactttttcaggtgtgattgacttttgttgaagtttggtgtaagggaataaaccttgaatcatcgtccagcaagaaagaactgctcactgcgttattcgagtcttctgtcatcattatcctcatacttgagatgacctataagcatttgtgcatgaacaaaaacaatatttagtgataaagaaataaagaaatatagtaaatccaccgcttgacccagtagcagatgtatattggaaaatttgacaagtaaaattaggccaaacaagattac

SEQ ID NO: 23007 - DNA, 24687 bp, Oryza sativa
  unsure (1)..(24687): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctccctgaaacgcacgggaatttcagctggaattcatacgggagaggggggcaaggaagaaaataccccagtagaagggaatagcaaaaccccacctggacgacgcccacacggctccctgcgctaggtcggaggcgccccccgccgccgccgccgcccccgcctcgggagggtagtcagggtgcacgccgaccgacgaggaggccctgcctgcctccgcgccaccggaggaccacccgagcgagagccagccgccgcaggcgtccacggcggcggcgaggtcggccctccccgcggcgacgagctcggcgcgggtggggaacgcccccggcttgtcggaccgccgcatgaactcgtagatcgcctcctcgaggtcctcctccccgcgggccgcattggacgccgacaacgtcctcctcggcgcccgcgtctgcgtcggcgccgcgcgctggcgacggtagacgcggcggcggcggtggtgatggtggtggtgcggcgccgcggcggcgaggaggacgaggcgtcggcgaggagcggaggcgggggctagggttagggttggggaggggagaggaggaggaggggtcacggggagggggaggaggagggggagcatcgcggtcgcatttcggtgctgcttctccgcggggggggaaacgcgatgggttgggcgggaggggggaggcgacgacacgagaaagatgaggaggagggggggagcgagacggccagccactgctgccaccagtggcgactggcgactggcgagcgatccctctgacgcatggggccctgggcacccaacccctgttgctcctcccttcttggacctttctgcactgcagagtgcagatcccaatttggcaatttgcaaccttagcaccgcgacctgctcaggtggctacagctagtagcctgcgtttatgcctgctattgtacaactctatccgtctcattttaagtgcagccgtgaatttatttgtttaatgtttgaccgttcatcttattttaatattatcattattatcagataaaaaatatgaataatactttatactccctccgtcccgaaatatagcaacctatgactagatgggacatcacctagtacgacctatgactagataggacatcacctagtacgacttatgtccagatacatcgtactagatgatgtctcatctagtcataggttgttatattttgggacagagggagtacattacttaaattttaaactttttcataaatttttcaaataagacggacagtagaacgttggatttagaaatacacagatttaaaatgggacggagggagtagtagtaacagagtagatatgcgcaaacaaggagcatgtgactgatggttggtcctttgatgcgacttgggattttgtggatatggaggagactgtacaatgtgccatcgtggcgttctctccctattttgatagggaacgagatcatatatgctacattatttggatttgagtcactaatatatggtttatttattatgatttatgtgtaagtgatctagagtcacctggcatcatggtagagaatccgtgtctatttgattgagctaaatatggtgatggcggtgactatggcaatgaaaaatgatgtcggtggtgaactggtgatggtaataaatagaactgcctgtgtttgtaatttaatgacatgacgtgcaaatttgtattgttgggttgttttgttccagttgtgtgaatgtaaatagcgttgatggagaaaatataatagtgtagtaaaaaagatttcatttcgaaattgatttggactacattgaaaaggctcatttgtgacatgtgaaagggaacacgggtggttgctatatccgagagatagacacaaacacctatgggtatgtccatacctctcacatccttgtcatcgtacgcccgacaaatataggacaacatcaacctcacatcatcgattcgttgataacttatcgtaaacatttgagaaatttttcagtgagcataaaaatgcacatctccgatgatattcaacattctccgcggcttgtctgattggattgccacgcaattcgttcaagcagaaaacggtgacagctttgacagtgaggagcatatgacaaaaaggccaagaggcagacacttccgttttgttattatgggctgaagagagaatagagaaagctggaaaatcacagctatggaggatagccggtgccaattatttcatcgttggtcgagacggttactggttactggatgcatgagaggccatgaagttatttccactgaactgattgtgtgagctggatggttgatgagcaaacaaacagcaaaattaaattttgagtttatgagtgatggcatggggtgtagacagctgcggttcaatgttaccatcggattctccgttcatcattaagcagttcttccatttcaaaattttgccaaaatttaagctggactttttcctcgggccgatttgagagacggctactccttgccaagccaacctgggattttccttaccttcgcatgctttagttcaatatagttcatgctgcgagagtacgccgtgccaaattgtcgatacacagattttgaaggcgtacctgcatatatatggattgagatcctctgacttcaagttagagaggcgtgatcattgacatgtggatccgattgccagtgacaatgacttcgactaccattagatgacatgttaacatcatcttccgcgagcacatcgtctctggccatcatgtccaaatgatttcctgctgttggttgaatgaatgtcagcggctgcaacaatattaaccatgtcaacaaatgtttatccaacaaatgggatgcaagtatagaagaatgttaagttctaatatgacctcgaaaatctgaaaaaacaacccttgtcaagacattccgaaaatctgaaacttttacggcagcttcggttctaacaaaaaaaaaaaagggaagctattgcagtagttccgaatcaaaggcaccatatcccgtatcttgaatttaagtagacatatcctataatatttccataactacaggcggtttcccatttaagtgactaaacaataatccatctgccacaaacatgccaaatcttgttgcgtgcgcaggatttataaccatttactagatgtgtagcctctttaacgtatcatgtttggctagtgctacatgaatagagacaccaaacgaacacatcatgaatttaaatataacggaattccgcaacagtatcagttaatctgtatgatgatacatcggttgacacaccccttgttcctgggtcaccacggggatcttctcgaacgagaagagggaggacaccagctgagctccaagctttggatacagaatcacttgcatcacccaaaatcaatgaggaaactgcatcaaaactgcatgcagcaagtcaagatctcgtgcagctgcactgtcactagaaagttcacccaaacataaaaggctaacagctccaagatagtgaagaagagctgcaactattgatgtcgtcatggcagctgatgacccaagtccagttttggcaacttcaggtttgctccagtcattgttccataattccattagcaacttctgaattaaatgtaattggacagaatggaggcagcgaaagcaatacttctggtctggagttagagggaggccacgtgcttcaatctggagaaacggtggaaaaagacaagttaattatttaacagcggcacaatgctccaaaagtgagttatattcagacataagttaatcatggaaagagagtatatttgcagtttataaaaccatgcaacccatccgcattgatttttaatttttatttttgcagctggttcatccttcacagttccattgaatatttatttgtggacacaatagaggatatcatatcatgaccacacagagtacaatacaaaaacttttcaactttataaagtacataagagaaaggatagacctcaaagcaatgccattacattataaccaatcgtgttcaatttattgcagttacagataggtgaaatgtaaacatttgccaatggaatgataattcaattagcagagaatctaacatcaccaggtatcagatatacagagagaaaatacttattacaaagcataaagcatatcttctcccttatggttctgcctgagccaccccttttcagtaaattatccgagtagtcatgaaaaattaccaaaagttttgttcagacatctatccaggaaaaaaaaatcagctgaaaattactacagattgtcaggagggaaagaatagaaggctttttcttaaatccttaattaggcactggcaagtggcaaccgtgtttgttagtgcttttcgtgggatgcgaagaaaatatatgttcaagattaggtggtcagcaaagctgaaagaatcaactagggccacgttcagattaagtcacacttctttgttaaattctaacctgggattggtgagttaagctcttggctaaaggaaagcaaatgcgtgacaacgcaagctaattcagaaaagaagctttacctgttctctataggaataaaaaatcgttgcaacctacaaaaaatagagatgagaatttaacaacgatacgaaatcaaattatagcgtggtattcaaaatgattcggacaggagcaaaacttgagactaaaatcgcaaaaccttgcaaaagcaaagcttgtccagtgcatccttcccctctttgtcagcgactgtcacttccgcagctgccaccgagaattgcactgtcttgttccacaaaagggtttgcagattccctgcaacatcaagtcattaaccactatcaccaaacatgattacatgaggtccaagtctccaatgacaactacagagcagagttctgctgcgcaaatggtacaatcccagcaaatgatcatggactacttaccttgaggacgtcgatttcttcggggagagcttgtaggtggcctcccgggagagctgaggagatgtcactttcacattcgtccacgcctagtagcaatttaccatatgggacaggtaccacacagagtaaggattagttctccctgatggtgatggctactaaattgtgtgagaaataatctggggtttcgggggctcacccatgcccaggattcgtcgtgggtgagctggtcgcggggcgggaggacgacggcgtagaagcgagcggtggtgatgaggacgaggccggcgttggggcgctccagcacctaggaaacctcccgcgacgagcaccttccccggcgccgacgccgacgccgcccccctgccctgccctgccacagggatcggtcgaacggtcagacctggatcgagggctaggcaatcgaggtcaagtagagaaagagaaacactcacacttccattctcggcttcggcggcgaggggggacgcgatccggagctcacggccggcggcgggaaatgccgggtagcgcgcgcggcgcggcgcaagcacgacgacgcacgccgcctttcgaggtcgctccgcttacggcggggcggggcataggaagcgaggggcatcgcgagcgcgcgggcgcacgcggtggccggggggaaggacgacgacggcggcggcggcgccggcggcgagatggccttttgcagttacgcgggctcgaggactgggcttggtgaaatggcctcctgggccatgaggcccgctactcttagcttcaatataaaaattttatcctcttttttgtttcttttttgtttaggacaaaaggattcctccgtttccattcatgaaggattcgaattttatcctaaaatataaggaatttgcatgtctaacgtgtactcctgatgactctttatatatataacgactttgtagatattaacatgcatgtcgtgtttaggcgcatttagattttagggcctgttcactttgctgccaaaaaaaaccttaccaaaaatgttggcaagatttcttatatagttaccaaaatttggcaacaaactaaatgtagccactttttttagcaactttactaaaatttagtaaggttgaaaatggcaccaaagtgaacaggcctttagaacacatgatgagtatagcacgatctagtttctatgtgcacaaaattactttaaataaaaatcatatgctacacatggtgtaaaccgtctttattctcccagtcttgtttggcactcggaaaaaaaaaggaattggctgatgttttccctcgttatgcatgctcacacacttttatatcctgtgcgaatgcaaaaaatcatgcttgaagtgtttatactttatagtgataaaaacaaattttaaaaattaattaattaatcttttaagtataacaaatagttaaatgtgtctctaaaattaacgatgtcaattatttattagtagtactatgcaacatatcgtaccatccaatatataaaccactccaatagtaaatcttttggaccagatattaatttcaaggtcatgtggaggtttaattgcatatatgctagtactatagaaatctaagcattagatctggggttgctaaccaatccaattaacaaaagacagccattttgctggctaattctcctgcagcacgtgcccaacaccgaacccgacatcccatttacttttaagcaattttcacaaaactcatatattatactcccttcgtcctaaattacaatgtataaatttttacacatgttttaatgacatactttaaccaataatttattatattttatattcctagcagatataaaattaacatcacattaaagcactttaaaatatgaatctagttttttactgaaagttaaactatgaatctagtgatataacatacataatatttagcataaatatatggttaatatgcttattagtcaaaaactaccaagtttgatcttcctaaaaagaaataggacatcctataatttaggatggagggagtagtccaatttgttttataaccattataaccttatagagtcataaaccacaacattaaacattttttctttgactagtaaggtgcccgtgcgttgcaacgggaaatgctatatatcaatttcaaattatattaagtgaaaagatattaaataatcattgagtgaaaatttattgaacacggaaaaaaaatctggcaatccaaaaaaactacaaatcataattgttctatagattactttcaaagcaagaaatatgttatcattatagaagtatagtgcaaactttctgccacatatataaaacaatctcatggtgtttattaaattataaaaagacaacatagatagaagactttcttatggatgatcacctcaaaattaaattactacatataggtaaataactattctaatgttgtgcacttgcgatacacttaaaaaatcccgtgcaccgctagggtgttgctttcacactcattttgttggtacatcagtagatttagcaaaaaaaaaattgccttagctcgtcaccatcctggacatgttaaatatttataattataaaatatagttacaagcccgcgctagcgctatggtgacgatttatatcgtaaatgaaacaatcataagattggctattaagtatgtcgacgtttgatgtcacgactacagtatttggacagtatggggatcgttggtgctaggatatatgcgagactgaggtaaaagagatggtgacagggatttttatacaggttcaggcccctgagctatcaggtaatagccctacatcctgttggccggagccgatgttgctttttattcaccataatcacaccaatacaatatgtggggtagcctatctaactattgtcgacatggcggtctgaaggtctgactcgtagttgacaacagggtagccttcctcctcgagctcgtgcccgacggaatcagagacagtgctagatccctacggccggcctctgaaggtaccggatagggtcgatccaggcgtatctctgatgtcgatatccgacggcttgtcttggcgtatgtaggcttctatgttgattgaggtggccgtgtctcttccctccctagggggtcttgtatttatacccatagatgttccattatccaagtagaactagggaaaccaatatggatacaatccgagtagtccttgtcgtttccatgtagaactctggttgtctttccttaccggaactcctcctatatctgaaggttgtttccgtataggacatgatatgtggtgggtcctgccgagatttaagtcaacttctattaagtatgtggtatctcataaccatgacaaaggtatatattcaagacattaattaagacttaagtatcagatagttcaagcaggcaggtttaatgagctgagtacagaagctctttgtcaaaatataatataatacgcaattcttttaaagaatagaccacgctaaacttattgcaataagtttcggtccatttttgcaataagattttagcacgatctattcttcaaataaaattttcaaaatggtcaaattgtcaaaatttcagaaaatactctttgtcacaatataatgcaatatgcaattctttataccataaatactgcttaaacagacaaaacgctaattttagcgaagttacattaagaaggttttcacttcacgtcagaccagcacaaagagcctattacaaggtccttagttttactatagtgtaataaaccagcagccaaagaaactacatccaagacaaggtccatgattcagtcgacgatgttttatcaactccatgttatgcttgatgtcttcagcgtctttctcccacgtctcacgccagtaaccaaagaacgaaagtctgaaccaatttcaggacacatccaatcaatttgttcgaatacataattcatggcttttcaacgttaattaaagcatcacattcatatatcagtacatgacatggcaaaccacaaagccaaggttgccataatctaagctacgaccaaattacagaaatctttgcatttgcgaataaatgaccaagagagaatagattaaatcgcatgcactatttcagacacgtttggtattcacttccaaatatgagagtatgtactaaaccttaggagatatatgattgcgtccatattctaatacagaagtatatgatacttgcttcagataaaatctgacaaggagaacaaaagttcaaactcgtcataaaaaaatgtgtgcgtgttcggaagtaaaattataaaggtaccattttgccatcgttctgaaggagctaactctgttattgaatatctgatcctttttttcataaactcactaatacgtatgagctagctttgattgatcatcatcagctagaagtgaaattgtaagtcaatagtgaagataaatgatggtttagagagagagagagagagagagagagagagagggagagagagagggagggagggagagagagagagagagagagagagagagagagagagagagagagaggggagagggtggggtggggaagggggatgaactcaccaaaatatcccaactgcatacaaccatcaagggtcacgcattcgtgtgtgatagagagctagctaaagggctggcacaggcaacaaaatcaaggcagcaagtgccagaataatgggacatgatcacattcaacgacaagaaatatatagtattttccgagaattgcccatcctctgctagaaaaattcccatgttgagctattttgatctgaatccaaagaaactattaatcaaaaaagagaaggtgcagatttgcagttcactgggtacaaaagttagatgcacctctttaacatttagcagattgctctcgacatatgacaacaacttcccagtcaattgagctattgtcctttagaccctcaaacagctcctccttttgtgtatatatgccttcattatatatatgtctgaaaaaaaccaaacaaaagggggaaatttatgaacatccctgctagttggttattttacaaggcattggaaaaaataagaaaaaaaatatgatctactccatagtaatgacaccctgaaacaaacagatacaagaacaccaataaccgagcacatgggaaatcctaataattaaattgacaacacaaaaaagaaactaccaagaccacaggcagcaagcatgacttggagtgaagaaagctgctaacaacatagggcaggctcccatctgccaccagccggctcagattgcaccagcagcaagcatgttggagtatgcagcaacaatcatgaagcaggataggcttagttggtgatcttggggttggtgtggttgttcatcttgagctgaacaatacaaccataaaatgttagtcctactgctaggtatgaaaactcagttcaaatttttaagaaggtatcagatctatcacaactgagggttattaatagtagaaaatgtaagcagtgtcaactgtagagcagatttacaacatattaattcttgggctagctttaacatatgttatgcagatttacagagatgtagttcactaattaataacctgcaaatttttgtatttgtgcaatggccatctatgagaatttcaggatcgatatatcacgaacattgcttacataatcttcactgcatcgttccattttttattttcatccactctgaaacaatcaaggaccagattagttttgagactgcaagatccaaattagtttgctccaacatataatttgaatctttctgcttggtagcaacactctcaacttcccagcagttcatagccctagagtctatacatagtaattggatatttcattacattagcataaataacaacagagagaatcctgcaatcattagtataaataacaacataggggacatgacaatatgacattctcacttacagagaaatcaatttctggtaatacattggctaagcagcatttcgttgaacaccttttgggcaaaaaagagcattagtgatcctgcaatctgtaataaccctcgacactcacagtgatgattcttgacaaatgaatgggttgcaacgtaaagagaacgaaccaattaaccatgcgtcccttctccggcagaagttctgccggagggatcgtgctcggatggtaccgggggcatggagcgctggaggcgggcacaggtgtcacctctcccatggagcgggcgaggcggctgggaagcagattggcgaacctcgcccttggcaccgacctgggcgaggggcgagtgagggatcggcggcggcgttgatctgggcaaggacgaacaaccccgtcgcaccttgcacttcattctctccctcaacgcctggtagtgtcaccgcgcgcagccgtcgttggagtgaggtcttcaacatctcccatctgtcggctgttgtggcgtcgatgcagggtcagcgtccggtccccaatcggcggggtgtcgggcgacgagcggtggcgacgagcgtgtgaccttgagaggcggaggcgtgcgatggcgatctgcagtggatggatggaagcgggggtgcggccgacggcgagacgcggcggatggatggaggcggtgccgggggggggagtgttggggcgatagggcgggagggaccgggagagcaggcggcagaggaggaatggatcggtggtgcgaccggcggcgagacgcggcggatggatggaggcagtgccggcggggaggagtgcgataggaggagcggcgatgtcgacccgcgacgacggcggcgtcgattcgggcgagcaggagtggcggtcggtgaaggcgtggtgggggcgcggcgaaggatgaggggagcggcgtcgacggttggatagcgagcgcgatccggcctgtgggggagaaaagtgtgattcgcggaggggaggagtgcgtgcgatgggatcctcagcaccgtccgatctgccaatcccacggttaataagtcgcgtgtctgctagggttggagtgactgtcaccactacagaattttaaaaagtagtagagatacaccatgcatgcatatgatatcctgcaaattatatccaaaacatatgttttattaattcaaccgtagtaattttaagttattgttttttattttttacaaaattaagatatggttaacattgtggttctataaaaccttatgaccaaaatacccatgattatacgaacatgcctaacctcctatgtagggatggtaattgtgcccgtttgcccgtttatccgtgggtaaaaaccctattagggttggttttgttcgctattttatacccatgggttttttattgggtcaaaggctatgtccgatgggtaaatgggcataggtattgtcagggttacggatagggtataccctctacccttagatatacgttgtatactgatacggtatacccgcgcgtatacggatatttcccgtgtacattaaggaaattcatcacaagatagatgcggaatccacagatagaaggagtcctactcggacagaactgggtcgttcctgtatcgtgtggggtccgatgtctccgagttctacttagagaccaactgacctgcggtataaaagtgaccccccgggaggacctaaggcattgaatcttactgccaacacatccaccacagcctacgaagtcggagcctacaagagccaagttgccgggtgatctagtcgaaccaactcgactacggtctcgtcggtatcatcgagttctgctattccatttgtaatctgtggattccattatataatcccatatcaactggattagggctattacctattaaggagcctgaaccagtataatccttgtttcctgtttgcttgatgtcgtactacgtagatcctcgtaccagcgtaccccaataccctctatatccggtctacgggtatcccccgtcgacaggtatgggtaacactacgtatgcccgctttgcccatttacccgtgaaatctaacttatattgtaggctagaagcaaaatccactagaatacatcactactacaaaatcaatttttcatggcgtcactctatttttttctctggcggccatacgcataaaccgccattaaaaatatattgaggggtgaggggctaagtaccaccagcgaaaatagattttcactagcggccgagttaacttaaaatcgctcccaacctcacacttctccccaaccttatccgctcctctcccatccccatcccatcgctcctacccatctctgtctccgtgagcccttcctcctccgctcctctcctttccgccgccgccaccgcgcgctcttcctcctccgctcctctctcgcccaccaccgcgcgccctttcctcctccgctccactcccacccgtcgccgccaccgcgtgcccttcctcctgcactccgctcccacccgccaccaccgcgcgccgtcgacactcggcgaccacgacgacgacgccggccgagagagcggatccaccgccaactcaggatccggaggctcctcccctccctctgtaccctctccttctcccagatctagctggaagggagtggttggcgcagaggaggtgatgacgcggtggaggaagaggatgaaggggaggcgcggtggaggaaagggtggggtgtgccgatcagcgacgggggtacacgagagctctggatctgtcgggcggcggcggtgctcggcagtgcacgggtgtcagcggtggtcggcggtgcacgggcggagagacgtgcgagcagcagagctcggttgcgggaggcagatggcggatccggcggcgactcgttcaagtcctgcattggcaagttctccatcggcaagccattaggcaatccggcagccccaagtcctcggatcgacgacggcgtggagctccttcctccgtgacgagctgccgccgtggagctccgtcctccaccgccgtggagctccttccttcgcatcgagccgctgccgggagctcggagccttgggttcagcaaccgctgctgttcttctcgtggtgaggcaatgggtgatgcatgctgggattgaaacattttttttgttccgcaggatcgacagcatggttggcaaaattaattttgatttttgtgatggtgaaattgcactgtgaggccaacatatttgaatcgatgcttgaatttgtgattgtggacttgtatttgtgatttggtgagaagaagaggatgcttgaatttgtaattgagggcatatctgaatcggtttgaatttgagtttttgtatttttgcaccggagaatattttcgcaggcgatcctcttaagaatgcgcctgtgaaaattggttttcgcaggcggccttcttaagaacgcgcttgcgaaaaattgattttcgtaggcggctcttttaataacgcccttaaaaaattggttttcgcaggtggccctcttaagaacgcgcttgcaaaaattgattttcgcaagcggtattatgaccgcttgtgaaaaccaatgattctctggcctttacttactggcggggctgctcagccgccagcacaaacctctttttaccgccagcataaatgtttttttaagtagtgcataagctacgttctttgttttatgtggttttctttttatttcccttattatttttctcccacttcctctatcaccgccagaggagagaccccacaccaaggcagagaatatttaatgttttcagttcgattcaaacttagaagcttgtagacttttgtttcactgattttgttgtagccggtaaacgggcacgcccgcgagcgatgggcatgggcaacaatctttgcccgtcatgtagtaacgggcatacctacgggcaagggtatgggtaggcactgcccgtgcccgtcgcacccgattgccatccctactcctatggttttttgcaacttaaggtttgtttgtatgactaccgtcaagtgttgggtagtaccaaattaaacataggcaagtttggcactaccaattgtttgattgggtaattttgtatttagtttatagtgaagaaagttctagactgctaccaaaattagtatgggtgctaccaaaagtattggcttcaatccaaattaaccaatagtagaacaaattttggtagcaattcaaaactgcccttaaagcataatactggggttttgtaaaaattatttatttcttattttcaccctcgacttaacaagaaataacgaagcggtgacgataacaagtcaaacaggatagcaatttgcttagcttggtgtggcccagtagtttagtttggagttgaaacgatgatagcgaagtgtaaaaggcggtttggatttctcggattttccttctgtgcagcttagcccttttaattagaacaggtcaagcaaaactttgagcctttcgttctgtgagactgatagactacgaccctgtttggatcagggcacatcgaatgcttaacactaattaaaaatattaaacatatactaatgataaaacccaggactaattcgcgagacgaatctattaagcctaattaatctatgattagcctatgtaatactacagtaaacatgtgttggctatggattaattaggcttaaaaaatttatctcgcgaattagctctcatttatataattttattattatacttctaattagtatttaaacattcgatgtgacagcgactaaaatttaattcctagatccaaacaccacctaactacgccatgatttggatttcatgacatgcaccaaggacacacattggtggatccatgtacatgattccgcacgtgtagaaactatagaacagattttctgagctaaacgtagcatccatgattttcacatatatagaccagcaagttaatgttacttgtcaatttcatgaaacttcaataccagttattatgattcttttgctaatttatttttgagataatccaagaaatatcattgacaaacatccaaatccaagaaatatcattgacaagtgtaagttttaagatatgctatcgtacaaacgactttgtctaaaaatgccatcgccgttaggttccgttcattccgcgccgttaaatactataggatgaacaatgcatttaacgacgtggattggatggaaccctaacggtgatggtatttttaggataaagtcgtatgtacgatggtattttttggaactcacacttgtcgatgacgttttctagatttggacgcttgttaattatatttctttattaatttataaaaccaataatctgggatgatggcgtgggtcccttcctcttccccttcagatgttgattcaatcttccacttcccctttatacgttgattcagcagtaacattttatgatttaatttctgtgatttgtttttagtttttggaggctgcgtttgtttcagcctgttactaatctctctccctcgttttccacgtacatgattttcaaaccgctaaacagtgtattttttaaaaaaaagtttctatacgaagattgcttaaaaaatcaaattaatctatttttaaaaaaatagtaatacttaattaatcacgcgccaaagaactagtctgttttccgtacagaggagatgggttactaacccagtaacgaacacagcctaagacttgaatggagtgtgtagaccggatgatgggggtcggcgccatgcaaattggctccaaagtttaagagcaaggataacaatagatctgacggcttattattagccaatcttaaaaccaatatatataatagattagctataagattggctacaattttcttctcccatctctatcttttacttatacatttattgtatttgtcttggagtttgtgttaagctagctcttgcattagagccaacacctttgatttttttatctctcctccatataagcttagagcaagtttaataatatagcccactactagctacaaatcatctatagccaatgtaatagccaattcatacaatagttactcactatactattaatatctagtcccacctatcatacacacattatgtcttggagtctgtgctgcagctggctacagatctgtagcccgctgatcttctctctcttcctttatctcttgaaaatatgtttatagctagcttatagcctgctattgtacctgctcttacagtaggtttgttcccaactccctactctcgttttccgcgcgcacgcttttcaaactgctaaacggtatatttttttaaaaaaagtttatatacgaaagttgcttaaaaaatcatattatctattttttaaaaaaaatagcaaatacttaattaatcatattttaatggaccgctctgttttccgtgtttactgtttgtgttgagaacatgttcgtgtgaacacaccctaaagactcagtgccaagttttgatcaatttatataataagcatgtgtttggtttggggacgaagtgggatgtgttgggttcatccctattttctggaatatgatggttctattttttgtttggttagagggatggagcgcaccctattttttgttttgttagagggatggagtgagatggaatggtcccatcacctgtttggatagagggataaggtgggatatctggataaaaatacttcctcaactagaattggtgaggttacttctcacatgaacaatatatttttagcacctacaaaaatttaataaactctcacacaaaaaatacattcgtagcagccccaaaaatttaacaaaaagataaatatgttgccatatcatgctcaagcactaattaatcatctcatcacaaattacttgcacacatcacaaactaattcttgctcacatgaaaaaaatgtctactgaaagaacatgtacagatctgaaacgaaatccccatccaatgctgtcgttgggattctaggaggattggagaaggaacatcacgcatgctgctgacattggaggccgacggcggatggaggctggttggacaccgccgtggccgccgacggctcacccctgctcgcgtgctcctgtcaaatgagtttccgcaaaaggtctcgaataaaaaaaatccagagtcagcagtcagcactcgggtaacgcaatcgacaagggttgagctagttccaagcaagtgtttccttcaacttctctcttcttttttttttttgaactgctgagattgtgttttcttgcacggatcctggtactatttggacagacgcaggcaggggaaccttgaagtcttccccggcacagaggatcgggtgtgtttcggggggcaacaaggtggcgtggcgtggcccccacatccagcctagaagtagaaggccgcgagacatcctggcctgacctcaaaagcagctccccccctccccagtctctcatccgctctaccgtgcgcgagcgagaattttaaaataacataactttaataaaaaaaatataaaaatacattttgattgattaaaaaaacacaaatttagcaccttatcaaataatcaatatctattgaacaatcattattcgatttgtatttatcaaacaacgattgttcaacaggttagggtggtctaccgaactcgataggacccacagcccacacgcatgcatgcacacacatcgaattctctatttttttaaactctatcgaacaatgtttgtttgacacggttattcgataaggtgttaaatttatgattttagttaataaacatttatttttataatcttccattaaagatgtactatttcaaaaagaaagaaagttccgagcgtgatgcggctctcgtgtggctggactgggacggcaggcagcggctggccacacgagctccgccacacgatgccgcggaccggaggggcagtctcgtccactcggtggacgggcggtgcgctctcgcgcgtcacgccgcgaaaaaccaacgctgcacgctatatagactatagccggttgctgacggcggctggtggtgtggccgaaagcgtgccggccacacgggcaaatagccatattacaataggggaggaggaggaaaaaaaaagaaactatatgctctgctttgagctttctggtggttgatggtcagttggtcacacaagaaaaaattgcaacttgagtcctcccatctctaaccgtttttcctttttcttccttttttctgcgtttcatttgctgtcatgagtcctgacaccctcctatatggaaaaaataagaagagtcttgacaccctggtcctatgaagctgtgctcgtactcctgtggcgtagacatgcaggtgcatgtggtaatgtgggataaagggcctgttcggctgtctggtacagccactgtacgtagctgttgctgctacagcagcagactcaacttactgtttgggttggctgcacaacaataaagttaagtgcagccgaataggcccataatccttgagaacgttagaaaccatgcaggaagcccattaaaaaaataatgaggtttcctataatttcgtatgttttgtttaagttccacacaaccccaagatcctatggccctctttgaaatggaaggattgtcaaaataattttagaggatttatttttctaaggatttttttaataaaatcctttgattcataggaagatgatatgaaaattttcgtaggattgttttcaccaattctttagggaaatgagcaagtgactagacctcttgtgatatttttatttggttgatttttttctatggtacaatcaactggctcatctttccgattattgtgttctcaattactataggattataaaacatacttcctccgttttatattataagactttctagcattattctcattcgtatgtctagattaattaacatctactccttccgtcccacaatataagggattttgagtttttgcttgcaacatttaaccactcgtcttattcaaatttttttctccaaatataaaaaacaaaaagttatgcttaaaatactgtagataataaagtaagtcacaaataaaataaataataatttcaaatttttttgaataagacgagtggtcaaacattgcaagcaaaaactcaaaatcccttatattatgggacggagggagtatatgaatatgagcaatgttagaaagtcttatagtaatatgaaagggaggaagtattattttaattcaaatgttttttctgttcctatgtgttttttcacctgtgtttcaaaaggggacttaaattactttttatggcaacctatgttattgaaatgtcgggcacagaacattttcagtgtaggagaaaataaccattttttcttgaggaccaataccaggggagtgaaacttgatatagttattgaagttcagagtcatcattactgaccggtcatctttatgattttgaattttatatggataatgaaaaagactagaagggcaatactaatatatatagagttaaaaaaagagaacaaaatattggaacatcactttgaattctacacaaacctatattttgtgcttaacataacattaatatcgagtgcatctttttctcttcacatgctagtgttttgtgagcgggcaaacgttgttccgaggaagtaacgcttaagccatcaataaaaactattttcacatacaatgttttaactgttaatccctctctttttaatcaccatcacatattatattatacatccccctcctatttgaagaagaagtacatacctacaaaaatgtttagtaaccttccgattgacaccctttatttattttcttttcaatcataaggactaaaacgaaaatgccaagaggaaaaaaagtgaaattccgagaagtacaagcccttgaagcgaaaagcgcaggtattttagctgccttgctccaagagagcagaattcctcggttctttcaaaacgcaagggaactaaaaacgaaacaacctgtaattaccatttctgtccctttcccctcccctccacgactccgccgccgccgccgccgccgccgccgccgtcatcgccgccgtcgccgacgacgaagccgacacagagccacacggcggcgcgctcgaagcaatcgaaccaacaagcagccgcgtcgaatcgcataggaggaagagagaagttgggggcagcaaccaacagctaggggtgggtaggtggtggtggcaaagcagcgggggtagcgggaggagaccggggcggcgggcgcgcgcggtgccctcgggagctagcccttggccccgccgcctgcgccgtcgcgccgatctccatcgccaccggcgagcagcggcgccgggggcgtcccgctgctgcttccgccgcgtgctctgagcgtctgattcccctcggccccgcggctcccgtctcctcgcgagctcgtctgcccgccgcctgcgccgatctccatccatcgcgagcagcggtgccgccgccgtcgtcatggtgagcaccccgtaccgacgcgcatcctcttcctttctcatctccatctcgttctacgcacacttttctcgaattcgcgttatccatatcttctcttctagatctgggactggaagctaggttttctatttgtcttaactttagtacgaaaacagcattttttccccaaaacaaaaagttaggggttcaactgaaattgctcatagtagttccatcattacttggtactactacacaatttttcattgctctcactgtagtgtagttacaaattgtttagctgcctagtttgccaccttacgagaaacctggactcatgcaaaattgggatagagcaacttggtttggagctttggatagtagtaacttggtaggtgaaatggctcctgcgagtgacatggatgacaacaatggttagctattatttgcggagaaattgattgtgcaataatgtgaaggacgcggaataagatgtttgcttatagcttcgtgtgaagcatggtattgtgttttacttttggtgtgcttgttgaagtttgctaggtgatgtttgaaatggaaccgtgccctttcatatgcattatgagcagtttttaggtcccgagtcctgacacaactttctgaactcgaatatttattcgaaaagctctaactaaaacaatttgaggagactgatattttcatgtttttgaaccaactagctaggattaagcttaaatattactgaaactctgcaaaacttaaatactaaggttttgaagcaactagtaaggaaatgctattatactttgcaaaacttataaatactgaggttttgaaagaactagtaaggaaacactattatactttgcaaaacttaaataccaaggtttttatatcatgaattcatgatactctgataccgcaaaagacaaatactaaggttttcaagccttaacaagtttgcacatcacaaaactgattttgacatattgcatggtaagtggactagtggagtgaatgttagcctgatgttttagtgctctgatttttgaatcttatcaatcttctagatgagaccccgtgtttttgctgtgggaaaattgcatgataaaatggtaggcataatgagcgaagtcggaattttcttgttaccaaatggtttatttcatgtgctttgtacgataagaacctttaatcatttctccaaaggctatacataattgatatgcatggtgtggaaaagagagacaatttgtaccttagaacaatcacctaaaatactatgaaaacaattgaggtaatgtgtctacatgagagatgagagaattagcacttactacagttagtgggaggcaactatgtaagtataggatacaatcattggaggaattgttaactaaaattcacctgcgagatctactatgaatccacctatgacctacacgttggaggaaaaaaaaagaagaggacatcgaatcactcattccactaaagcaaatcctgtgtttacctttcggctaaaatccctatttcttgaaaagccttttaatgatatgtcatatgacgtattcgtcaaccctgagtgtctgatgcttggtaaagttggcagcgatacgtcatggacgtctcctttttatcctctgtcatgtccaacatacttatgcatattctcagttgtcagttatatatgacaatttcgcaagatgtaacacaaccctctgcatgagaatgagggaggagtattagatcatccatcaaagccttaaattattcttagttctgttttatctaggcatctgtttgattactgcaccatgtgttttgcaggggactcctgttaatattattgttggttctcatgtttgggtcgaggacccaattctagcctggatagatggagaggttgttagcataaaagacaatgaagttcatgtgcagacttcaaatgggaaaaaggtacagtttgcagtttcttatcttgcattctgcagatcatctctttctagttcttagtatttccttaaaatccttcaatggatctattttgctctgttttaatgtacaaggagaacttcgcaatactgtttgtttagttatttatatgtggcttcattgtaaccatggattgtatcattttgacataaaatggattacgagtttcatcacaagtaatgcttttgcacaggttaagacaaataaatcaaaagttttccccaaggatatggaagctccaccaggaggagtggacgatatgacaagattatcatacttacatgaacctggtgttctacagaatcttgctacccgttatgagctaaatgaaatatatgtgagtgccttatcatttctgcccaaaatcttactttagatgcactacatgactagcgcatgattatcattctgttgcattcccagacttacactggcagcattttgattgcggtaaacccatttcaaagattgccacatctctatgatacccatatgatggaacaatacaaaggtgcagattttggggagctgagtcctcatgtcttcgcagttgcagatgttgcttacaggtgaactgttgtataatattgatattgccatatatatgatcctgtcagcagattgtactttttatatacctacatttccctgatatgacctattaatgcgagcaaccagagcaatgataaatgaagggaaaagcaactctatattggtcagtggtgaaagtggtgctggcaagaccgaaacaacaaagatgcttatgagatatctggcacacttaggtgggcgatcaggagtagaaggaagaactgtagaacagcaagttctagaggcaattcattagccttctctttgtctgcatagtaatttatttttcaaataaaaaaaattccgttggctgattacctaataactgatataatttcagtcaaacccagttcttgaagcttttggtaatgcaaagactgtgcggaacaataactcgaggtaagttaaccttgttgctttcattttcttttcctttcattgacacttcttgctttatttggacatc

SEQ ID NO: 23008 - DNA, 1677 bp, Oryza sativa
attggtaatgatcctttccctttgccctggcagaaaaactcaattagatttcaactatgcatcttgacatttccccactattactgttatcttcttctcaggattgtggagaagatcaatgtctccattggacaggacccaaactcaaaacagttgattggtgttcttgatatatatggttttgagagtttcaaaattaacaggttagtgttttgcacctttttcaaactaggccaaaaatccatttcataacatacgctaaaacagcaacgtgttgcactcctctaaacagttttgagcagttgtgcatcaattatacaaatgaaaagctgcaacaacattttaaccaggtacatcttgaatttgttcttgaaagagggctttgctctagagattgctggtttgtgtctaacgtgagatgtttgtcctgcagcatgtgttcaaaatggaacaagaagaatacaccagagaggagataaactggagttacatagagtttgttgataatcaagatgtgttagacttgattgagaaggtacacatttcatcatatcttacatgctatgagatggcatattttggctatgcaaatgtataccaaaatcccttagattatggggcggatgtagtataatataagctcttcaaaagaatatatattacaagctaaatttatctagttccactataagcttttcggaatattagatgaagagatgggataaaatttcccaaaaaaacctattctcatcctacaaatgatggttgggcaacaaggcttgttcagctgttcctatggggttatatctgcagtactattcctgccaataatagtgtcagtaattataaatcagtaagaaaatgatccaatttgtgttctcattttgaaatgattatcatgtaggctcctagtctgtttgatgtttgctgctcgagatagcttaacttaggctagaggaaaatctgttttgtaagttttgaaccttcagggccctaccatctgggagtttactgatttcatggattaattaaattaatctgtttatttggtgttatgtccttaggttgtaggtctttttggtaacattgtacttgcagtgcatataatgtttcaacagacttgtgtcagatagtatgtggttggtagaagaaagtctcctagctataatgagctttacagattcccttcatacgtgcgatgcttctagttctaggatgagctaaggcttgtccagacagcatattgcttgttagtatttgattgtggaaattggaaacaacatattgcttgtaataaccttttattttggagttctataaaatggcaataacatatgtttccgtactcgcagaaaggtggtttgatcgcacttctggatgaagcatggtatgttctggaattcacaactatcattccaaaccacttgcaagcaacatatatatcttcaatcactataacatctggatcaattgtagattatctcaatcctgtgacatgtaactgcttgcgaattaataatgttttgcaaattttgttcgcagtatgtttcctagatcgacacatgagacgtttgcgcagaagttgtatacaacatttaagaataacaaacggtttgccaaaccgaggctttcacgcacagattttacaattgttcattatgctggtgatgtaagcct

SEQ ID NO: 23009 - DNA, 4150 bp, Oryza sativa
aatataaaaaattttacatagcccccacacataatatgaagtgtgtggattttaatattttcaatatgcatgtattaatttttttgaaaatataatttatgtttcatatgctctagcgtcgagttcgtttatgtaaataatctttcatatgctacataaaattatttttctaatatagctatgttttgtgtgtgtgattcatctttcatataccacataaaaatagtttttcaaaaaatatttttgaaaaaaaaaatcttaaaatatatatagaaactttatatcatataagaaggctacactaaaactttcatattttttttcaaaacttataatgagccaatcaattggcaatccttgtatggcttgaagggaattttaggtattttttgaaaaatatccatcccgatggcatattgtagaaaaaattgacaaagttggcatattatagagaaagacagtcgatggcaaatcattaaactagagtaaactcaggggcatagaatggattatctcatatatataacttagagactggaataaaataaagagtaattaggatgatctaaatctacaagaagactgtaaaaataaacttcggtggaatttgacaaaagaaggaagattcactgtgaagtctttgtataaagctcttaaaatgcaacaagtgaactttcggcagaaaaaaaaatctggaaatttaaaatttctctgaagatcaaagttttcatttggttgtttgttaaaaacaaggcactcacaaaagataacttatacataagaggttgaagaaaaggggatagaaaatgtcaattttgtgaaaagatgaaaatgtacaatgcccatggccagacttctgtggaatatagtaacttgtgcccttagttggaaacctatgctgaataatcaagatctgtttggacattggcttaacaatcttgtaaacacacaaaaaaaccttcttgtgataggaactagttgggcggccagcgcaattgcgcggctagcattaatttaaaattatttatttattatacatgattttatttaaaattatcattcccatgattctaattattttatagtttttaaaatccacgccagtcactacccctcactcctttgacaccttttttatatggttactcgatctaccactacttctattcatcctctttaaaactttaaaaattacgccttatagtttttagagtttattatctcgtattaggttcttatatggacttttatttaaacatttcttattttaattcctaatttcagaaatttttaaattgtattcctaggtggactcttcttgttttttctaatttctggttttattttatttttattccgaattttgttaatctcgtattgggttcttatatggactcttcttttaatattgcttatttttaatttcgaattttagttcttttcaaattgtattcctacgtgaactcttcttttattattttttaatttcagattttattttatttttattctgaattttaattaatctcgtattgtgttcgtacatggactcttctttcaatattccttatttttaattccgaattttagttatttttaaattggattcctacttggactcttcttttttttctaatttcggattttattttatttgtattctgaactttgattaatcttgtattaggttcttatatggactcttatttcaatattgcttatttttaattccgaatttaagttatttttaaattgtatttcttcttggactcttttttttctaatttcagattttattttatttttattctgaattttgattaatctcatattgggtttctatatggattcttttttcaatattgcttatttttaattccgaatttcagctattttgaatttttattaatctcgtattggttttctatatggactcttctttcaatattgcttatttttaattccgaattttagctatttttagattgtatttctatttggactctccttttctttttctctgattaatgtgggaatttctagcccccacagcgaacatggtgtcttctttcaaaactgttttaataatataatagaatataatagatagatagatagatagatagatagatggctgcaattatttggccatttggaaaactagggatagagcttgttttgagaaaaaaaaaacccaaataaccccactgatttggtttttttggcaatgccattgggttgaaccctgggctgttatgcagaagccggaagcaagcccaaagaaatctgcagtttaagattcggatagagggctggcatcaggaggattgaaggctgatggagatactggtcatttggagaagtggggcttcaggggttttcgtgttctcctccgcataaaagtttgttgatgtatgctggcttgatctaatctgtgttgagagtagtttctgttgaagggtcaattctgggcacaggccccgctgttagtaacttcaattcgctttttgtttttgtgttcagttttaaactgctttgtaccagacttctatagcgtgtttgctcatttctagtaagagaaatgggggacttcatgacctagatcaaaaaaaaaaaaagaaaatcagtactctgcacaattttcgtcagtactagtttgcaagcgtttttttacatcatattcagggttgttgaagtagatacggaaacgtgtgaagcgcaaacttggccggggtttctgaatacattatacctggaaaagctctaatcacccaagctggtgggtaaaatgtatctgattctgtcatatagataggtaaaacattcatcgcgatcgattgcctttctggctggaaaaatctctgtttggttcgtgatctaaaacaggagaacttgtgagcatctcaaacctccttgcagttgtatatatcttcagaacttgatgtcttcttatattagcttacctactgtaccaatcatactatcttttctagaacttgatacatgtgtaaccaatctaacctagaaaagttgttttttttaatggaagcaagataactaagacaatgatgatcaaataaagaacaaacaatgctctaatatgaaactgtgaacatccatatatctcttcttttgtacctataaataccctgtacagaaatcattagttcagtacaacaatagcatcgattaacacagtgattaagaaagaaagaaacagctaattaatcagtcactaagccaaaccatgggcaagaacgcgagccgcctcgccgtcgccgccgtcgtcgtgttcgcgctgctgctgtcgctccggcagctggaggcggccgacgacgtctccgtgtcgtgctccgacgtggtcgccgacgtgacgccgtgcctggggttcctgcagggagacgacgaccacccctccggcgagtgctgcgacggcctgtccggcctggtggccgccgcggccaccacggaggaccggcaggcggcgtgcgagtgcctcaagtcggccgtctccggccagttcaccgccgtcgaggccgcgccggcgagggacctgccggcggactgcggcctctccctgccctacaccttctcgccggacgtcgactgctcccagtaagtacactttgcagtagcagtaatccagtgacacgccatgcattgtgctatagatggccatatggcccgaggcccgatggccggtgatttgacccggctcaggcatggcacggcttgactcgggtcatgcctgtgccggcccggcccaacaatcatgctgtgcctgggctgctacctcaacacgctgggccaacacaacccggcccaaagttcagggatgcgaaacatacttattctcaaccatatgtaaggcaggtcacaaagaatagagaggaaaaatagacatattatatggcacgacgtaaaaagtagggatataaaatagacttattttagctattttaaagagggaggggaaatagacttattttaaagaaggcacaatgggccacccgggggaagtatccggtgcaatcatgcaactttcatcttacactgttggatcgagaaatggacgcccgagattcatccatgtcaccatgagttaaaatttaactcacagattccctcatgagttaagggctggtttggt

SEQ ID NO: 23010 - DNA, 8147 bp, Oryza sativa
aattcacaatagggttaatggcctattgggttgggagccaaattttggcatgcctaaaaaaataggccatttcaacagttaatttaggctattttggcttcaatccaaacacaattttacctttgccaaaattagccatgctaaaagttgccaaaatttgacattgataaaatttggtaaggccaatttaggccacaaaccaaaccaaccctaaaatttactgggagttaaattttaactcatgttgacgtggacaaatctcaggtgtctatttctcgatccaacggtgtaagatgagagttgtatggttgcaccgattaggtgattgcactagatacttctccgggctacccgtgccttcgggccagtacagcatgggccgactactggtgagccgtgcctgggcctaaggtgcagcctgtgggccggcacggcatggctcgaagtgccaaccgtgccgtgttagctcgatcgccttgggctgtgcctagccagtgtctgggtcgggtcgtgccgaacgagactcatggccatctatacattgtgcgtagaggtggatctttaacgttaacgagttaaagagctacaattaggctcggcttgtgcgctggctcgttaaattcgttaggcttgtttcatttgtattatattaataatttcaaatttactattttattatatattaacataataaaaaacaatactaactaataaaaaaactcactaaacacgaatgttttaatgtaaattaaaatactaaatattagttaagtagcactaagtatatatagatatggttatatcttatactaacaagctaaacgagtacggagtagataacatgctagcttgttaagctcgcgagctaaagattagcggccccatcatttcgcttatttgtgtaataaaccaaaagacatataaaagtagtttgtgaataaaacttttatatacgtgttcttaacgatctaaatgcaaaggctaaaaaataaacttcaatgaaaaaaacctcaaaatcagctctaaacatatggttgaaaaaaaaacaaattttagctgataagtataaacataagcgaaaagatgaagccctagctcgactcgactcattaaaactacaagttcaagtcaatatgagttacgagtttcgaggttttatccgcccctaaatatatgtgatagtacaatctcggttgagcaatgtggatggttggatctcaatcaaatgacatagttcagccttgatcagttgattgtcaggaaaggccagcctctctacgattttttttaaaataatactatattaatggaaaatattactgtggtgcttccatatgatagagattttagtcatcaacctctatgtttacaatttttcattaaaatattattatattatttcaaaaataatcctcttaatttctccacattccacagcgatctgtctctcttttctctgcgcttatctttgtgccttgaccttgacaaccaccattgccaagcagcagaacaaatctcatactatcatattctccgatgtgtcaacacttcagtagtattaggcccaggggaccttttttaggcccaggggaccttttactatcgggagatgggttagccctccccacggtaaaccctgttactgttactgcggttaaacctggcgaaactgacgagaaaagaatgccaacaacttttaccggaaattttattctttatttttataatttggtcgatataccagggtgttatcaattatcataccccgacgattagctcacaataactaccaatattgtaaaccctaattaggccatgcacgcaacatatcagaaccaacatataagcctgcttgtttgttctttggttctgcacctaaatttaaattatagaacttaattttagattaatttaaagagtatttcatctctttctatttttcagcattagcttttggagtacaaagtgcaaaagcatataattatggttgcttccgtcacttgtcttcagcttacattctctgtttttgaataggatattgcattaaacctataataatcaaatatttgcatttaatattacaatattacattaatatccaataatgaacttgcgcaatctggatgatcatatcgaagataacaatacactgacggacttgcgcaatctgcaggagtcaaggacacaatcatgcattcaagcagccaaataattcgtctactggaccacaattgcctcccagaaattaaaataaattaatcaaacgaggaacatgttcacaaataaaacaggctgtataaagttggattgcacggcgacgaaatattttatatctcgcatgcactaacctttttttttcttctctgctttcatttctatccgcaggattgagtgaagagaacaaattaaaagacagtgtgtactgtgtcttgtgtgcttgaactacgtcgagatgagacataaattctcctttgtgtatttgtgtgtcagcccgtgtgccattatacttttttgtcttctccttttgtgctaatctctgtacttagtgtgtgctattactgtactactgtactccttttagtatttgtgcctgagcttttatgatgatgacatccatttgttagtaactttataatctttgcgcccatcaggtgaaaagaacaggttgaacaaccgcagctcagagaatggcggctaaaaaaaaagaccaggacacaattaactaaagctaccattataatatccagactttcggccaatattaatacagatttcagaacaaatttcacggtaatttatacaaaacatttcatttctaaatgtaattggaaaaagaaaaacctctgctcatagagttccaactaaatgcatgggtggataaggcggatcacaccattttaatggtttcaattttcgacccctctaattgtgcttgctaatgctctgaaaaaaaaaatctagatcggccacttaataaatgtgaaatgtatcctgataattcaaagaacgtactaattaatgactaatgtgaccatctccttgactaaccatcaactataatcaacacgttcaccttgtgtcacgccggcgtcgtgggcgcgggcgccgccgcgatcttgccgtgctcgaggttgtcggcagccgcgtcgtccgcgtgcgcgacgtcgtaggtggcgtgcacgccgaagagcacgtagtagacgagcatggcggccgtgcagatgccgaagcgggcgtacgccgcggtgcccagcgaccccatcaggaagaggttggtggcgatggacatggccggcagccacggcaccagcggcgcgccgtacacccgcggcgcccgctgcttctccgcgcacgccgccagccccgccgcccccgccgcccacccgcagccgaacgccgcgtaccctggccaccgccgcgcgtaccgggagttgtagtaggccgagacgccgatggaggagagcacgacgagcgcgaggaacgcgaggaaggtgcgcagctgccccggcgtcgtcgcccccgcgacgtggtagcggcggacgaggagcgccacggcgacgagcgcgaagatgaagagcgtgctgatggaggagacggaggcgagcacgtcgaggctggagaagagcgcgacgcaggcggcgccgagcgtgacggcgacggtggcgtagatgggcgtgccggtcgtcgggtggacgagcgcgaagtacggcgggatcatgtgcgtccgcgcgatctgcgtcgtgtacctcgcctgccccagcgcgccgacgaggaggccgctcgtcatccccttgagcgcgccgagagccaccacgtagcgcgcccacctcatcccggccgcggcgaacgccaccgagtaggcggcgttggcgtcgatctcggtgtaccgctgcatcccgaccagcgccagcgacatgaggcagtacacgacggtgatggaggacatggacgagatgagccccaggggcacgtcgcggccggggttcttggtctcctccgccatggtggccaccatgtcgaacccggtgtacgaccagtacaccacccccgccgcgcggaacacgcccgcggcgccgaaggggaagaaggacggcgcgaggttgccggcgtcgaagtgggagaaccccgcggccagcacgaacgcgatgatggcgatgccgaccaccgacgccagcgagttgagcgtggacgtgaggcgcgccccggacatggccaccgcggaggtgctgacgagcaccacgacggcgatggggtccaccagattgaacccctcggcgagcgccgggacgtggatgcggagcgagtcggtgtctcggccgaagagcgcggcgaggtacgacttccacgacctcccaagcccggccgccccgacgacggcctccagcagtatgttccccgcggccaggaacgccgcgatgtcgccgagctcgacgcggaggtacgagaacgagccccccgcggaggggatctccgtggcgagctcggcgtagcagaaggacgacagcagcgcggagaaccccgccgcggcgtacgcgagcgggatcgccgggccggcgtcgaagcgcgcctcctggccggtgagcacgaacaccccggagccgacgacggagccgaacccgaggaacgcgaggtccagccacgacaggcaccgccgcagcgggttctcgctcacggcgcgcagcgtgccggcctccgccgcctccgacgagcggctccccacgcggtcaaccagccgcggcacggtggccgcgagcgcgccgccgtaggaccgccagctcgcgaacgacggctccgggaagaagtccgccttactccaccgccagtaccgccgcccactccctccctctcccgccgccgccgccgtcgccatcaccggcaacacacacgctgacacggacgaatggacggaggagaagatgccgcgtgttagctaaccaccaccaaccaccgacaagccatcgccatggaagagctggagatagtgcggcgggcgggtgggttggagagatcgatacgagaaaatcatcacaggataaactcgaatttatctatctacgcgcaaaacagaatcagctcgggattcaggggagaatttctcagcccggcgaaacagaatttcagagaagcgcgcgaactttacgcgccagcgccgcgccgccaacaagcgatgcatgccatcctcaccgtgcaggctactgctactacgaatctagacagcgcgcttatcctgattcatagaatatatctagaatgagtaaattgcgttgatgctaaagacctatctcattttatagaaaaccccctaatatgatttcttaacgtacacatatctcatttcatctttcttgacgtgatcctgatcgagaggtggctgcgttggtggcagttactactagaaaaagcatttttcccgacgtacgggtctcattttcgcaagcggacataacccttagagccaaataaccacctacaaaaatataaatcgaggtgaatgtgtcggtcacctgcgaaaatctatttttgcaggcggtcctttcgctggcgccgcttaagagatccgcctgcgaaaatagacttgactataaatagactttggatagacttaaattttttctaagtctcaaaacgcacccctcccctctcctcccctcggccggactatcccacggcggctacagcgcggggcggcgcgcggcgtccggcggcgcagggcggcagcggagaccacagcgcgagcggcggtggcggtggctcccctccccccctccctcccagatctggccggaggagggaggggggaggccggcggcggcggctacggcgcggggcggtggcggcgacgacggcgcggggctgcggtgacgacgacatgcgcgctggggccgtggcggcggctcccctcacccctccctcccagatctggccggaggagggagtggagaggccggcggcggcaactacggcgcggggcggcggcgacaacaacgcccggcgcggctcccctcccctcccctcttgcccggcgcggcgatgctggaggagggcggcggcgacgactgccgcccgtgatttttttgcccgccgcatgtgatttttttttgtttttttaatgtattttcgcaagcgagctgttaccccgattgcgaaaatggatgattttcacagtcgttgacttacaggcggtccaactctccgcctgcgaaaatcactttttgccgcctggaaaaatactttttctagtagtgggtgacgacgcagtggcggtggcagcggtggcgacgacaacgagggaaaccgtgcaactacatcgcggcggcgatgagggctccgtgtgccacactagttgaagccctaaaccaataaccaaaccaattcaagtccactagttgcaccatgagcgcactcacctagccaagttataaagtcaacgcaatttacttttctagatacatggcatggcattatactatgtccaatctaatttactttttatattttggagcagaggggtaactgcatctgccaaatttcacactcgattttttttaaagacaaaactaactttaattatcattaataatctttttaccctggctgcaaaataaaatctttatcacaaaactgaaattttaaatctaatgctttgaaatcattttttaaaataaacaaatttggaactttcaacttaaaatttaaaaaccttactcaattttcaaaactttcaactccaattttaaacctttccgtttaaaattttcaactataaaattggaactttcaaattatattctaaaaccttcgatcaatcatttatttattgttttatttcaaaagtgattaagcataataagcggtatgcctggagttaattacgttaaaaaaacaaaacattgaaatgagcgtaggtcaattaattaggttgtgtaataaggtctctcggatttaaatatttttttatacgggtactcgtatttatgagtaactattttttttttggtagaccacgtaggctaacccgtggaactcacttgcatactaaaacaagccaggaacccgtcctcatccagcagtccaggtcctcggcattgtgggcttgtagccatccataagattgagatgatgaccggcagtcgcggtgtggagggagccctgcaaggctgcaagctggagcgcaatgcggcagccatgcatgaccttgagctcggaggcctcgttgcgggggtggtgaccgtgaagtggaggcctaccgtgctgatgatgggatctgccccctctcccttcgctgcaactagatccacccccatgagccccaagtttcgcatctgcccgtcactgccgactgcatcgccctgagctccgcttctgtcgatcaacgttggtcccacacctcgagcctctgccaccaccaaaaggctgctaatggaggatatccatatgtggaatgatagggtgacccgttcttggcgacgaagatctagcaatgttgatggttagcccttctttgtgatgaaaggaaggaggaaaaaccgagagggtgtggtgaggaataagataaggaggccaggaggggaaaaaatggtggcggcaatgtacgagatggaaccgaggccaaaatttgtgtggggagcgtaaaggtcggaaacaaaaaaaaaaccgccacggcaggaaatggggggaggggggagggggactcactttttcttaaggtcaagttccaaccctccatctaaaatggtgtttatggtattaactacattgtcatgtaggacttttaacttatgtggcactatattaattaagagagagagtgaagagaggaagaaactagatctcatgcaagagacagcttcaacacgagaacctatacactagacactgtcaagttttacattgggagataatagtgtcttcataatagatgaaaaataaatatgattggtagagaagagagatgatgtatttattaatggcccactttaagaaatcatgggttgtggagtgtagtttctattgtgatgttttattgacatggcaccataaacactgcttatagacactatgggttgggactgccctaatgagccaagacaggcttattagggaataaaattaaatttgtaggtaaaactttgagatatcagttcgta

SEQ ID NO: 23011 - DNA, 1400 bp, Oryza sativa
ataggtcggatatagatacaaatatgtatattttctctcgaatacgagtacgagtatgatatcgaagtttccatcagatatggataataattcggatattcgataaacagtactatttggatatccatagaagccataagacataggagtacctaatttcattataactctatgaccttcaatatacattttttagattttaatagtagttcatctcttaacactagtccacactattaatattatttaaatttttaaaaatatttataaattatactatattttatataaaatgagctaattatatatagatatttgtttctattagaagttgagttagtttttgtgttccgagaaaattttgttgccgtattcatgtccgatcatattcgattcttattcgtattcgagataattcatatttgtttccgtattcaagctatctatattcgtttccatatctggcatataaacgaatatggtatgagtattatccgtctgtttatgttcctaacgacaagtatgctcgcagggcacagacagatttgggggctaatccatgggcacaaccacaatccatggattggccttctttgtcaacctgcatccacttcagcccaaaccgtaattcttcataggccagaccgctccactccaaaatgaaatcttagcccattcaaaaccaaccaatgtgatccaaatgaacatccactacacttaacccaaacaaacccaccctactaagtaggcataactacaacacactgcaattccgctctcgcttcactaaaaagtttgagcttggtgttacaagccatcaggcatccatccttacaaactagtgcttctctagttggctggtgaggtgggaccataacatcagttacgttgtttctgctgccgactgcctgcatgattgctgctgatcggctggatggcccaaggcccgggcctgccgctgcactagtgtcactgcttgcactactgctgccttacgctggcccaaggccaaagcatcccaaccagctcaacaactcttctattaactcttttttcatttttgttcttttcaaatattgtggagcgatacagatacccatactcaaagatttaacgtccccgtcgtctatatccgagagcgatcgatcgctaggggcgattagatttctgatttccttttttggcaccgcattactttcctattttagtaaatttatacacttaaaatttatacacctcaagtttatacatctccacaaatttttttacaaaaacaaaaagttagaaaaatttatgtatagaaatactatatataaaaaatttgaattcaaattcaaatttaaacctgaatcgggtatgtaaacttttaacttataaactttgggtctataaactttagg

SEQ ID NO: 23012 - DNA, 2621 bp, Oryza sativa
atcgggttcatccaacattgtatgcccgcatacaagatacgtatatatgtataaccacaaagtcatctctgataccatttataaagtttccacacttttaccactaatgataaaagtgcaagaccatggattattatttaacaaactatgttttgtcaaataacacctggccattggagatcacaagactacaagagaaatagttagagttatctttaatttgcctccaggagtcttatgaacatctatactctgtcttataactgcaaagaacaaaacttataaaggagttatatagtaaaggtgggcactttcatacttagaaaatcattaatagcaaaatatcaatgcacgaataatagtttatcaatttatattatatactatacctatataacatcatcgccttcatcattcatcaaaactctaagtctattttgtaaaaggattataaaaaagatttaaaaactaaattacactcataacattgactagagttagtaacaactctgtgtagctttcaattcaagagacaggcgtgactcacaattttattgagcactgtgcaggcttataccactttatggatagtactcttatttttaggccttcacattccattcaattgttagacttctcagagtactctcgtttccatttactatactccacaccaccatgtgcattgagaaagtatgtatcatcacttggtggggtttatatcatctcccatcctaactatttgcggatgggatttgtatcatttcccatcctattactccatacccatgtagagtgtaataaagttgataaggtactaggctcattccgtcttgagacggatccataattgatagggtttatttggttctctaatactaataagaggtgattaattcttatatgcatacactctattcagagagagccctaataatcatcacttcccctgagctctccctatccatcatattaatatcctgatataatcatcatcatcgtcatctaccaatcatctcatcatcaacaataatattttagagaataaagttttgatacaatactaagagaaatattttacaaaatacagatttttaattaaaatagtgtcatcaacatctatcaatatgatcaaagagagacttatattatgccctactgccaaattgacttattccaactcttgcctcattcctacatttcgttatatacgttgaggtttaattaaattcctaataggtatagatgggtttgatgggaactttgaatctttaagtgtggtgtttgtaatacccccacaatattatatgggtaccccgcgcgttgctgcgggagaattatgtatagtatagtagatatgagttctaaaattttctttcttacctacgttacgattttttcatgtgtttaaatatttttttacctttatcaattatccaaatgttataaatgatcgggctgtatggtgtgccttttggagggaagagatgcaatttacatccttggtgaatcattcaaaggttaaaaataattgaggtgatgtggctttatgagagaagagagaattagcagtaactatattttgtggggatgaattttatagatatataggatttgaaaaagaaaaggaaaagagataaagacaagaattgttgggctggcttgggatgctttggccttcggccagcgtaaagcagccgtagtgcaagcagtggcagcaccagtagtagtaaggaatttttttcatttttatttttttgttttaatattacagaaatattgtaccagcgaaaatatttatagaaatagactctgtaaccctccccgagggcgagggcgcagggtgacgtgtgtgagcaggcgctggaggcttctgagcgggcatgtgaattttgcatgcggtgaaaattgcatttcacctacctcagcgcaaaatgcgtacatggcgccgtgtgccacgtcaccttgctgctctccacttgggcggcatgatctatttctgtaaatattttcgctggtataatatttctgtgaatattaaaaaaattaaaacgaaaaaaaatacagtagtaagcaggcagtcggcaggcccgggccttggatcatgcagccgatcagaaacaacagttcatacagcgcagcagcaagcaggcagtcggcagcagccacaacagggatgatccttcggcgtaatgccgatgcagtaacagtggctaacacgcgggcatagctgggacttgggccgtgctttgtcgggtcggcccaaggcacgatggcccagcacgaggaaagcacggcccagcacggcatggatttgggctgggccggcacggcccgtagttgggctgtgcctgggccgtaagttgaggcacgctgggcggcacggcacggcacggccactgggccgtgcctgggccagcccagcacgaaaatggcccgaaggcctgaaggtcggcccagcatgaggagcgcaggagtcggcccgtaccgcgagcgcgacgaattttttttatttataattttttttattaaaagtttgacaaaaataattttccattttgaaaattgacggaagtagtcgcctaccaaaaatcgccctctcagagggcggcgaaaatgac

SEQ ID NO: 23013 - DNA, 15110 bp, Oryza sativa
agggggcatggaattttgcaggcggcccccttgccgccctgggggagggcgatttttgcctctccccctataaagcccagcccctcctctgtgaaatttcattatattcactaaaaatacaaaaaaaacgaaagagagagaggggagggcagcagaaggggagcggcgaagccctgctggttcgctcaattcatcacaggtatgctcccatacatcttttgcatttgtactaatatgttatgtttgagtatatatgttacgttttagttttagttccatatattttagcacatctgtagcacacagcacatatgtgtagattcagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaaaatcattgagatgaggtatggcacatttgaagcttcttatgataatttgcctcgtttgttagccaccattgctcagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcatcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaaaagaagaaatttaatgagttgtgggacaagttggattagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctatggttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtagatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttttttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccacgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtttttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctattagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcaccgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgagtaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggcgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctattttgcacggtacagttcagcccagatataagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaattacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacgttagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactatcacacaacacacgaaaatgaaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaaaaaaatatttgtacggtaacaatccaaatatgccctaaaaaataataaaattgtattttaccagtcttggagattttaatcttgtatagttttcaatataaaatgatttgataactattgatatttatacaaaaatatagagcacaatacaaaatcgccctagcggagggcggcaagggggccgcctgcaaatttccatgcccaccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgagagggcggtaggcgactacttccgtcaattttcaaaatggaaaattatttttgtaaaacttttaataaaaaaaattaaaaataaaaaaaattcgagcgcgactgtgcgagatgatcaggaggcaggtgcctcgagcgtcgagtgcgtgcgtgcatgccggggagcccagatggtgatttctgttttgttttgaatggaacgtaactcctgtgacgatatctgaacgcgttatctgaatggaattactccttctcaactatcaagggaacagtgccatgcagatgtgcatgcctgcatggtcgcatgttgactattgttgtaccatgcagatgggcgtgggcgcgtggccgcgtggtcagacttcagtgtgcgtgcgtgccgttgccgttcagtgtgcgtgcatgcgtggccgatcgacgtcggcgcagtgcggagcaacaggcggcggcgggcaccggcgcgctgcgaagcaactaggcggcggcggcggcaaggtaacaagtgggtcgtgcttgggccggcacggcccgaacagcgcccgccgtgctttgggccgtgcttgggtcctttcttctccacctcggcctagcacggcccggcacgattagtaggccgtgctgggccggcacggcctgttctagcacgaagcacgatgggccaggccgtgctagcccggcacggcccaagtcccagctcgtgggtccagatccacgtgtcagtatctactactacatcaagataattctcattgtagtaacacatgatttagtcgatcccacctgtctagccatatagagaagcactagtgataaagatggatgccaatggattgtaacaccgagtgcaaacattttacgtgaaatgaggataagagcacaatattaattcaaacaaaaatatgctgtaaaatttatgcgatgcaaagaaacccgaaaagggaccacaatgctagtatacatataggtgtagaatgagggcatgcttgtccttcttttggacaatatgtccaacccaagtgcccaaccataggagaggtcactttttctctctatgtcggtggaggctgagagtctatgcgacggcaaaaaaaaaaagtgtgtctttagctttcctctgttcgcctcccttccccctctgtcttcggtggccactggtcatcgacaaggggaggggagtccagtgggtggtcgggttcatcctgcagttaggtctatcccattatagatcgagtttatctcatgttaagatttcttctttccctttcatgcacagctcaagggagatgacgatgtcttcatcctgcttgctgtcttgcatggctgagaagttatggtccacaggtgcagccgatatgtcctttggtggaaggtcttcttcctccacaacggcaagatagcaccggcctttcagaccaactccggcaagtttattcctaccgatttgatgtccttctttgtcttcaatggtgtgttttcaaggctagactgatttttctcctatttattgaatctgtttcaacctctacttataagagacccccgttggatttgtgtttcgatactatcttttgcggtcaacctcgttctcgccatcgccactatcgactttattgttttggtcatcggatcggaagaagaagcaaagtaagtacttgattgctttttaattttcttttagagtccttctttgcttatttttaggatctctatgtaatttgtttatcttctagaggtctttctgcaaattgtgatgtatgtctgtcttgtcctattgtgggcaaattaatcactatttcttctagagatgttatcatccctcgtgaattcggatcaggtgtagtcacactagtgattgcaagttaacaactgcacgcaactttggccgtctattttttgcgatcaacgggttagatcaaagctacagtagccatgtgaacagtactctgtgctacagtatttattgctacagtgttgtcgacggtacaatgcgcgatctaggctgtccagcttgtatccaacgatgcgtacggctattgtttaagttgcagtcactattgtgaccgcacctgatccaaatccatcactcatgtatgtctagtttatatatatatatatatatatatatatatatatatatatatatgtaatcttctatatattgaataaatgcatgggttcttaaaaaaaaagtgcccaactatctctggcccaataaggattaacgtctgatctacatgctgctaaagttgattgggattttcatttaaaaaacaaaggcatttgccgcaattctgtaaattcgtctacaagacaattgtcgctgtcttgatggagatttttgccacgttcgttcgacctgaaggcaatgtcgaactgctttgttaaatacacgaaatttatgaaatgtaggtctaaacttaatagtagcaaaggtcccaactgtttaattaacacattgaaatatacgtctaaattcaattgtagcaaataaggtcccaactattcaattatcccatgaaaggtacagttgtccaaatcaacgctctactgatcgatagatacattgatccgatcatttagttgtctgaagtggggcagtctatgggatgaaatagtgtagcaaatgtataggactccgatatatcaccaggatttaaaagttaaatgttgtttcatcctccgttcctattttctctacggatctagacatgctttaagaatagctatatatactatttaaaacaacagtagtggtgcatggtgtctattctgccaacaccgccgcatctgccattgacaatatatctgggtccactaaggcagcacgaaaatattgtggcttattaacatataattaattgagtattagctaaaataacttgaaaaatgaattaatatgattttttaaaacatttgtatagaacttttttttaaaaaaaacacatcgtttagtagtttcaaaggcatgcacgcaaaaaataagagagctgagttgggaaagtgaaaaaaaaaacttgagttgggaaagtgaaaaaaaaactcagcttaattagtgaaacagcatgtgccaccagcgttgtggaaaacggttgatacggccgctatgacgcccgttaaaacggtgacggtaagcagtccgtcacattagtcgtccaaaaacgcgtaattcctgttattaccgattaatccagcgtttttccgactaatcggccgtattggcagtatataatcgggcatgatcaaattcactgggcccagctcacgcacgatagcctatcctgttagttgtcttctctcgtactcctgtacagcatgcatgtactactatattaatctctttgaagaccaaatatttttcaaatgcactaatactagtataagatttcaataacgtgtaatgcaaattatcatggtattattatatataatttgttatggcagcaatggcaggcattatgaactgaacctaccactagttaatgcataaatatgcattatgatattttttgcattattaactttagtacgtgtatgttaagttaatgtcatgttatggttgttctatttaaatatatatactaggaaactagaatgtgttcatatggatttaattacctctaaaaggacaaactattattaactatgtacttatatttgcaaaacgttaaatttccgtcatattccgactaatcatccgtattccgattaatcgtttggcagtactctccccgtccgacatccgtatttcgtcttccataacactgtgtgccacttgattcaaacgctcccaatttcacggttgacccccatcccgtcttcgcagtttctcgccgtaggccgcaatgcttcgccgtctctcgaaaagctgcatgctgcatggaatcgtagtgcgacacatgggcaatgccctcgctggctgggaattgtgcgctcttggccaggaatcgtcgccgccactgccagccaccagccatcaacatcgaacctgacacatgggccctatcagtcagtcacccaccctcctagggtctcctcctttgtcaggcccatgaggctactacgcggtgcccctgttccccagcacagagctttgagtggcggcgacaaccaaaaaggactgaacgcgaagaagaatgatgccacacggagcttcccgtcgctatcaccatcgagctccttcgtgtcgtgcctgagggaggtaggcggcaactctttagaggatgagcggcggagacggcatcctgatctgccccagcaccttggcgacgaggagggggacggtggatggcggcacactgaagagtagggaggcggtgtgaacaagaggcggcggttggaagccccgagctctgtcggcctatgccacccaaatccgcaccgcttcgagctccattggccaactccacttcaatgttcaaaatagctggctatggcttttagcggctggtatctgtagaggctaagaaaggctatagcgggctatagcgccgctaatcccatttagcggttttgtaattgcctgacagaaatcagtcaagaattatgcatataaacatggaatcaggaaaaaatcatgaactaacatggtccaagttctaatcttccatctatctaatcctctgtctatcctcattgcctgacatttgaaaggagcaaaaggaacaatactaagtttagaagaagaaaagaagaaaattaaacttgcctgtctgacttgcttgttgctccggctagggcatggcgtcaaaactcaaaactcgaaagaaacttcttcctcagcagccccaagtcgcgagtctacaggtcgaggccgtcgctgcctccgagactctaactccgcagcccagccaccaaagaatcgtgtcgcaggtcgacgtatatcacaggctcatggccgctgccgccgccgccgccgtcgccgctcttttgggggagaggagaggtcaagaggattgaggaatggctagggttgctgccttgctacttgctagcttgctcttatacctcccctttgggccaccagcgagacttggagaaggcccagggcctgctctggattttggcccaagcacaaattgcaaactgaatggcgctaaatgaagtgtaatttagcggatttagccggctaattgctgctattagcggaaaacatcgtttagcgtcaaaagctaactatcctcgctatatcccgctatagcggtggctatagccggctattttgaacattgctccacttaaacccccgtgtgccccgagcttgagagtagagaggttggtacaggatgaggccaccggtggcatcgcatctggcggggtggggggggggagcagctaaacaaacaagagagggaagaggaagataataatggcgaagaggacctagagctcacacatcccgatttgtgccccgccaggagctcgtcggtcacgccctggctcgatccgcgccattgggagctcgccaccttgaccacccgtcaccgtggacctcgattctcctcacctccacgactgtcgccaccccactccatttgaattaaaaccaggtttcctatggaatccaaccaatcctttcattcataattttaaatttgaacattcattcggtaaacggcactaacaactgtttaaccatttttgggtaactgtttgttttaagaaccgttatttttaaccttgtctaatagtagacctaaatggtgcacatgatttaagctgcgtaatttgttgccaagtcgatttactaccctataaactcaaaattttttgctatatgtttaaaaatacccgctgcaaatattttgtatttatgtttaaacttttcttttagtatttttaagatagagggagtatatcagtaaatattagtatgcattcttatagtgtagatgctctaagttatacatcttttataaaaacagtattaattaataaactttagtagagaaccgtaaaaaaaaaatagtagtgcactaaatctatctaatgttactcccaccaaacaaaaacagttactcgaagaaaagattctctagcaaacgcacacaattatcagtggaatcttagtcagtacaggcaagtgtgcctgcccaattcggtgcatcaattgatgcccataatacagaggtatggcgactgtttcctgagctcaaattaagtcttcctggtcccacgaccataatatccttaactgtcctgcaacaagataacactaaacagcagtactgtttttcttctcagcatgcaactgcgatttgcaggtttgctgctagcgaacacttgcagttagcccctcctggaaacgatgttttgcagttggatccttaaaaactataggacatgtacggcgggtgtgtgccagccgtaaaatactaaaatctatccaccccctggtaaaatctatccacgtcaattttcattgacgtgggagagagtttgtgaagagagaaagtagcaatatgttaattgtccaccgtaagagagggaagggaggtgttaaggatgataatctccttgctgtaacctagcattcctatatccctatgtttgttaggcggtgttctaaaggggcttttaactatttaccacttttagatttggcaaataactatttgccacccctatctcaatgacatgtgggtccagtggcaaaaagttaattgccacatctaaatgggcaaatggttaaatatctctgttctaaaggctatgtttccaactttctttcttcgttttcacacacatacttagcaaactactaaacagtatgaaattttaaaaattttctatatgaaagttgctaaaaaaatactccctccattttttaatagatgacgccattgactttttgacacgcttttgaccattgtcttatttaaaaactttgtgcaaaaatataagatataaatcatattcagttgacggagcgtggggctcctcaccgggagaccgcgcaggcccccctttgccggtccggccgggggccctgggtgagattctaagctcctagtctgtggaaagttcgcgagaatggaaaaagcacaagacacgggcgaagtatacaggttcgggccgccgagaagcgtaataccctactcctatgttctggtggatctgtgtatgaagaagctacaaagagctggagagccagagagctcttactctagaaaccctcttctcccttttttcctctcgtgggatctactctccagttcctctctcctttcttcttttcgtccccctctcctaagtgggcaaggtcctccttttatatctcaaggggataccacatgcaccacctctacctatctctctttttggttggggacttatcctatctttactccaacttggcttgccttctctagaaagctaaaaacactgcttgtttttgagtgtggccacgcgtcctcactcgtctgacctcggggatcaccctgtcatctcttcataaatgggcggagacttgcaatggctgctgtccgaatgaccttctgatgggatggcccatacctacctccactccgccggaagcaggtgcaacgtgggaacatggttgtctgccgacgacatgaccagtgtcagaccggtcacaaatcggtcattcttgcccaccacgtgtcagtctagcaatctgcatgctcgcccttcttcatacaatatcttgcttgtaatggttaggatgaagcctggcatatatctgaccgggaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgaccagtcacagaccggataaacgagcgca

SEQ ID NO: 23014 - DNA, 26254 bp, Oryza sativa
tcggggccgacccccccgagggggtcaggccacgtgggtgattgctcctgcccaaacctctagtcatgatactcccggtcccatgtcaccgacattagtgataaaacaaatcacaataaaatatactataattatgtaaattttttaataaaatgaatgatcaaatgtgtgttcaaaatcaatggcgttatctattaaaacagagataaatctatttttaaacattttttcataataattaattaatcatgcactaatacatatttcgatttttcgcgagggtctgtaaataagatgtgctgagtgcatggtaaaacaaaaggtgaaatctagcacaagtgatattgtatgacactcctcgtgggggaggtctcatgtgcacacaatgtggccctcatcctttggtcaaatgcagataatacgtcatacggtatattagaaagaaagtaatttgcagctaaaaaatttatatatgtgttattagtgactttaaatgacaatgctgaaaaataaaatttgataaaaactttacaatcatctttttaaaatttaaatttaacagcgattgatgttctatagagaacgatagaggcttgctgtgcagacgcccggcacgcgaacgccatcatcgtgctcatgaattaggattctctatcttcaaaatcaaagtcacgtgacatttatcattgacatgtaggctcgacaaaccttaaactgatcacatgttagtggcaatggtatcaggagggtttggttaactaccacacagtttgttgagccttatcacaaatttttggcagattttgcttcatcgatacagttctggtacgccaaaatctttaattcctcatacaaacatgccatgcacctctattactttaattatcacactttagctataactaagtttcgtatggtgtgatattaaatacgagtagatcgaccaaatatgcatcgaagcattttatatttaggaattaacgcctttgtcttctatatcctaaaacactttaatttagtttgaaaactcaaaaacaaggatttatcatttattccctcagtttcatattataagccgttttgattttttttcctaatcaataatttttaagtttatagaaaaaatatagcaacatttttaacccaaaataaacatattatcaaaatatattaaatattaatttcaataaaactaatttggtgttgtagatgttaataactttttttataaacttgatagcctgactagaaaaaagagtcgaaacgacttataatataaaatggaaagagtaattataaagtttagcctacatacttggccttatttgtttcagcttaaaattattataatccagattattgagtcagattactataagatgcattataataagttgagatagaataagctatctttagattattagttgtttgttagctaaaaaaagcacctttaaagtggattgtaataatctattataataaactatttgtttatttcagcttacacctaataatctattttataataatccaagggctgaatcaaacagggcctaaatttcttgggacattgtgcaagttaaaaccattactttgtaagcattcttcgtcatctccagtaagcttgatgtcctcgccaactctaatttcttctccgaagaggatgacagacattcctcggagcacaaaatcaccatgttcttctttaggttagttggatccataccactacaaatatgtcaaattagaaaaatgtcactactattcacgatatcgatttggtgccactgaaattttataaaattgtaaccatgccaccgtccactttcctgtcatcctcgttagatccacattctcttcatctgtggcgtgtgctttgtcaacctcatcggcttcttcaactccggtgtcaacgctggcaagtagcagcagcaccgacacacgggggagaacaaggagagctctgcgtccgcggcctccagcggcggcgtgcggctcggcctcctccctggcacggaagaaataagcggaggtcgtcgaccatgacgacatggtcctcgtcgtcgtcgcgcctggacagcagctcctcgtcgtcgcgcgtcgccactaccatgcccccatgctccagcccatcgatgctccacgagcaaccaccaccctcaccgcctcttcccgcactgacaagcgacgagcgagcggcgggacggatgagccatggcgggacctcggtagctcggtggtggcttctctctcaccagatctaggcagagatcccaacctgtcatcatcacgctcatcgatgagctcgagcggatgcgcgtcctgctcgccgctgccctcgctgaggagctctcctcctgtcccgcccctcccccatctatcgctgtgccctccttctccagcgccgatttgtctgtcgaggatctcctcgcgctcatctcctttggctccctcttcgaccgtccacgaccaccgcgtggagtcgtcgccatccacgaccaccatctagccttcccggagctcgctggctagcctccggcgtaggcttgctgcttgcagacgaagacgacaaggagacgaaggccctgatgtcagaaaatgtgacatggacaacataaattgcgatggagtagcatggttctaattttagaagattggtgtggcatttacctgatatcacgaatagtagtgatatttttctaatttgatatatttgtagtggcatggtgaccatggatttcaaatgcaaatatcacaaatgtagatgccttttatggaagatttccccccttctcctcttcgctttcgctgtcacagatagaactaaaacacctaattcccccaaacaattccaattccaattccagctcaatgctgcacggaatctcctcttcccatcccccaaaactctcccaaaaccgcgtataaaaagcgagctcccctatcaccttctccatcgcatcatccctcccccaaattccccaactccgggcctccggcaagccaagaaacccccaacccaactccggcgatggcgtcgcagctggtggaggagcaccggtcgggcgcggaggtccacacggggcacgagctctgcgagcggaaggcccgggagctgctggtggagctcggcctccccgacgggctcctcccgctgccgtccctggaggaggtcgggtacaaccgcgccgccgggttcgtgtggctccggcagacccaggcgggcggcgccacccacacgttcgacaccatcgggaagcaggtgtggtacgcgggcgaggtgacggcgttcgtggagcaggggcggatgcacggcgtcgccggggtgaagagcaaggagctcctcatctgggtctccatctccgagatcgtcctcagcccctccggcaccaagctcgtcttccgcaccccggccggcctcggccgcgccctccccgtcaccgccttccagctcaacccggcgcccccggagccggagaagaaggacgccgccgccgccgacgaggccgacgccgccgccaccaactgatccaagaagacatgggcgttgcgttttagcagcggtaagtaagtagtgagatccgggccgtcgtggtgaaaaagattgtagttgttgttatatgcttggaattcgtgagcctacgagctcgatctgatctcccatctctctccagtctccagtgtgtctgtccatggatgatgctgaaataaatatatgttcttgtggattcctaattgcagtttacatttttgactgctatgctattgctctgccagcttgatcgatggcttggtgatctagcaatccatgcgaatttctcgccgttctttttgtggattgttatagatttgataatttggcatatattgtcataggattcacaaaaaaaaaaaaaacaaactgtgttttttttttgttttattatttatagaagtggcagagagtaccaaccaacagccttgaattgaaccataatccagcaattaaaaggcaggcaagagaggcatggggtctcccctctccccatgtgttgtacaggtagaaggtagaagttgttcatctaatccaacggctgtgcgtttcttgaaaaatcaacggccgattgttctttactcaccgtcaccttttttttttttttttttttttttttttttgctatttcacggtcatccttgcttggcttgtaatgtaagtcaggccctgtttagatcggactaaaacttttaattccctatcacatcggatgcttggatactaattataaatattaaacgtagactattaataaaacccatctataatcttggactaattcgcgagatgaatctattgagcctaattaatccatgattagtctatgtgatgctacagtaaacattctctaattatggattaattaggattaaaaaatttgtctcgcgaattagcttttatttattaaattagttttgtaagtagtctatatttaatactctaaattagtgtctaaatacagagactaaagttaagtccctggatccaaacaccacctcacggtcatatattccctcccacatactccctccgtttcacagtatgaatgtggaaaatgttagaatgacttatagtcagatttgtaactcagattagagtcgaccaatgctggttagatttgcaagttagggtgtgtttgaggagaaggagattgagaagattgggaagatacgcaaaacgaggtgagctattagctcatgattaattgagtattaactattttaaattttaaaaatggattaatatgattttttaaagcaacttttctatagaaaatttttacaaaaaacgcatcgtttagtagtttgggaaacgtgcgcgcggaaaacgaaacagacaagctcactctcccaccctctcgagcgctgccttaatggctttgtgttggcagcatgatgcatgcactgtttgatatgatagccaacagttgcttagttgctgtagtgaaagaactagttacaggctattgcgcagcgccgtaaagagctgcccaacaggccgagaattttcagaatatgtcactcaatttgtaacactctcagatcatgccaccaaggacgcgaattgtttcattccgtgtcactctgtccctctgaagcggagcgccgtcgcccgcccgtgtcacaacgtccgtctgagtcgggcaccaccgaagagttcctcccccacgccagggagttcttccttccatgccggcagagctctccccaccaaggcgagctgttcctcccgcgccggcgtagctcctcctccccaggttgccaagcttctcccccgcagatgctagagagcttttcctccctgcaccagaatggcgagctctttctccccaacaccggccaagctcctaattccctcacgctggcggcagcaacatgacgcaatggacggcacggtacggatgggcgacgggcgtaacttcggagagacggagtgtcatggaatgaaacaattcgcgtgctcggtggcttgttttgaaagtggtacgaattaagtggcaaatcctgaaggtggtgcaaattgagtggcatactttgaaaattctccaacaggcataatgcatggatttagaattgtaactttcccctgttctttttttaataaaagagaaaatataacttgctattcgtaaaaactggtagggttgcccgcttaccaaatagcacagtttcaagcgaaagatcgctaatgcatcatttgagagttaaaacacaactaccaaagaaggtattctcttgttcgtcgatagttatttcattagatgtgggacgagcctacgtgtcgggcgcccgattgatttagggaaaaatcgggcgttgacgtcagcataacgtcaacgccacgcatacgtacaaaactactctaaactaatttttctcttaaattatttatccaaatcatgatccgattgcaccattaaattcgttgcaattaaatctttaaaacaaaaccacacatggatatattccgatgaattttttttagcttattattgaattatcattgtgtttagttccaaagttattcttcaaacttccaacttttccatcacatcaaaactttcctacacacacaaacttccaacttttccgtcacatcgttccaatttcaaccaaacttccaattctggtgtgaactaaacaaccatacatagtgaaacattgtgggtacactaggtgaaacatttttcgtggaacaaaaaatgaaacgaattcccttaatagagggttttcaaaatatgtgggtaatttgttgcaatgaagtatatggtggagataagtggcaggcgagggaagagacgtggtggggcccaggggcaggcaatgcgcgtgatggggagggagcgcctgatattcctccctcccccgagcgactgatccggggcattctccttagatgtgtacatctggagttgaaaaaatgggttagaaattcaagtataaatttagggcctattttgtatagtttcacttcgagggatatcgtctatggttaggaagtgcttcaaagctcaaatcagataaaacacatttgatgtgttagaggcaacgggttcaaatcgtgataccctgaatcatgcatgcgcacatatactttctactgaaagtatatgatgttcgtatgttatggctttttatattgagcagcgaagccagggccgggcaacctagagccagtgcccaggcccatcgcaccgagaggccggtaacgctctctcatcttagagtgtatgagattttttttaataatggattaaaaacacagctaatttatggaaaaggatgtatacaaccataaatgtccatacaagaatacttatactctccccattacatgtgaaacattgacgacataacaagtttaaccaccacaagaaagaagaaccaaaactaagcttcaattcttcttgtgaagttccaaccataggtagattagacttccagaagtttcatctccaaggttttgcatagaaccttcactatattgccatcatcctcattaagaacagcgaccaaagtcttgccaaatgcgtgcccctgaaaatcacctacgcaaaagagttagcgatgtaaccattaaataccacattattcctacttatccaaactgcccaacacattgcagctatgcatacaaaaattagcttcttaagtgccaacttccaaagatatgtgatgcactacgaggcttggcagtgaagaggtcctgatgtcgtgcacagggagcatggagccatggagggaagggaggggggaggggggctaccgaatatccgtcggaatatccatttgcaagtatggagattccggttgaggatttctgcttggaccgaactattcaacaggatattggtatttgttactagagattccagtatagttggagcttctccaacaaagtgaacaaggaataatatcgaaaggaatatttagggaaaagagagaagtgattccaaacacaaaaagggaacaaaaacacacagacaaaaggatttttttttttcatgaagttctgatccaaagatcctactcttcattgaggtgcttcttagagctggtacaataaagtgatgtaagatggttgtacaagttaccacatcagatttgtgcttacgtggaggaaagagaagaaaagtggactacagattcttagctagcttcagcacgagctcaaataaactatgtgagagatggctgaattaggttttaatgatgtgatatatatctatagctaactattgtatgagtgagctattaggttggctatagatgatggttcaatttttggagctaatagttgactatattattaaacttgttcttaagagacgactctcttttgatcccaagcctcaccaagttaataaccaagagaaggctttaatctccaacttcacaccaaggaataggggtttactcctaaccaccaaggttcaaggatccaacaccaaggctttagtcgcaagagcatgaacaatccaatccatcaactaacctatctagctctcacctcatgacgttaccatctcatctctttgtattctctcaatactcaactctgtctatgtctcacgtcgctgtcaccacccacacctgcagcaaagaccaacaccatgcactccattgggtctgacaattttaatttgtttcttgaaccgaggtgcaccatcatcttcgagatatgaaacaattcaatctatatccgcacccgcttagaaaatgtagtgtaggatatgatatgactagaggtgaaaacagagtggattcagacgaatagtgatgagaccatatcctacaccacatattttaagggattctgagcgggtgtgatggtgtgcatatgtggtgcgggtagttttggataatggaaatggtgcggactctattcggaaatagatatgtgtatgtaatacatataacatcaatgcaacgtacaaaagtacataacaacataacatctgatttctaaacatgactcccactctcaaggacaacaaccagtcagctgttaggaggtaagagccggaaagacgtctctcaagaccgtcggttatcatgtggtagaccgtcaccttcgcctcatcaaagattaggaggttagaggggaaggattggagtggtatcactcactgctcgctatgtcattgtgtgttgtttctatgagtggtggtggctacacaagcatgagatgagacggtgagagtctacaattaaggagtttatgttatctgatgaattgggctgttggataatccaatgggaactttggataatcctcatccgctggattttagcgataccacaatcgttggatttatataaacccctaccatattctcatttcaaacagattcagaacggatcggatcggatattatccgattcattttcaccctaggtatgactgctattgcccaaatcctctctgttttcacccctattatattaaattcgcccgattgttacactcaaggtttacaacatcatgaattcaacactgggtatccatgctccacaaatgcattgtactataattgtgctaagtcatgagctaccctattacaccatcttccaatatgcctaacctcaacttccgggagcaatctcattatacttttcacttcattgatagttgactctctctcaaaagtagctgttggagcacgaaaaaaccaaaaacaaatgtgaaaaaaaatcttgtgctatcttgcatgatccaaccatgatgaagttgcatcggcaccgtcgcaagaggaagggaactccacctatcttattctaaataatgtatattaccttacaagcatttaattattgtttttttttcaaacacactatcactgggaagatggtgaaccactattgacaaatcaaatttggtttgttgtcaaaaaagttatattcgtttcttgaaacttttctttttatgattgcatcgttgttttatcttgagtatatttgcaacaatattttaattgtgcatgtagtattcttgaaattgcctcattattgcaagccaatgaaaatgacttactcttatgagggcaagtcctttgctatgaaaatgaaaatttttaaatattggaaagatattcccattttgtatgcatttgcatttattcatgacttgtgaggattcctcaatgttttgccacttcttggcaaattgtttgaggtatttcggaagtatgaaaataaattgcaggtaagaagaaattaggaaaacatcctcttcagatccctcgtctttgcatcgagtttaaattccggtattggtttagggatataatttaaacgacggaacgctgaggaatataaagtagactttctctaagaaattacaattgaaaaaggagttctgctgttgggccgtaatgctaggcccagccacgcagagcctacgaagcggccttctgggctccggcccggggcctatcatttcgcaacaaaattcccaagtctccccaaagaaagaaaaaccccatctcccgtctccccgcgagttcgcccgccgccagcgccggcgccgatctccatcccgcgaccgcgagcagcggcgacgtgcttccgccgcaccctcgctcgccggtgagaatccgccctcttctctgtcatcacaccattctcagatttgcttaaaccctagtttcacttctagatctggaagcttcctatctttgccttaaccttagtactaataacagttactagttcgtttgttcctcaaaatgtttggggggttcaatctgtcggacgaattgattagcctattttctttcagccctgagttccaacatttgtaatcgtgtgcaatctgttggatcatatagcgactagagtgtgttgtgttgtagtgtgttgtttgggaggaagcatacgtgaagcttcagaaacatctgtagtgtgttgtgtaggttgctgccatttttactcctaagataagagtgttacttgagaggtgaatccattcttgggtttgctagttatcaaaatttccggcttatattcaaatgaacttaatcctaataatggagatcaggaatcaatgctaataatatatttgttagtggtgaaatcacaaagtatttgatgggctagtcatggatacacactttacgccactgaccttccacgatcacatggaagtatggaactctgggcatcacgcgcctcttggaaactgcttgttgagccggttactctctgctgtaactccctgcttcctttaacctgaccgatttaacccctctcatcacttattccctgttctgaaatcactgtgctctgcaccttttttttttttttactgaggaaatgtaaggttcagatggtctgccgcagccttctgttgcttactcaacagaagctaatttgttcctgggtaccacacagcatgtggtaacctttttgcttgctaggtgctacctaagtctcaggttttcaggaatgtatctcaatttgctctgaattggtagtatgtaaatttttgagatttatggtggcgtgaattttctagctttcttggctgctgttcatgttgcaattcttactgcggtcaaagctgctggccttaaatttgatgatgttaaccttctaaaaaggttgaatgctgagactatagtgtttattcaattcttatactagtcacaacaaaccagttctagttgtcagaagattatcttctctgctgtcactatgccttggggctaagttacaggggttgtagccgggtgaaacaagaggttggggtcctggaccaaggcagcgggcaggcattgaaagaggagtgtgttgctctagcttatcagtgattacctctagatcagtggagagatgcacgctgttgagtattgacttcttcatctacaagtttacatgcatacggggatcatcatctgtgtatcttgaacattggaatttgaaattattttttgaaccgtcatgttcttattgcctttcgcagttttcacaacaaaaataatatgtaatgggtcttataagtgcttatgtctgtttcatttcctgctgctcttataccattttagattcatatgtatgctggaacatcacagatttatcactcatgtgaacactacacagtaatggcatctgcctaaatttgttctgagtttttagtgcttattaaatttatttaaattttgttttcattgctgtcgaaagctctaaattgcttcgtggttcatgacaaagctaacttttaccttctccaggtgtccgggtatttgcattcagtgacaaaagttcttcagctgcggagtcatggctgcccagatacgcataataatgaaatcttttatgagccaagctaacaaggttcaaggggttattccatacgctcagaagattggattgcctgaatcacgatccttgtatactgtgttacgatcacctcatattgacaagaagtccagggagcaattctcgatgcatgtcaagaagcaatttctggtacagaaagcggaaacgcacgagctgcaaaagaagctgttctggttgaagcgcctgcgcctacttggagctcaatacgaaatccaaatcagtttcaagactcgtttggataagagtaagctccaagctgctttgtagttggttcgttcacccttgaacaagactgcttctctctcttggttttgagattgtcaaacagaacctttgcatccattagcatttcatatgaagaactgcatcatttggaagagttcacaggaatgttgtactagtaattcattccaaactcagcaccatttggaatagtttacaggaatgtagcagtagcaattcatccaactatcatatgctatgaattatgatgacgcagcatgatctgtaataaaacagatgtgcctgcattcctggatttgttggttttgtttctagtacagtctaacaactcatgacattccaatcctatataccttttattcgtttgttcttggtactactaattcacatgagtcatgacaaaactcaggggctcagtggtggagatgagctgttgaattagagtttagtgttggtggctagtgagcctggttctgaatcaagcagccttagcacactgtctgttggtcacaaggtctgcataaatcttgccccttttcgtggaaggacaacaaaacagagtgcaagcacatcaacctcttgtaaaatctgcatttccggcgatccattcgaagtgttcattttttttttggcaaaatacttaacataaaaaaaaaatagtcgaatcatgctgaactgtattgtacagtgttggatcatgtggacactgtttatactccatgccttcatggcactgatctgcaatgtgagtatggattcctctattcatactctcttcgtctcgaaataaatcaaactttaactagaattaaatcaaactttaactagaataggatacatcctaatacaacgaatttgacagatttattgtactaaaatgtgttatatcaagattcgttgtactaggatgtcctagtacgagattaatttattttgggcaaaagggggccttaatcaggctggccgacatactccaattattcatctctgtttgtcaagctgatgtgcgcgccttctgaactccattcattaattgaaagcgtcttcttggcttgttgtcacctattaatcgatctgatatgaattcaatacccaaagatacaactcagttgtaatggataattaatgtgtctatgtcaattctttctctgaaggaacccaaatatctcgccttgataaatcctatagctaggggtacgcctaatggacgatcgatcgccctggggatagggtagcgatcagattcgctccccacctctcccctccaccctcccttcctccacctggtttcctttttggctccgtattactttcctattttagtaaatttatgcacctaaagtttatacacctcaagtttacacatctctaaagtttagagaccaaaagtttataagtcaaaagtttatatatccgattcaaatttgaatttgaattcaaatattttttatatatagtatttctatacatctaaagtttatacacctacagtttatagacctaaagtttatatatccgattcaaatttgaatttgaattatatctgattcaaatttgaattatatctgattcaaatttgaatttgaattgaaatattttctatatatagtatttctatacatctaaagtttatacacctaaagtttatatacccgtttcaaatttgaatttgaattatatccgattcaaatttgaatttgaattcaaatattttctatatatagtatttctatacatctaaagtttatacacctaaagtttatagacccaaagtttataagttaaaagtttacatatccgattcaaatttgaatttgaattcaaattttttatatatagtatttctatacataaatttttctaaattttttttaaaaaaaattgtggagatgtgtaaacttgaggtgtacaaactttaggtgcataaatttattaaaataggaaagtaatgtggtgccaaaaaagaaaacgagagagaatcagatctgattgcccctagcgatccctagcgatcgatcgctaggtagcattacgctatagctagtgtatgattgttctcttgtattctattactagtactcttatatgctaacaggtttgatgttgcctagaaaaataaataactatgtgggctcatttgagactgggaatgtggtgaggacatccctatcattgatacaaccatacctagtatacagcaaggaccaattattcgagctcaagcacaacaactcaattatcaggaacattgaacacaaacaaggtgggaggaggagcagccatgagaatgaacaagtgaaagccagcatgagcaagggaaagttcagacagcatgtccggttctacaggcaatggcaacttcaattggtcataactctttacttcaaagagtgttggaagctcatgagcacttgttggaaagggttttgatgtctactttcatatggatccagaaacaccatcaaattccatcgaagctgtccagaaactgcagaagagacgttcggacctcgaacttgctagttgggccttgtatccagtatagcccattaagggagcatttcagctcagttcaaaaaaaaagggagcatttcagctaaggtctccgtaacctcctgctgtcctccaccatataataaggcagcagcagccaccaagaacactcgagttttgattagatgcaagtttagtttcagctacttccttatattcgcgtgaatcggctaaaccacccggatgcttgatttagaaccctgactttatgtgtattagttttatcatttggcaagtgttgtgaattgtttccttatcaacttgttcttcgattgcctacaagttaagtattgttcttggcacaacaaaaacaacaataaattagagccgatgtactggttgctaaggcgcaacgccgctctggtagttgtaaccgaaccaccagcgtcatctcctcccacaaatcgaagttattattctctcactaaaagattgggaaccccgttgctacatcaaaatgtggatgtcccaacagacatgagcatggatgtgtttaatttgttccactatatttactttcagctactcatacaacctctacctcattttggcactgcaagttatccatacaacaaaaggaggtcaaggtttccacaacaatcttgctcttctaaatgatattccatcttcaactcatcctcatatcaagcttttgtctctatgagcattattttttaaagaatttttcttttcagttgaaatgaaggcgtattctccagcaaattatcagttttgtaagatacctttcagccataacaatcattttcatatctactaacaaaatatacaaattttaattgtcttgtagtaaaatttgattttatttttctatactgaaagtcgcatatatttccaatttttgctctgggccgggtacccagctaagggctccctttgaactggtagcgctaatgcgcgcggaatattagttcgagcgccacacgacgccctctccttccggtttttctattttttaccaccccacctttgctttgcatctcaccttttctcggttcctttttttctttttttttaccaccccaccttccgtgtttcttttttctcttttctatctcatccgtgcttcatcaatgggcccgctaaaatattagccatccagatttttctgtttttcgttccttctctgtagtttttctgttttcgcgttttagtaaaatatttaccgtctagtttttcttttcgagtttttcattcttctagtatttatgcacgtttcaaaagtaacgaatttaatccgacgagtttttcatttactccaagactcccacatctgctcttcaaaagtaacaaatttattcgcatgaatgcctccacatcgtatgacaccatacctagctggtcgtaaaataaaagaattactaccaacttacaacgcaagtaattcttttaccaatattataaatattgtttagatttcatggtctaatattataaatattgtttagatttcatggtctgtgagtaaaacaattactaccttcctcttgttatagcccatgatctcgtagccaccgtgtagtaatatgtttactgatgtattcaatacatagtataagagtaaaaactgagatttcgtggtctgcgagtaaaacaattaccaccttcctctcgatatagccatgatctcgtagccaccgtgtagtaatatgttcattgatgtgttcaacatacagtataagagtgaaactgatactaagagtattgttgatatgtatcacaaaatagtcgtatgaatgaaaatattacaggcttaatcacacacaagcaataaaattactcataggtgaatcaaactagaaaaaaaaatgattcagccaaaaatctatctggtggctttgctggatcttgctataaggatgaagatgatggtttgtgtcttatgacgggtagtggagagggcaaccgggtggcgatcagtagtcgacgatggaatcatggaaggatgtagcggtgtggtatagagatgagctcgacgttgcacagtagcagccatccatcatctagcaagcacgaaaaaaaaatgcaaaaacattctcgttcatgtcaatagagatgacgagcaaaagaaaaatagcaaacaacctccatcaccggcgcactccaccctatcctctgcggccagccacatggagcacaatgtgcaaatgtaggatatgtgcagcccatcaattgagtttaggtaatattggagattgcacgctaatttgatttgcaaaaaaaattagggcttcatgcgtgaaatggaaggagagtatgtagatgcaaatcagagtgtcatttccttacttgcttgttctatcaatgtcgccgacgtggagcagccgctggttgttgctattggccctggtgaacacctccttgctggttaaggtgttgcccagcgtctgacggcgagggtcgaagcagtgccttctcctcatctgccgccggccactgccatcaatcgccacggtgtcgtcgtcctcctcctccatggtgtgtcgccgatctgtgggcttttgtcggtgacatgggaccgggagtatcatgactagaggtttgggcaggagcaatcacccacgtggcctgaccccctcgggggggtcgggcccgagggtgatgtggccgcccccctctttgtctccccgaggggtcggaccgctcccgtttcggccccgagggctgaggcgccccgaccccttgtgggtttggcgccgcgtgtatgggttaggtgagcataacggggctcacctaaccgcatttattgcggtttagacgagcgcgtcacgccgcatgtaacgcagtgcagcgcgctcgtttatccggttgtgaccagtcacagaccgatcagatcgtgggttaggtggcgacaggcggtctgacgcacgcctcgccccatcccgtcaggataagagcctccaagcactcgtccctagccggagccggcgtgttagctcctggaggtggcacgttggacccggtcagatatatgccaggcttcatcccaaccattacaagcaagatattgtatgaagaagggcgaacatgcagattgctaaactgacacgtggtggacaagaatgaccgatttgtgaccggtctgacactggtcatgtcgtcggcagacagccatgttcccacgtcgcacctgctttcggcggaagtggaggtaggtatgggccgtcccatcagaaggtcattcggacggcaaccattacaaatctccgtccatttatgaagagaaggcaagtcaagtttgagaaaagagaggataagtccccacacaaaaaagagagatggtgcatgtggtatccccttgagatataaaaggaggacctcgcccacttagcaaggggggacggaaaaaagaacgatggacgaaaagaagaaaggagagaggaactggagagtagatcccacgagaggaaaaaagggagaagagggtttctagagtaagagctctcttgctctccagctctttgtagcttcttcatacacagatccaccaaaacacaggagtagggtattacgcttctcagcggcccgaacctgtatacatcgcccgtgtcttgtgttttttccattctcgcgaactttccacagaccaggagcttagaacctcacccagggcccccggccgaaccggcaaaggggggcctgcgcggtctcccggtgagaagccccacgctccgtcatctggcgcgccaggtagggggctctgcgtgtgtttttctaagctctcgcattctttcgtgtgcgccaagcttttcctgttcagcccaatggccgaacaagcaaaggcgcacaacctctctccgagcgttagcggtgacgacggggagccgaacccacaccgtcgagctcgtactccaccgccccctccacgccaaagtcctaggcgggaggaggcgctcgagagggtcgaaggatccgagacttcgacatccacaggtgatggagaagggcgccgagatggggagcgtcgcctcctcgtctacggcgacggcagcacgccccagggcgcgctccaagctgcgggcgcgctcctacgtcacccgcccgttgtccttgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggctgccactccctcgtcagcacctccaacccgggaagatcagcgtggggggccagatgcccgcatcgatatcgaacgccggcgtaatggtcgacgtactgcccacgcaacggagggcgcctcctcgtccggagtgtcacctcaactcggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacgcgaccaggatcgaggccgccgggggcgatgacagggtcatggcgaatttctttcccatggccctgaaggggcaggcacggggttggctaatgaacttgccacccgcgtcggtccactcctgggaggatttgtgccaacagttcaccatgaactttcaaggcacatatccgcgcccaggtgaagaagcggacttgcacgcagtacagcgaagggatgatgagtcacttcgctcatacattcagcggttttgtcaagttcgcaacaccataccatgcatccctgcacacgcggtgatctacgcgttcaagggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaaaaggtccgcccattctgacgacgagggtcatgtccttgccgtcgagggtgcttcgcgggtcacccgaaaggggaggtctgcgagcgacaaaaagaaggaggccggcgctcccagcagggagcgcccaaccggcaggtggtgcaccgtctacaacacctcccttcacgacctcgcggactgccgcgccgtcaaaagtttggctgagcggacgaggaagtgggaggaggagaggaggcaggagcgccgagggggcaagtccccggcggttccttccggcaatcggcgaagtgaggccaagcagaaggcccccgccgaggacatcgatgacggcgatgatgacctaggtttccaagaacctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgatcacccaccgtgcgttgcccggggaggacagatcgcaatggtggtttcccccactgtttgcaacgtgaagctggggcgtgtcctcattgatgggagagcagccctcaacatcctttcccccgtagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcacgcggaccacctcgccgccgcgtccaagcccaagggtggcgacgagaggcttggcacctccgtccccgccgccccgaggcagcggatgatcacatgcgacgaggtcccggtcaaggaggttgccctgggcgacggcccgtccaagaccacaaggatcggtggtcttctggacggcaaataggaagacgcgctcgtctccttcctgcgggcaaacgctgacgtcttcgcatggagaccggcagatatgcccggggtccccagggaggtgattgagcaccgtctcgccgtgcggccgggcgcaaggccggtctggcagaaagtgcggcggcaggccccggaacgtcaagccttcatccgcgaggaggtggcgcgactgctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacctattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactttcggatctagcgaaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccggaccgtttacctggacggaggaagctgaacatgcctcgcccagttgaaggcgtatctcagctctcccccagttctggtcgacccggagccaaatgaacccttgctactctacttagcagcgaccccgcaagtggttagtgcggcgttggttgtggagcgcgatgaggacaatcctcattccgcgcatccccaccctgtgctggcttggcctgggagagagcagggaggagaggcccccgagccgaacggtggcccaaggcccccgacgactggagctggccctctgcccgcttgtcagacggtgccaggtgcccccgacccccaggatggcccgggggccactgcgggaaggccgcacctatcgccctctgaccccgaggttaaccctgtgccgactcgacccgggagagagcagggagaagaggcccccgagccgaacggtggcctaaggctcccgacgaccggagttggccctttgcccgcttgtccgacgacgccaggagcccccgacccccaggacggccccgaggccactgtgggaaggccgcacctgtcgtcctccgaccccgaggtcgtcggcacagaagacaagtgcgccccacgtgaccgcttggacgaagagcgccccaggcatgcggcccctggcgaagaggatcggccccaccgaaaggtgcagcggcccgtctactttgttagtgaggccctccgggacgccaagacccgataccctcaggcccagaagatgctttacgctattctgatggcctcgaggaaactgcgccattatttccaagcgcatcgggtcacggtggttacgtcttaccccctcggccaaatcttgcataatcgagagggtactggacgggtggtgaaatgggcaattgaactttctgagtttgatttgcactttgaaccacgccacgctatcaagagccaggccctcgccgactttgtggcagagtggaccccagctcccgagcccgtctccattcccgaggccagctcgggcccctcgcagctgcatcacaccgcctactgggtgatgcagttcgacgggtccctgtctcttcagggcgccggtgcgggggtcacgctgacctcgccgagcggagacatcctcagatacctgattcgcctcgattttcgggcgaccaataatatggcagagtacgagggactccttgcgggactcagggtggcagctggactggggatccgccgcctcctggtgttaggcgactcccagctggttgttaaccaggtctgtaaggagtaccggtgctctgacccgtagatggacgcttatgtgcgccaggtacggcgtatggagcgccattttgacgggatagagcttcggcacgtgcccagacgggataacacgattgccgacgaactctcacggctcgcttcctcgcgagcccagaccccaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaactctacgtgctgatagaagggaccctttatcggcgcgcggctaatggagtcctcctaaagtgcattcctcgggaacaaggcgtcgagcttctcgccgatatccatgaaggcgaatgcggagcccactccgcctcgcgcactttggttggcaaggcctttcgccagggtttctattggccgacggctctcaatgatgcggtcgacctggtccggcgatgcagggcgtgccagttccacgccaggcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacccgcccaccccagaagcaatggccaagtggagcgcgccaatgcggaaatcctcagaggccttaaaaccaagaccttcaacatcctcaagaagcacggcgattcatggatcgaggagttgccagcggtgctctgggcaaaccgaaccacaccaagccgagcaaccggggaaacgcctttcttcctcgtctacagcgcggaagcggttctcccatctgagctcaccctgaggtcccctcggcccaccatgtactgcgaggctgatcaagatcagcttcgcagagatgacctcgactacttggaggagcgaaggcggcgcgcggccctccgagccgcgcgctaccagcagagcctgcggtgctaccatcagcgccacgtccgggcccgatcactctgcgtcgacgatctcgtcctacgccgcgtccaaacgcgtgctggattgagcaagttctcaccaatgtgggagggtccgtatcgagtgatcggcgtcccccggccgggctccgttcggctggccacgggcgacggcacagagctgcctaatccgtggaacatcgaacaccttcgtcgcttctatccctaagggggatcgggtgtcaggtttcgggctcgggccaaccccgcacccccctcgggcgtgcagggttggccgggggctaccacacatgcatattcttatttctcttctatctgtatttcaataaaagcattttcaatttcctaaaggctgtatctgtgctgttgtttccttttgaagaatcttgacttgaaataggtcactcgtgctcaatcctgccctcgggggctcgggtcggctaaaatcgccaaaaggggcccagaaccgagccgtgccccggggcgtggtgaactccggggggggggggggaatcggcaaaaacccacaatcgggtcacccataaccctcggtcaccacgctcccggcctggccagtctcgacatgtggatctccccaggcactagccccgacccgagccaattgaggactgggacctgggcacgagcccttgttcaagccaagacacaaaaggaccgcggcacagaccatcctcgtctcatacacacaacaaatagaattgacacaaaaatttcctctttatttgattacagattaaattagtctatacaaaaaggaggcctgaaggcctcggaagaaagaagaaaatggcggaaccagccctgccattgcgaaagggaggaagaagacggaccgccccgggtagcgtggcgccgagcgtccctcgcccagcgtgactatctcccggccggtggcagattccggcatgaagcggcgcggcagcccgacctgtctctcgctcacgatgcgggaaggcggcagcacgctaccatcaagcggagcggagccccgtgccatgacgccggaagaagagatgtttgagagcgagcgcgtgtggcgagggtagggcacaggaaacaaggagttagggcgcaagcggcgaagacaaggggaataatggcgagaggaaggaagtaaatcccttcctcggtgtctttatacccttgccaacgctgtgctcggctcctcgcttctcgcgcccactatctcgctccctcgtttctcgcgcccacgcttccactaatcccattcgcccgcttgcggcgcatgaggtggatatgcggctgtggcggtcgagatggaacatatcgtgcgcgcgttaattacgctcgccgaccgaagcgccatcaccatatctccaggcaaaacgaaccggctcgtcccaattcgcgtgctactcgagtaatgtggcagtcttgaagagaccgctcattattgacagccgagttaccattgccgatgtgtgtgatttgcgaccgttgggtttctgcccaactgtagagaccagccccacttgtcaccaggcctaagtaagtggcgtcacgcccgaccgcttccctcaaggagggcgatcgccctggcataacgccgggggctactgtcggtgacatgggaccgggagtatcatgactagaggtttgggcaggagcaatcacccacgtggcctgaccccctcgggggggtcgggcccgagggtgatgtggccgcccccctctttgtctccccgaggggtcggaccgctcccgtttcggccccgagggctgaggcgccccaaccccttgtgggtttggcgccgcgtgtatgggttaggtgagcataacggggctcacctaaccgcatttattgcggttta

SEQ ID NO: 23015 - DNA, 5314 bp, Oryza sativa
  unsure (1)..(5314): unsure at all n locations
gatggatgaaaagaagaaaggagagaggacctggagagtagatttcccgagaggaaaaaagggagaagagggtttttagagtaagagttctctggctctccagctctttgtagcttcttcatatatagatctatcaaaacacaggagtagggtattacgcttctcagtggcccgaacctgtatacatcgcccgtgttttgtgttttttccattctcgcgaactttccacagaccaggagcttagaacctcacccagggcccccggccgaaccggcaaaggggggtctgcgcggtctcccggtgaggagccccacgctccgtcagctttgatggtggatcgattcagatccaaaaaaaaaggaaaaaaataaagtgggggcaagagtggttggttgggtatgggaaacatagaatatataccggaaacagagaagttgtttttatcgagtaaatcatttactccgataatggtgggagcacgatgcgggacgtgtggtgcgatcgcaagaatgggagttgtttttattattgaagtaaatcgtttactcgaataaaggtgggtggtagaggcgcgcgataggagtaaatcgtttactccgacaacggcaggagtgggatgacgggacgtggggtggggtgggcctgaactgatgcatgcttggttgaaatattaggagcatgcgtagttctactaatttatatgaaatgtctacaaaatatcttcgctccaagaaatattatccggaaaacacaattctgtggaatattctgttttcgattgtttaattatccggcggtcaattgtgcttgcctccttgctggtggtcactgaaaaacagttctagactgctaatcaattaacacgtgcagactagaaggactaaaataactttaaaattatatatacgtcatttcacaaagatagtacccaagcaatatatggtcgatctagcttgtgcaggtgctcgatcggatcaattactatttagtctaataattgatcgaacaagaacacaatcagaaaagagattccaagctatatcatatctggaaaaaggtacagatgctaattgatttaatttgagttaattagctccagttattgcaaatatttggtctagttgtacttgtacgggcatatatggttgcttcctggcactaattaatctccatggcaggtgggcttaacatctgggaatctcgcttaccagacgactaagttgtggtgctaatgtattcagaatgacctttttcagatgatttattgaattatttttaaagtattaactagattattaatacagattagttactaatatgtttttaaaacttcttctattacataactgaacattcgttttagatctttgttaagtttattttcaaaatatttatattatatctaaaatcaagtagatatttcatggtaataatctgctcactaatctaaaataaacgagaccttagtcgataataagttagttattcttactcaaacatatctaccaagtgtgtagtcccatggattaatttattaaaaatcgtatgtcagactacatgactatggggaatggatttaatgtggaaaaacctttttgggaaagaaaagaaaatagtgtagtttcaatatataattgcggttttttcaaattaagatgtttttaaaacacaagtacaatgttttcctaaattagctagaaaggttaatactttagtatgatcaaatgccataaaccacaaaataaaaccatctagctttgtaaatgggattcaactttagtgtgcctagccaacataagctccggtgccagaccgatcggttgtaaagagaattcattcactatacgttgctttgaatatatagtaccggatgtcgtacttgttcatattacataatctccggtgccacaccgatcagttgtacaagagaattcattcactatacgttgctttgaatatagagtaccggatgtcttccttgttcatattacataatctgcggtgccacaccgatcggttgtacaagagaattcattcactatacgttgctatgaatatgtataagtaccggattgccaatcttacttgttcatattagaagacaattttccaaaaaaacaaaaaaaaaaccatcttgagcttcctgtttcttatactccctccttcccataatataagaagttttaaagttagacacggttattaaaaagtaggtataagtgaatggtggagggttgtgattggataagtacgtagtggaggtaggtgggaaaattgaatgatagagggttgtgattggttgcgaagagaattgtggtggagaagttgttatattttgggacaaattctgaaagctaaaagtttttatattttgggacagagagagtagtgattagtaaatatggaagcacttacaagttgaaattatggaaatatgctactaccaatgttggatataatcagacaaattcagttggcaacatcagtcacaagtcatagacttctttcaagatacctctttaattagttaattaatatcatagcaagatctggctaatcttcacatcttttagcaaaaggatcatttgtctttgtctttatatgtgccaagtgccatatcagtatcttgttactcaatggttgaaatttactagagctctcttaattattcttctttcttgtatacactggtcctaatccaaaagcctccaattaagcagggaacttcaaattaaagtctccaaactagatatatcctaaggtaggtcagatacgttctgcactataggctttaatttcagtatgtactgctacaaatgctactacccaatttagagcactttagcttatctgggtttaagttaggtcagatgcccctccactagcttttggctgctattaactagtttcaatcgtgtgtgcactctgccaattctcctaatttaagagtaagtaacaataattacctaggggattaggatgcttaatcaagtatgaatcatctgatgatgcatgtcatgataataaagtaggattgatctgactcttactacatgggatgagctgttcttgtgctagttatatactccctccgtcccgaaaaaagacaaaccctggtttccgtgcccaacgtttgaccgtccgtctcatttgaaaaaattatgaaaaaaattaaaaagacaagtcacgcataaaatattaataatgttttatcatctaacaataatgaaaatacgaattataaaaaaaattcatataagacggacagtcaaagttggacacgcaaactcagggtttgcctttttttgagacggagggagtatacttttagaccacttggaacaataatgcagagatgatgatgccacacattctgtatgtatcgagtgtgggagaagataagatatcatgcagatctaagttagcaaagaagtgatgaacaacctttttagaacacaaggaagaaaaagtgctccagttgagtattgtcatttgtgacagtgaaagacacagataatcctttaatttattcgcatcaatgtattattggatgtttgtccaacgaatgtaaaatcctctggattcggtcaagccgtccaccgtaagttgagtgcgttgagagttgggagtgtgtgtgatcaactaactagctttgagtgctccagaaattatctttcagttgtgagttgtgacccaaggttttgtgaattgccaaaaagaaagtagtcttaggttttggcaactaccaaagaaatcctcgtcctgggactcccccttagaggcagtttaattattgatgtctctctctatgaacaataggagattgttttaacggcaaacaagattatattgtttcaggactaggggaagcaccattggtggttatatatatagccgtacgcatggagtattacatcatttgcaagttttaaaacgtagaaacggttttttttttgaagggggaaggcgagcgaaatatcataaatttgaggataaataatttttggatcttaatcaaattagccaaatttcattttttttactaattttaaatgaatgaggtttttttttttgtgggnnagnngggttaggggagtggggggggagtattgtgatagatatccaagctgagaatggcaccataataggctcacattgattagtctaataattgtgtagagtttgatggagctccatcctacggagaaaacagagagaaaaggggacaagctagggaggactgtggtagcttggtccttgaggttgtgacccatgtagcgcgaatgcgcgagatcgaagaaggatggggcaatggctgaataagttgataggtggacctgtgcattagtgagagatatgtgaatagtgttggtttgtaaccgaaattttgataatttgatctttaaaaaaacttatttaaaaataaatagtgtcaaaaacttattttaaaaataaaccgtgaacttagggtcatcggaattggcgtagaggtccaatgactcagcaccagccatcatggtgctaaccactacccgctgatgaggctgtgtgcaaggtgcaaaagggtcagtgccatgttccaagtaaggtcttaagtagaggatatgtcctttgcaatcgtcatccccagtgtagcccaatggtaaagctcttcacttggcagggttgtgagttgtgatctaggttctgtctctcggtttgcatatttttatttcttttcccattggtaacagataaagcttaaaaaaagtagtgctcaaagggagaatcgaacctagtaaaccactagtccactgtgatgtattatgggggtcagtncnatnnngnanggnattcccccccttacactttgcacgtggacttgttagcatggtagcggccgattagccccatgctcgctggagctgagcgccattggaccttagcgtcaatcccgatgacgctgaggtcacggtttatatttacaataagtttctgctatggctcattttttatataaatttttaaaaggttaaattatcaaaatttcggggtttgccaagtgacatgaaccacatgaaccgtatgtgtgcatgtctagggttgaagatgattggattggctacaagctagggaacatggtgaggaggatgctggtggccacaacgaggagctcaaaggctttctatagaagggggttgaagatgctggatgctggtggagtggtggccacactagatccattaaaggaaggattgggtgattgggtctaccgtctacgtccactacacgcttaaggacacaaagttgctaccatacttagggcctgtttggt

SEQ ID NO: 23016 - DNA, 915 bp, Oryza sativa
ggaggcggcaggggctatatgatgagcttgcctctgtcggtaagctctctcctgcactcattgtcatacgggagcatctaccttctggaaaagcatgcctaagagttaacattgatgcaacgaaagtggggaatgtggctcgttttatcaatcattcgtgtgatggaggcaacctgcatcctgtcttagttaggagctcaggctcattgctcccaagactctgcttttttgctgctagagatatcatcgaaggagaagagctcaccttcagttatggtgatgctagacttaggccgaatggcttgccgtgcttttgcggtagcttgtgctgttccggcctacttccttcggaagagacataatgccatcatttgtaattgagaatttcctgatgtggtgctgccagaataatattggcatggcatcaggacgagtagacggtacctcagtacctgatgagtgatgactagtgctttcacaaattcagtgtacactatgcatgctgccttggccgttttcatgacccattctgtaacttttatctgacactctgagaaaacgacttgcaagctatgcattctttgctcatagcatagtgtaccgcaagttaccggagggtagagagtcttttggtagggatgttcttaaatcctactagtaaaatgcaattcatgctggcagttgggcatgcatttcccgcttcaggagtcaggaggtgatgaagatgaatcctttgacaaagaagactcctggagagagtggaggactcaacagaaaaacaaccttgtgccgttgcaatcctttatccaaagcacacttccgtttccgctttccctagcgtttgtttcctctgtgcagcaaccgcagcttatgccaatgccaccattgcccatgccccatgttccatttgcacta

SEQ ID NO: 23017 - DNA, 395 bp, Oryza sativa
ccggccttgggggattcgcctacctccggtggtctcccctcctcctcctccaaaccctacttcccctcggatcgccgacgcgcgtgcgggagagaattagggttccgtcgattggggggactgtatatctattgcgagttggatggattacgccgccgcggaggtggagccgtggaggtggtggtaatcctcagatggggggcgactcggttgaataccggggattcctccgacgggaaggcacggagtacgcgtgtgtgtaacactattctttttttcaaaagaataataataattttcataaaacactacatattatatataatgcaaattacgcaaaaccacattaattttagcacgcgacgcataatcctaggtattatcatcctaaagtt

SEQ ID NO: 23018 - DNA, 577 bp, Oryza sativa
ctaactcatgctccaggttctaatgattgaatatcactgcagatcttgatataaacttcttctatttaactgggatgctctattttatttaactaagatagttgttgaacagacgccgtgctaactttagtatttagatgattgcttgaagattgtgttcattatttcgtgagaaatgtacttatgttgcaactatttataagtgccataaatctttaaaatctgttgccccttctgagtaaaacttctgttgcatatttttgttttatttgtaccgaacaagtggggaaatggcgtataattcactgtgaccattcacttcctacttttaccctttttttccatgttagaacagatgcgttgttttacttctgactggtatttactcgattgcagacgacagcatctgaaagtggactttttgatcatttgataaatgtttgggagttcaagcctggtcctgttcctggaacatgtgacctttacttcttggttgattttaagtttcagtcgccactatatcgtcaggtaaaatcatccgttacgatcgtgcacatgaagcgcattcatttaactg

SEQ ID NO: 23019 - DNA, 1170 bp, Oryza sativa
tctttataacaggggaagcttcagactgatctaaaggcaactacaccagaaaataacaaaacatttgcatctattatacaaatcaaccaattaaactgatggcaaccattggcattgctacctcgctttcaggttgtaggtgcgactgaaaaataatcaaaattgtttgcaaagtcttaagttgaacaatctcatctgtcatctctgcatgctgcaaggaaaatgaaacaaaaaacaggattgagaaatcatcagctaatattgtacagaatttgtttcaagaataaaacaacaaaatatcctaatgcaaaaacaaaaggacttagtaattaatcatgttttctaaacatacgtttgttttttttttcaaaaagaaaaacactatcagactcatcaggtcatcaggataactagatgacacaaaatatgtgattcagtttatacatctattaagaccaaataaagaacaaatgaaaatagtgagaggtatatggatacagaagcgatcaaaactcacatccttcaaagtagtcagtatatccttcaatgcagaagaagctacagcatcatgagatataagcttttgcaaacaggatagtcctattacactcagcttcactgatttaacactgcatgccaccagaaacatccgcaatatatcctcattttgagctatttccatcggactagatagagaacggagctgcatgccaaaaagaattcaaatacaagttaggaaacaagtagcatgacggttaaaagaaggaaacaagttaaaaggtactttgtggtctaacataagaaattacagaacttttgttcactatgcatcatctaaattgcaacacaaaattattggcttcacttgagttatggaggagatttgttgataccaaagatttaagaacgtcaacagattagcttcagataggcggaaggacatgcttaatcattatcttgcaaataacaggtatacagttggtaaagaagataaatgatctcagaatacaatcagtcatctggtcaggtcaatcatattagcatttaaagtatctcaaacgtttgagaaaagaaaaacaaagtggaagagaggcaataaacacatcagcgcataccactcaagttcacacctcaatttctagaaaatacatgaaaacaatcttgcttgtg

SEQ ID NO: 23020 - DNA, 686 bp, Oryza sativa
atttaatagtcaagggagtaataataagtttttttttaaaaaaaaacaccattttctatcccaaaatataccgcttcgactacgtaccatttacttaattttgtagttaatttcagaggtattttttattgctttctgttaatttcaggggtatttttattgctttatgtttcttttaacctttgctttcggaccgctcagatagcttttgaaccgcttagatagtcagaatatagtctagttccagcttcattgcttcgcttattcgtagaataagccaaacatcatatttacacacgggatataatttgtgaataaaacttttatatacgtgttcttagcgatctaaaagtaaagactgaaaaataaactttaatgaaaaaacccaaaaccaactccaaatttaaaattgaaaattcaaattctagctgataagcataagcgaaaagatgatacccttcatttattcacctatttcctccgtcctaagaaatagaaaaaagggacaaagcaacgagggcattttggtcaatttctaagtgctagcgacgcaaagcagacgataatgaatattgagcgaggcaaggcaggtgataaactcgaatgtgcaaaaggaatgtcaaacttgacatcaaattgtaggaccaacggccctctgaggagcatcgtgacaatagggagtatcg

SEQ ID NO: 23021 - DNA, 1025 bp, Oryza sativa
agttcaaactctagagcccctctccctcctcttttctgcagtctaccagcttccggtcctctctcctttttttctccttccgtccgtcccctcttttggtaggcatggtcctccttgtatatctcaaggggataccacatacaccatttctacctacccttcttttgggtggggacccatcctactttgaccaaaacttggcttgtaccttcgtctgacaccgggataaccctgtcctccctcattaatgggcggagatttacaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgcgtcagtttagcatgctacacgtatgcccttcttcatacaatgacctccttgcaatggttgcgatgaagcctggaatgtatctggccggggctgacgtgccaactccaggagttcccacgccggctccggctagggacgagtgtctggaggctctcatcattccgacgggacggggcgaggcgtgtgtcaggccgcctgttgccacctaacccgcgatctgaccggtctgtgaccggtcacacactgcgaccgatcacggaccggataagcatgcgctatgctgcattaaatgcggcgtgaggcgctcgtccaacccacaataaacgcggttaggtgagcgccgctgtgctcacctaacccacacacgtggcgccaaaccctcagggggtcggggcgccccagccctcggggggtcaaacgggagcggcccgacccctcggggagatagagggtggggcggcctcatcaccctcgggcccgacccccccgagggggtcaggccacgtgggtgaccgcggctgccccaaacctctagtcaagatatccccggtcccatgtcaccggcacgtaccttttcctttccgaaataatagaggaggagttttgggtccg

SEQ ID NO: 23022 - DNA, 617 bp, Oryza sativa
tcatcaaacgttgatgttgttactatcaatatttttttttgttctaatacaactattgaaactgtgttctcaacgtatgaaactatcttctttttctataagtttgtatatgatctggaatttttatcggaacacattattgatgtttcaattcttaatttactcaatttctgcattactgaggacctccttgaagttctgctgtctgctggaaacttcatatggcttgcgtctaccgacatatcttacgtgcattcatcacataggtgtttgcataaagatttggttggcacaggatcatgctacattgaatatcccatatgtggttgatgaattctttggttttagctttgctaattctgttacgtggaagaagttcaagggcaacaaacattttcttttgtcatgttcttgccatttcaacaattttttcattcagttctttttggtgttataccttgtaaagtcttattggcattttatttgctgtattttgaagtcattgtggtataatctcctctactacatatgctatagcgaccttatgggaaggactatgcttcttcatttcatatttgggttaggaaggctttgtgttgatagtatttttcacggct

SEQ ID NO: 23023 - DNA, 345 bp, Oryza sativa
gtagctccccaaagttcttaccgagattttatttatagaatctgtttgggaagaattaccgaatccgcgttttgttttgtttcctgcgtgctactcagacgtgtaagcaccctaaataaaatcaacgaagttttgggcctctttttagctgattcaatgattcgtgattcaagtccaagccaataggatcagtagccatagacaagcccattagagatgaaacattgaggcggatcaatttatttttcgttacaagatgtgaaagattgtgttcctcctggaccgagaaggcgagaaggtgttgaaaatcgaataaactgcacgaaccgaaccattttatttcca

SEQ ID NO: 23024 - DNA, 683 bp, Oryza sativa
gcagctcataattttaccttctctgattgtttggaaacggtaaattattggtgctgattgttggtgcgttggtgggtgcaggtactcgccggagcagatgttcgctgttgtcgcggcagtagacctctatgaggattttgtgccgtggtgtcagaggtctaggattatcaggcgacacgagaatggctcgtttgatgctgaactcgaaattggattcaagttccttgtcgagagttatgtttctcatgtggagatggagaagccaaaatatatcaaggtgagaacttcatcatggtactatcaccatactttattggttagtacataacataccatggaacacaagcatatctagaataactaaatggttctgaaagcgacaaattaattgttgaagccgcattagttaagttttgtcacatgggtcaccttagtcatgcgtttttcttttgtgttgtaattccttagcacattgcttcacaactatctgctaaaggtttacttcttctaggattacttgtagtctatccaaacatgtaaaaattctgtcgtcgaggacgtgcctttcatttttctttcttcaatgcggctatgtgggccaaatttcttgaaacagtcagatatgatgttacttgtgccgactagtagtgaacacattgaattgcttgcaatgttggctataa

SEQ ID NO: 23025 - DNA, 200 bp, Oryza sativa
cgctatagcggccgctaagttccaatacgctctatgcagtccgctaccttgtagcggtagcggtagagctccgctactgctatagcgggcgctacgaacgctatttattaccttggtggagacacatggtatggggggcagagaatgtggtggggccaggtgcctgcattacgcgcgtggggggcggggcgcgcagggga

SEQ ID NO: 23026 - DNA, 658 bp, Oryza sativa
tgctagcatggcttccagctacaaggatacttctagctttctttggtagaggcaggaattgttgattgggagagttgccgttttttaatagaacaagtgatttcctgacggcttctctagccaaatctctgtgctcctgttaaattagttactcatttacttggatgatttccaaacttgtcaattgtgtagagtaattttcacgaaactacagatactttgatcaaattatcagaaaactacagatttaacttgatacatcacaaaactacagatttaacactaaatttatcacaaaactacaaatttaaggtagaatatcacaaaactacagatttagtaacaaagttatcacaaaactacaggtttaatgataatttaatcacaaaatttaaaacaattataagtccaacataacattagtgctaaggatttaaaccccaaaatttgtagttttgtgataataattttattattaaatctgtagttttgcgatacttagccttaaacttatagttgtgtgataaatttattgttaaatatgtagttctgtgttacatcactttaaatctatggttttgtgataatttaaccaaagtatttgtagttttgtgaaatttactctgtggagtatacagcatgttgtagtattcaacct

SEQ ID NO: 23027 - DNA, 509 bp, Oryza sativa
agtcataaatcaagaacaaattcatgtcccaaacccaaactgacacaaataatattgacccctatgaaaaattccgttcttctgattcgaaactccattacgcgagacgacaggtatctctcctgcaagggcagctctccgtcctggagtctcagctcttcaacctgcgggtggccttggcgagcgcgcaccccgacacgccgccgcagcacttcgtcgtgctgcagccggcgcactccgcggcgtccacgctgaaccaggtggtggtgaactacgacgacctcccgcacgccgtggatttcatggacgcggagcccgccgcgctgaggggactagagtctctccagctctcgcagccactgcagcgggaggaagacgagggccaccgagacatgaacctcttctcggacagtgtaggacaacggcagctgtaaaattacctgtgcaattgcatgattaggtgtctctgtggctagtacattcactcttgagttggaccacattgtgtg

SEQ ID NO: 23028 - DNA, 17162 bp, Oryza sativa
  unsure (1)..(17162): unsure at all n locations
accaataatctgcatattgtccatcggtccatttaaatattagctgaaagaaagcatcctcaattatagtactaattgagccattgatactacagtaaaatgtagtaagatagtactattttagaaaaagaaaaagaaatacatggaggaagatttgctatatggtacagcatatacgtttggtatttctctttcttccccaaaactctgtagtatacgcattcatcaaatcattctctgccgatgtgagagtttaggatgttcttgctgctacgtttctccgaacatgacactgaattgcctttgaatccgacagctggagcattcaatcctttttgtttttcctcgtattccagttccctgaggttgctgatacgaaagaaatttataggattgttaaattgtttggtcccagctagcaaccctggctacctctctgcccaacctggcatttcctagctccctccctggatggctggaagatctctgaatgttttctttctttctcttttttgaagaaaaatactgtaggaaaggatcctacaatgtatacttttaatttggtcaaatttgtttttgcaggatttaattttgtcaagttactacaatccaattggtaatgcattgggttgttctagtaagattcatggctttatactcttggggaaaacacactgcttaattacttggtaatccaattggtaatatatttttttcatatttattttctttagagatgtgtattttctgagttcagtgggggagatactgcttaattacttctcactgtttttatgagacctcaacaacgatactgaatttgtttgtacaacttgtgattacaatttttttacaggaattcaggtttttcatgttattatcacgaagtttacttgtttttttcttttggactgtacttcaatcctgatgagaacagatcgagatcatttgatgactcttctgtggtgtcagcttgattagctggcttttgcaccggtagcagccggcaaaagtaatctaagtacatccttaaatttataactacatggacatcagggcattcaagaattttggcagcctgcctgctggctggaaattaaaactcaagttttcagcttgcaagagtaacaaactggtccaaacaccgtgcatcttttaagtcattgtcgtttgccttttgctctggctatttgatgctgtcttgaaggcatacactacaacactcgtttctaacatcatgtcaacaaaacttatttaaaattgtactgaagtagttttaatggctgatatgttgattcattttcatgtgaagaatacaaacaatttcatccatattgtaattactgcatgaaaacatatcactataaaaagtgatgggaagtcatattactctgtcagtactttttggtacttgcatccaaattgttggccaatcactgcagagcaaatgttgccggacagtaattcagtgtaagttagatcttgaaagtctttaactccaattgtttgaccttaatctattctcatccttcaaccatgggaaactttattatattagagaattcctttcctctgaagtttctctatgattcgtagtacaatgcaaaaaaggcctcgacctttttaccactctcacctaatctaattgttgtgaagaaaaagagagagagagagaagtggcagttgatgatgttagtctctactgtctgggcccagtatgattacaagaatgacatgctaattggtttgttaagctgttatggaagtcggatggtgccttatcctatcttgaggctacctccactatgcacatatataattgtatcaattaatcaatttattaaattaaatgttaaaataaccatatgaaaggaaactcatgattttagaattgataatgtttaacgcattactctcgattgggagaatcgaacccgcgcctcgaaggctcgaacagacaatgtgcaaaagaatgagactagggatttaccaccaatcttcatccttttagcgtgtattaggtgtgtaagtgtggtgtacacatatagtagcttgtgcgcttgcaccttcagcataaccgaaacaaagtaatgtgaagaagactacctgaaacaactaaatgcaaaaattgtgcacttccactatatgtatatgaaattctagaaatttctctctaatgttgtgaactttttacttgtctggtatactgcatcatcgtagatatcagagatacttgactattttctgtgtactcccttcgtttcatatattataaattgctttgactttttgatttttattaaattatagaaaaatataacaagataattatagttttattaagtttagcattgaatatattttgatagttttatttatgttgaaaatattgttatattttttataaatttgatgaaagctaaagaagtttaacttagaaacttataatatgaaacggaggtagtagttgactagtattttctttcttttgataagattttccccattatttaagacccctcttcccacaatcccattgttagattcaatcgagcctgaatctaagccattctctgccccccggcccagagaaccaggtcagtcaaaaccttctctttctcccaaaaaggcaaaaaaaaaaaaaaccctgctgagagagacacactgagcaaaaaaggctatataactaacatgtgcatctaattcaagagtaatccctcttcaaatccaagagtttttttttctccctcttttttctttggcatttcaccccagagatcagaaaaccaaagccaaatcctctcctcatctcctcgcatgcaaccacgtacacctcctcgtctatgatggcttcctcccgcgccgcgctgctcgtcgctgttctcctcctcctgctggtctcctccctctccgtccgagccgaggcggatcaggtggcgcgagcgccggcgctggcgccggacgttgccgcggcgagctgggtacagcagggatcgcaggaagcggcggcgccggggcggcctggaatgggcatgggcaagaacggcgcggcgaggtggaggaggacggcggggcggcgcggccggggaggaggaggaggaggcaccggcgcgtgggcgttctcggcgatgctgccccgtgggttcgtgccgccgtcgggatcgtcggcgtgccacaacgacatgccggccgccgccgccgacgcggagttcttcgtgtgcggcggcggcgacgggagcccgtgatcgtcgacgacgacgacgacgaagacggccgtgttcgttcctgcctgcccggtgctggacttgttcgatcaacaaatgaagatccagttccaagagctcattcaagaataggatgatgagttagttcttgtttcgattcgtcaccttctcggcttctcccctgttcttgaatttgtaaaaaggcggaaaaaaacttttgtcctccgaaaatgagtgcttacactacaatctcttggacattccagctctgtaaactccgatcttctttaactgctctttgctctgaacctgagtgaacttcagaaaggagtttcttttgtttgccattgttcttacgaacatcttctctgttattgtttttgttgttaaaccatctgatctgatactaactcagaacatcatctgaatacgatcatacagatgactctcaagtgttaattcccgctcgttcttgaggccgtctgatcatgtctgaaccggtactaaatcttccggtctgtcactgcatttatcgattcaatctctcttgtccatgtgagcttagcacacacaaatgcacacaacgcaagaaaaagaaaaaaaacagagaggatgctttagtcgtttctttaaaggagaaaaaatatagtgattaatacaggtaatgatccacttgttccagaaacaacaatgactagctggtcctgcattccaccatgggtgagggtgacatcattaagctaagattaagctatgcttaggctgcatgtcaagcagtagtagctctcgcagtttcttggaggcaggagcagatcaagctagcttggtgatgtgatgctttccggcgcccttccgatcttaagcgtgcggattaagggaggccaattgaactaaaccactactaaactggctagccacaatataatcaaatcaattactaacattttcaaggaaaaattaaccaaatcgattatcatggtgagttcccatgaagcggccggccaggtgactgataggaatagtagtagtaatctatctagtgctagataaggggagcatggctagttagctggtgtcgtagcgtctactccatgcagcaaacaacgtcgcgccgctagctccatcttttgcgaggttagagttaacgtacgtacgccccatgtgaatgatgatttgtgggtggattaattaattctttaatagcaatatcacaggtatcagaggtaccatgcagctggtaccataacatgtatcaggtagcaggtactgtctcatagaagggtatccagttccaacgggataccgttgtctaggttttctgattataaattattgtttggtagcaaataagtggtatgacttataatcgttttagatgaacttatgctatctctagccagcagagatatcacaagatataacccataaggccattaacaatgcaagctacacaaactgaatggccttgtgaaaaaagtgtttccacgttggatataactactcaaattgtttccacgttggatataactactcaaacaaactcatcctacaacacatgcatccctagcaatactgacacgaaattttctatttcagcccttacgttttctattacagtcctcccaaataataaatccagaattttataaaagggaccccagctatagatggccataaggtccgcccggcccaggcacgggcgaggcacggcccaaggcgatcgggccggcacggtacggtcagcacttcgggttgtgccgtgccggcccatgggctgcacctcaggcccaggaacagcccaccagtagtcgggccgtgccgtgccggcttgaaggcacaggcggcccatcttgccttttctagaataagtctatttcctctccctcctctttgggctgtgacatatatatagctaaaataagtctatttacaaccctactctttgggccgtgccatataataagtctattttgcctccatattcttcgtgacgtgcattacatatggttgagaaaaagtctgttcgcatccctaaacttcgggcctggccgttccggcccagtgtgctgaggtagcaacccaggcacgacacggctgttgggccgggccggcacgagcacaaccggagtcgggccgtgccatgcctgggccaggccaaaattaccgggcctcgggcgggccatcggtcctcgggccatatggccatctataaccctagcaaccacaaaataatcacaaagggagtaaaacaaccgtcactctccactccccaaccgtcacaagggagtgtgacatcctattctgcctttttttttccatttctatatttttaggatcttgcgttacaaagaagctgtaggattacattatatccctaagcaatttcttattcatgcctcttgaacaacatgtcactttttacattttttttaggtaacataactttttacattggtctctactctctgctaaaagtgggatcaatctaaatctttcatcgttcttttccagtggatcatgtttatttatagcactaagcttaattgctcagtatgtacatacacaaagaactacaggaagttggaacagaggatttgatctcaccaagcttctatagattgactgcatcgacaatatagcaataggaaagggtcttaagcccttatggcatacttatatattatgagagtggttcttaattatagtagtcctttggatgagctaccgtatgcctaaggactaaccaccaggggtggataacgagctagcttggctcgttaagtctcggttcatttgagttcgttatctttaacgagttagcttgtcttggttcggttcgttaaggttaacgagctaaaagcctagccctgctcggaagctagcttgttaatcatcaggcttgtttaagtatttatatcatctttataatttttaatatactactttaccaactaatcgattcattaaacataaatagtttggatggaattaaaggacagatcactagttaattaagaaacactaagtatgtgaacataatgttgatcttttgaactaacgagctaaacgagtagctgtgagttgactcgttaagctcctgagctaaatgcttagcttggcttgacttattaagactacgagttcgagtcgatctgagccgagctcgctacagccgattcaagccacgagatttgagctttttgtccactataactaaccataaggaatacattaaggttatctctctctcccctttgccacccccctcgctttcttgtgtctttacttactgttacttttttatgtcttaataggtctcatgtctaaagtgcatctagagctcaccattatagcaacaaaaataactgaagaccattattatggggcctacccataaggacaatatccatacacattacccttagtgcccttaaattccatataggaaactaagcaatgagttcaaacctcgttttacttttcctttgaaaagcccaaccggcaaccatcttctctctctgtttcctcttatcccacttggaggattaacaaaatccccatgttaaatgatctctgaagaatatatgcataaggagagattatgtgtcgcgagtttcttactagtgataacttgcgactttgtgataacaacgaacctgacgttggaggaaagttttgaattcaacgaattatatcatgtttgtttatggctttatttgagaatcaagatagcttatacggtcgagtacggtactagttgactttagcaaaccgccaaacgtcgtaggtatggtgagcagaatgtcaacgaagcttgcttccgtaggttacatggaagttaaaagggagctaattaattaatcttcaccgccaaacgaaaaaaaagatctaattaattttgttgttattggagaaaaaagaactataatttcacgcaatgtcaaatctgtatgccaatggaccacatttcagatgataaacaacagttaaactaaatgtctgcctgtttcaagcagaaaaaactgcatgaccccatagaactaattcatgccatttgctcttggatcgattcatgatccattttgtagaaatcagaggacgcgcaaagaagactgcagtcggagtgacgctgctaagaagttgtaacaagactctgttagaatctactgtctttcgttaatgaaatgggagagggctagctccctctctttctaaaaagaaaatcttggaaattctataacatattttactggaatctttaatttctcagtgttctttaattacaaagctgtaccaaagtatacttgccaatctagattaaggttcaaatcaagaaatgacatgcaagtggccccatcgtatatgaactaatactaaccatgatatatactcctatatgtgatgtgatgatgatggagatctagttagctagcacagagctagctacaccggtggcagcgcctccgtcggcgacgactcatctgccgccggcgcaggtcggccgccgccgtcccccggcggcggctcgacctccgtccggcagagcgggcacgtggcgtgcgaggccagccacatgtcgatgcactccacgtggtacaggtgcttgcacgccggcagccgccgcaccgcctcgccgccctgcaccgcgccgaggcacaccgagcactcgccgccgccgccgtgcctcgccgaccccgcgtacgcgaactccgggatcttggccgccacgtcagcgacgccacgcagtacgtcgtcctctcgcccgccggcgccgccggcgccctcggcggctacgactggcgcacgcctccggacgtggcggttgcagtagaagacgacgacggcgacgagcgcgacgcccgtgaggccgacgcaggtgtagctgaagatggccgtccctttgccaacggactggttctcctgcggcaccggcggcggcatactcatcgtcgtcgagccggaacgcgaacccatggcgatggcgatggcgatggcaatggcggtgatttgagctttgtccgtggaggaatgagccgcggcatcgggtgatcggggagagataaggactgtggtgttgactaagtggagaacattattttttaaccagcgttgagaattgagattgcacaggtgtgtttgcagtgaacttcctccgttaaaaaaaaaaaaacctgagtttccatgtccaatgtatgactgtccgtcttatatgaattttttataattaatattttcattgttgttagatgataaaacataattaatattttatgcgtgacttatctttttaatttttttcataattttttcaaataagacggacggttaaacgttggatacggaaacccagtgtttgtcttttttaggacggagggagtacctctcctgaatgctgatcagattcagagaatcagagtggtatattatcttcgccccaaaacacttgtcattttgagttttttttaacgtttgactattcatcttatttaaaaggtaatagaattattatttattttgtttgtcaaaatacttttaagtatgacttatcattttctatatttacactaactttttaaataaaaacgaacggttaaacattaaaaaaacaaaacaacatctaatttggaatacagggagtacttatcacggacgagaagcgcttaattactagcgcgaaagtgacgcgttattaataaacttgttttgcaagtaactaatagttctccggtcaaaatagaaataacatattactttgactctatgaaatggttagttagggagggaggactatagcaaaatacacatattactaccgagattgctaatgggtgattgatcgcccctagtgatcagctcgtgccctctcccctccatccacctggtttttttttttggcaccgtattacttttctaatttagtaaatttatgcacagtttgtacacctcaagtttacatatctaaagtttagggacccaaagtttataagtcaaatttatatatccgattcaaatttaaatttgaattcaaatattttttatatatagtattttctatacatctaaagtttatacacctaaagtttatagacacaaagtttataagtcaaaagtttacatacccgttcaaatttgaatttgaattcaaatattagtttatagaccaaaagtttataagtcaaaagtttacatacccgttcaaatttgaatttgaattcaaatattagtttatagacccaaagtttataagtcaaaagtttacatatccgtttcaaatttgaatttgaattcaaatattttttatatatagtatttctatacataattttttccaactttgtttttttatttttttaaatttttatggtgtactatagtaggaagagaagaatgggaggaggaagggggagagaagggagcgtatagggaggggcggacgatcacccgcccattagccttaccctattactaccaacaatatgtgtaccgtgattcatttattgatggttgtttgaccattcatcttattattttaaaacagtgtaattattatttattttgttatgacttataccattaaaggtatttgaaccatgacttatatttctgatatttacaataaattttcatgacttatattttttatatttacacaatttttaattaggacaacacataaaagaaaaactacatgtactactagtagtaaggtaaataagggaatacaaataaataatggtaggaattatttttcttatattctcctatctccatgccttattaagacactctttggtattttctttctattttaggagctacagagataattctaaaaatacaaagattattttagcaattattctaaatacataagcaaatccttccgttggagttgggttgatttcagcctactttcttccccgtccaccgttgagagagaaggaaattggcaaaaatcagtagactgtacactgctacggaaatttatctagacgagactccctttagttagtttgccgatggaccataactacttccacctacaaaatttgatctctagagcacgttttaaggaccgcatacgaaaatcaattttcgcagacgccccccttaacatgcccgcatgcaagacctcttaagaagccacatacaaaaataccccactctttttactcccgttccctctctctcccactaaggcctcgtttagttcccaaattttttttcctaaaaacatcacattgaatctttggacacatgcatggagtattaaatatagattaaaaaaactaattgcacagttagggaggaaatcgtgagacgaatcttctgagcctaattagtccattattagccataagtgctacagtaacccacatgtgctaatgacggattaattaggctcaaaagattcgtcttgcggtttccaggcgagttatgaaattagttttctcatttgtgtctgaaaaccccttccgacttccggtcaaacatccgatgtgatacacaaaaattttcttttcacgaattaaacaggccttaagtctctccactccacttctatgttttttctctcccgtccaccactcctgtcccttctctctctccctttggactccctcgccttcccccccaccccctcctctcctgtctcctcccacttcctctcctctcgacgaggcagcaacgggctcaggctttggcggcggcggtcttgagctcgagcttgggcgtcagtagtgggcaaggatgagagcggcaggctcagggggaggaatcccactaccggcggcgacgggaagggcagaacctgtgcccctccccctcttgcacggatcccgcagcctctctgcccccacgagcgcagatctgccgcggggcgatgacgatgatggtggcggcggcgatggcttctggtttctagggttagagttccgaggctaggtttctattttcagaatttttttttgcgatttttcattttcgtagtcggacggcttaagcgcccacatgagaaaatcagattttcacgtggggttgctctattcccatgcaaaaatatgatttttgcagacacctggtgcatgtggataacacactctcgtgcgaatatcgattttgaccgcatggaaaaaaatgattctgtagtggtggtagacacacataggccgaccagttgtaattttgtctttttttagcaaaatacatcgtattatctaaaagaaaaccatcaatagatgtgtagacttcatgaaaggtttgtacaacagtttcactatatcacaaaccgtagctcgaagttgttaaaaacatttcacattttgagtaaatgatgtaaaaccgtactcgattttcttacaaaaccatatatatactagtactgtctatattggtggcttcacattaaaaaaagtcaaattgtttttataatgtgaactcctaatagagactcgcacaagtacttagaaaaacggaacaaatgatatgagcttaccaagttcctttaaactagcttattaagtcgcgttttcgtgcgactatatataacctatctcgctgttaaatatgtttacatgttatttatggttgtggatttatcttgatttatccttatgtgtgaataagtgtttgtagagcattaacgggattaataatattcatccaaaaagggagtaacaatattatcatatatcaaatatttaccgtaggtacatacaaaattagtatttgaacaataggcttgtagtttgaaacagctaacacatattttgacggaataaaatgatgagtgtaagaatcaaggttagggtttttattggtcttatctgctggtatttctccttcctatctttgcatctataaccgtcttctcttctatgtttcttgagttgtgtccttcccttatatatatcctcctttatatctccgcttatggtacatatatttttgtaaattcatttttgtttgagatgctaaataggtgttcaaagaggaattttagttataaataaatagatatatcttctaataagtaaatcttaccacgaaccaaaatcagagaattttgcttactgtctcatgaaatttcctaaattatgtgcccgcctgccaagaaatggaatgatctagtataagataattacgtagccgcttgccatgctctagtattcattgtaggtttcgaaaaaaggtgccaagcaaaatcacatatgtaaagtgcaatacacaatggagtaaattcaaaatttataaggtccttgatgtaaaaaggtgagtaataatatgggagcatttgctaaagtacttttaattttcaggggagcataggataaaatatactaaagatgaaaatgaaagaaaagttccaagagtcagatgtcacgaacaggtggcattaggacttgagagctagctgtgagctgcacaaccctctttctatctctctccctctctcattttctccgtttgccttgttaccgacgaggtttctctagttctctctgactctctctcattctctagctgctggtctccaatggacgagctaggcccgacggaaggtggacatggaagccaagaagacttcactcatctttcccttgttgtgctcccacagtccctctacgtctcatcgcttcctctcctgttaattgctgtcgtgagccgacaatgtcaatgatgcagcagtgagttagcgacgttgcaggtgaccacttgagcactggcggagcggctggatggtggcggcgatgatagcacaacagtggggactggtcctctctctctctctctctttttttttttgattttactaaacttttccagattcttctttgccccaagattattttcagaccatttatcttatcctatggctatgatatatactttctccctatattatcgttgtttgaatcagacggtcctatattatcgttgtttgaatcagacggtcattattttgttgcttgcgtggctcatcctcgtttcatattgagatttacccgttcatttgtttagttttggtccctatgccctttttccatagaaaaccaagcaatgagctagctcaaacattacttttatttcccttttaaaagccaaatacttctccctttggttctcttttcactcttagcttggagcatcaataaaattcctatgttaattgatcaatagagaagatatctctatctctactacttcaaaaatccatagtggtggtcttgattcctaacagagcagacgcatctgatagacacacgtaatctcaaccatccgaatgccatatccaacagcgtcaatctcctcccccatcacgcgatcgctcatctcctctctcggattgatctcctccccacgccgctgcgtcgcctcctcgccccgccgccgcgtcgcctcctcgccccgccgccgcgtcgcctcctccacgcccgtcggcctcctctccagacccgcgatcgccgccgccctctccaatctcctccgcgcctccacctcgcatcggattgatcctacaccttcgccctcctccctgtgtcgcctcctcacctcgtagccgcatcgcctcatcagcagccacggctgccggcctcctctccagacgctccctcgccgccgccctcgcaaatctcctctgccactacatgataattgagctattgccaccaaattattacaacaaaaaataatacgtagcaatatattatactattacaatgataatttttctgtggcaaataattattttttattgcaacgatctacaatcgttgttttatttagtacttttgttgcaatataaaatgagatatcgccataaaaaatcgtactgttgtaaaaaacatgttctatcgccacaattttaatttttgtggcaatttatatagtacatggtacttttcactattttttgttgccacgatcaacaaattcattgcaataaaaaaattgtcgtctcataatttaacttaattttttcatatggacacggattgagacaaattttatatggaaattatagctctcgacgagatctacaattttgtaggtgataactttttcatttgaaatcttttagatattcaaatctatgattcaaatcttagttagctaggctcaaatggaacgatatgcattttccaacagaattgatgcgtaggtgagttggtaaaggagagcacgcgtgaaggataggtcttaggttcgaatcctagccaagacacaaaatcaaaaaaataagtagataaatagataggatgatagattaatatttgaacttttaatttggtacgtaacactaatgccacatatggagtggtggcaataatttttattacaacgatgtaaagtgttgcaatatgactttttgccacatccattccgtggcaacatctaaatttattaccacaaaataaaaatcattgcaataacctattaccacgctgtctattaacacggctagcaacgattttacaattgtggtaacatgtatgtattgccacaatttaagtattgatgccacgatttttttcgtggcaacaaatgatttttctagtagtgtgcgcgctctcatccctcccttaaccatcaccggccgctctcatctctcgccaggtcgtccaccagcccgcggcgatctctcccgccggcgtcactatcgacgccttcctcgccgatctcctccgcgccctcgccgcccccgatctccgcctgggtgcccgcctccacgcctcccccaatccgcgcctccagatcaccgttgcccggagtctcatctagccgtctgcaatgggcaggcacgatggatcagtgtttggttctttttatggggtatcatcctgcatgtgcagaaaagtaaaggtgaaacacatcaatcctaactgctttttcagtttttagctctccttcgtggatttagtgttctgatagatggaagtgctgtttcagtttttagctctgtatttcatgggtttagggttctaatgagtggaattcctcccgttgccacagaacaagcgagcctagatgatggagaaggagaaccggtttggacaggatcaatccaattactaatgggcgtgcaactactactgcgacagcacagggaagtgtatgcatatgtttaggttttcagattaaaattttgattttacaaatgtttcagtacttcgactcaatgccctgcaaccaatcttgtattcaatccaatttaataatttacccaattgagtttaggatagtttaacaaatcaatcgggagttcaactatgaattgtttcgctgtttcaggtcttcagacttaactgaagtttcaatgtcgccgccagatcaccattgttttcggtgttttaggtctgactaataatttcttttgctgatcagacatggattgatgacctccacataaaaatgcatacaagtctaggctttatgtggagggctccatggatactaataactccaatgctaacatatcttctgaagaatgaggatgatggttttttgaaaggtaaggtatatttctgtctccttagctttccgagatatgctgtatggcacagcgaaaaacatctgattctttccgtcaatatttaattgacaaatatatgaatttcccctatttgttggactaatatgtgtggtgcaatatttacaactgttagataaattcccaggtaacatatgagtgtagctttcataaagctcacttcagattgtttattttcaagatagctgaacgtctgaaccgtcaacttgtctcaagtatgagtctgtagtaggtttcaaatgtgaaggttttactatagactaggaagatctaattcctattttccagtattctgctttgattgctatttgtcttccaatgcaacagaaaagtgcctcaagccacaatgtgttttgtatatatatagctacaactttgatttgagacatcggagagtcatcatagtttgatcatttaccacactttataaatgtaaaatgtaaaagagtaaagtgcacatgcggttcttaaacttgtaggggtgttttatctaagtccctaaactctaaaaatgcagatccaaatctcagaatttgtcaaagtgtgttgcttaggtcccaatttgtcatagcccctctaagatcctatgtggtgttgacgtggtatgccacaaacacggacgtgacatggcatcatcttgactgacaaatgggaccgacttaaaattcattttccttttttcttctttccttctcatttttctctctctttttttctttttttctcctttctctgtgacccgagcaccccgtgcggcggtggcctacagttgtagatagagaaaggagtataaagggaaaaaaagagaagaatgagaatgagaaggagaaggaaaagaaaaagaagaaggaaaaggaaaatttttaagtgagtcctatttatcagtcaatattatgtcacgtcacattcgcgtggcatatgccacatcagcactttatcttcaagtaagaaatggacaatattctttttttttgtctaaatacaaataataactagagtgacaatatacattttggttgttttgtagccctgtccagataatcaggaccacatgaagcgaaatggatggtttaagtcaagctaattttagatatttattattttgtgtatttgataggagcaatacatgtactttatagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23029 - DNA, 685 bp, Oryza sativa
tagtacttagtactaagtaaggctgcggcgctatgactagatgggctatgaactggcaaaattcccattctctgggtttgattccacccttgcgtctgtgtgtcacagccctttttcagcatacatttttcagaatgcaaaaaagttcaccaaaaatatttctgctatactaccattataatagaatgccaccagtaacagggagaacatgcacctcaaggtaattgtaaatcggttccccatcagttgaccaagagcaagaccttccttcacataactagaacaggttaaataaattactgaggcagtcaattgcttttagtcaatgacattacattgatgctgaaagagggatgcactttcttacctgaagtctccaactttaatgccaatgagcttactgttaagagcaaccaacctactagcttgcaccttgaaaaccgtgacctgatcagaagttagagaaccagaaaaatcatgactgcaagaaatgttgaaaacatagccctttctgtttattttcaaaccatagcacccattcttccttgagatgacaacagccaataccaacaacctctcttaatttctttccatataaatcattacctcatgttctttatataacaagtttgttattttaaatatcacccagattgcccatcaaacccatgaaaagaaagtcaga

SEQ ID NO: 23030 - DNA, 4526 bp, Oryza sativa
aaataaaggatttggatttctaaggatgaattcctatggatgtcatttggtttgtacaaatgagatataggaaaattagagaattttttttctttcctactccctttgtctaaaacaaactcaacctaggtgggatgtgaccccatttggtacaacgaatctgaaccgtcctttatccagattagttgtattaggaggggttacatccccacctagtttgagtttttttttactaagggagtacaaattatagagagaacatagaaaattttccatccaatcaaaacttatgaaaaaattcatatgagttaatgtatgcatttattcctattaatttatttttccttttcctacaaactaaaattcctctaaaaccaacaagcccttaagactctagcaccgcatactagttctttcacattatcatttttatttaacaactaaactttaaaggtaatatgtactagatttcttaacgtttttattcataaggccatattcgatttggaggggattggaggggtttaacggagaataattccacaccaggtgtggaataaattccgtccaatctctccctcttgggattaaccgaatatggcctaatgggtatttggttgggttttaatagaccacaccgctttctaacaatgcacaaatagtagaaccaataattcgattgggtaaatgagagaccgataagtcagggaaattaattgtgaggaaataaaaaaaaaagaccaacctagctaattgatgaaactgaaaaagaatatatataatcgatttaaaaagatgctccctgttgatgaaaatgacatggtcgtttaatactccaatatggacttggagaggggcgtacatgaagggacgacgacccactgggtgggaaaaagacggacataattgccgataatttaggagccttcctctaacgtatttccgtgtactagttttctctttagacaagcaagcaatggaagaaaaagaaacaaacaaagaaaagaaagaaagtgacatttaattagaaagggaatatatatttgaggcttgccaacgacccggagatgtcacctttttaattaagataatagaaaattttattgaactcagccaatcacattaagatggttaaaaaacactgaatatatttccgacatctgtataattagaatacacagtcaaaaaaacacacctaaaagtttataagatgaataagacgaatggtcaaacatgtttaaaaaagtcaaggacgtcaaatatttagggaaggagggagtatgttattttcgtcccataaaaatagaaatagatacattagtcctagcagatgttgggatgaggttgacaaaagccaccaagaatgaactggagatgaaaaggagagagatggtggtctttctcatagtctagatgatccatgtttaaatcgtttatgatatgttctcttagtttcaatggtttttttaaaacatgtctacacagcctcaatagtctatagtagtcaagggaattattcaatatataatcctgtgaaaacaaattgtacattattttctttgtgcacatatacatatgaacggtgttaagcactacctataagtacttaacgcagttagatcattgtctttacttaaaatatcacatatctatatatgcttatctctactaccataaaagggagttgtcctccggtttccacctatcccacgttccaaaaataataataaaaaaaactgttccgtctgcacccttttcaagtcccagaaaaccgaaagaaaaaattggaaaagaaaaaaaaaagtcccataacccgttacaatgcgcctccacatcataacttaaagaaagaaaaaacaaagaaaaaaatattttctccatatcccgttgtaacaatgcacaggcatgtgactagctagtcatcctaaatatcccaccggcatcacatcctccaccatatacaaaatccttttctccgtgcagtcaaaatccatttttccgtgcggaggtagcacccgtctacacccaggggtctgaaaaaaatcaatattttcacgtgcggcggcctaaccacatatgttaagtggactgcacgagataatcgactatcccatctagtcaacttataccgcccgcatgcacaaaaaaataaaataaaataaaaacctaaccctaaccctagaatcgctcgccgccgctcccgtcgtcgtcgtcgtcgccgtcgtcgtgccgccacatcacccggccacacccggccgccgccgccgcaaccagctgccagcgcaactcgtcgtcatcacgacgccgccaccgctccccgcagctgccgtcgagcccgcccaccactgccaccgtcgtgccggacgccaccgccaccggatccgcacggatctgggcgggggatggccaccgccaccagatccgggcgagggacagccgccaccgccggatccgggcgtggaccggttgccgtcgcacccgagccgctcgccgttacgaccaaccgctgccgccgctctcaagcccaccactcccggccgccgccaccattgtgccggcagccaccgccgccgtatccgtatggatccgggtagggatggccaccgccgctagatccgggcgggggatggccgctgccgccggattgagtgggggccaattgccgtcgcccctcgcggccactcccgagtcgctcaccgccgccgtctaccaagccgctcgccgtcgcgcccgcccgatcgtcgcctcgtctccagccgccgcatcgcctcgcgcccattcccggccgccacctcgtcggcggcgccgccgagccggccgcgtcccgtggagaggagaggagaggagaagataaagagatggaaaaagagatagagaggagggaagtgagagagagaggggagtgaaaataaaaaagtaaaggaagggagaggaggtgtgaaaattttgaagtgggtgagagggagaggtattttcgcgtgcggtctacttaatatgcccgcacgcaaaaattgatttttccgtacgtttctcttaaggagccgcacgggataatggggatcatccatgcggtcggattaagacgcccgcacgggataatgcattttcccgtgtgggcagcagcccggtgccggtcgaccggtttttccagacaacaccacttacggttcgtctggaatctaccggggccagcgtccaggaaaatattttgtgtaccagtgtacctccctctcaataccacgtatttcttcttctacgaagctatatatttggccacaaaattagaagggaaaagaactagaaaatagaaatgatgtccaataggtatgccaatttttttttgatcaaacccaatcaccttcacaacaaatatacgacactgacccggtgacttgaccgtttaaaaaagccattgtcacacctactttctttctctttctgcatcttacaaatgctcttgcctcttgtaaggatgtaaattaaacgcggttataaacacatgggtaacacgaggtatacatataaacttgtacgctatctagttttttttttcgcccctcccagtgacacactatatatacgaaggaaaggcccgtcgttgtctagctactagttgagttgtgcagccaagtcagctgcacatggggaacaagcgtgcaacagccagtacacgctactacgtactacatgttatcaactctaaccctccgtttataaaatatatgacaatacagacttttaaacactgttttattcagaaatttagtgaaagtatgaaaaatataagccatatttggagtaactttaatgataaaataagtcgcaccaaaattaattatacttacatatttctttcgtcccaaaatatagcaatttatgttggattagatatatcttgtgttaatatagacagtcctaatttaaagacggattcagcgtgggtgctactccgttgaataaccattgagaaaaaggggacagggaaggaggaagaagagggagagaataaagagaagtggggtcttgaggaggaagtcggagataagccttcccctctagtagaattgtggatctgctgatcttggcccaatctaaataggtggctgcttaaatttgtattgctagatgatatattcagtattaagtttatattccctccgtcctagaatattagcatttctaacaataaatttgggcatatatatgtttagatttatagctgaaagttgttatgttttacgatggaggtagtatattttagtatagaggcggtagttttcaaagagacgaaaggtaaaacttcatttataaaggtgaacggtcgtattaaacacagagatagtatagtggcactgtctaattaagtaaaccaccacccactctcgtcgtacgtacgtgtcctcggctatatatacctcctccgtctttctcgcctttcgccaccaccaccaccaactcgatcgattctttccacggtttccatactacacgaatggatcgccacgtcttgcagggcggcggcgccg

SEQ ID NO: 23031 - DNA, 6230 bp, Oryza sativa
  unsure (1)..(6230): unsure at all n locations
gtccagttacggcggcggcggcgccggtggtcatcaggcggatgtggtcgtcgtcgacggggcgttcctgatggagctgctcgacgacacgccggcggcggctgtggcggcggagcagcagccggaaggcgacgacgccgacgaccggctgagccgcgtcatgcggtccctcgaggccgagctcggcggcgccggggctgccccggcgccgacgtcggcgccgccgttggggtcctcctccggcgacggcggctcgccggcgagcggcgacggcggcaggctggatcagctggatgacgtgctgtcgctgtccgacttcgacggtggtggcagcagccggccgggctcgtgctcggcgccgccgttcgagtactgggcgcgggcggagttgccgccggcgatggggcacgacatgggcggcggctggtgcgtcgacggcgacggcgacggcctcgccgccgccgtggcagggtacgagttcgtcagagagccgtgctactacacttacggctacggttacaacgagagctcacatgtcgagcagccgtacagcccactttgggaataattgacaaattaaataaaatttaggaaaagaggcaagaaaaaaaaaagatatgcaatcatggactaaatgagggcagatatatcttcagggtttcttcggatcgtaggaactttagaagaaaattggaggatccaattcctacaggatttaagtattgttcactcaattcggtttggaggaattgggcatgtgaaaattggaagattttttttccttcacctatgatttcataagaatttcataggaaactgaacattcactgggtcctctttttcattttcctttgccaagacaaatcctcaattacattgatgaactgtgcaataattttttactcgctactaaacttcagaggggaaaagataagagagaatgttcagttgcctttttattatttagccattttatatatcttgcaacgatattaggacatgtcaaacatcaggctgtttttacagggaacatatcttggcatgaaaagcaaaagggggaaaatggggagacctaaaaagaagctgctaactgtgcaaaaggagagtgcataggacgtacctgtttctgactttccgctcctctgaaatttatgcatctcagattttacttaatttcaaccaaaacatgcttattgcttgtcactgatgaatggcaggctgccatcaactacgtcttccagaattctgcctatctttcatgtgacgttaatgttcttgcaaaactttggtgttagcccctgttctacatgtaagattcgccatgtttcctctcaaaaagaacaaaaaatatatcgcaaatgttggtcaacttgtagctgtatccctaccaattcttagcttccattgtacaagcttaagcaggcagatcaaactaagttttcaagcatgccatctcagcctgaacaatgaactcagaatttccacaatttgcaaccaaaatggcaacctcactacacagctacaatcttgtgcttatgaaaactttagcagacaccagctttccaacaatccaacgtgcacacagcttttctaccacatctctagtggttttctccacacatgaacagatgtctagtgttgtgtcagctataatctaatgccagccaggtcacagggatatcttccaaatccattacctctcactcattggtataaccgaagacatgacaatggaagaaaaatctacattacgactgaagtactgaactatcattgcaaacagaggatgagaatgcacaattttgttctatccaacaggagcccagcaaagtgattgcgtcaaaagggcatctaaattaagcactaaccgtttaaccgtccttgaacaaggatacgttacaagtgggattaatgccgatctttactagaatataccaccaggtagctacatcgctgatgcgcgggcttgacatgaaaatacccatcgaattggagtgcatttctgagggagagctcgtcagatccacaatgacattgccgtagtggggaggccagtaggcatcttcacatcagaacctagcacacagagaatgatgttagttcccggaaaacatggctcactgaacatcctgctaacaaacaaataaaatctataaataatgttgaacattgatacaatttatgccagaccaaacatatgcaagatcaaaaactcaataaggatagtcgtgatcctggatactgcatagttgcacatgacaaacaaatggatggcatgaacaaaaaatgctgaaactcagtcacaaaatgccagaaccatgcacattatcagcactccagtcatgtgagttttagaacaatttaataacttagcaacaacgaatcaaaacaaaaaattatagcataatcctcgaagttacctctaattggcaggtggcattgtaatgaatgcagcatgccagcatgtggtttcaactcatttaaaatataaaaacgtaatggttttcatgactgaagtttcatcacttgtattgaatgtatcaacatctaaaatccaataaattatttcctctaatgaagtgcatttcaaaacatgaccaaacaaatacaccattagaagtgggactcaggagtcgggacctccgctatttaccattgaaatattttggtacactttaataccatgaaaaggttgctctgttcatattttttaccattatatggtagtcaccatctgccatattcctgtattactagccaaatacatgtgcagtgctacagaacataacaatatacgagggacagcagcaacatgtgggatctctggtgagggtggcaccgaaccaagcagatctgaaccagtttttctgggtagctggtcttttggggaagttggctttttcagttttgtaggggataacaggaggttacgcacatagcgcggtggagtttggagagccaacggccgaaaactcatttagaccttgttcagttattccccgtgagggaggggttggaggggattgagggagattaattccacatctcaatatgtatggaattattcccctccaaatccccctcaatccccttgtgggtgggactaaccaaacaaggccttagagtaatagagatttttgttctttagaccaatgtgccctgtgaaatactacatagcaaaaacatctagatgcatcttggtctatcgatgattgattgacctgcaatggaggcatggatatagtgcaggtgggctaactcatctctgacaggaactggagatagaaccaggttggtaagggaccttgtcccatggagcagaatttgccctcaattttttgcttcattctctgttctagacacccgttaaatctttccatatgtgatgatctagctgtatcagagaactctgagctgtcaaagtgccccggctatggtattccatgatggcaacctagtcgtctaaacatcgcctcaaactaatgcaccgcatttgcttgctcacctgcacaacacccgcctcacatgtgcaggagcctttgccggatagagcacttgctcccctgctgtttcattctgaccatcatcacatggggtcttctaaccctgatttcaaaaggaagggggtgattttgaggaaaggggatgaagctcaggctagaaccaagaaaggtgagtgcggaacggttgggaggctcaagctgacagaactagtaaaaacattaacaggtcagccatttgaaggtattaagtgtaacagaacattgatggtatatggagcaacatcaatgaatttttcatgctatagaaccctttttcacttgagtttgaccacagaagtatgaggaagtcatgtattgtggatttttctcatatttaaataagtagaacaagtacataactacatattactaatgaaaggaaattttgctgcagggcactccaaaattgtgggatttgctacaagacattccaaaattgtgttacttgctgatggactctgcgagcatcattatattatttccacccaagtgaagaaagataaggtttgcagaaagtctattttgcccttggtacatgtattcagtgttctaaaagtttggccctagtcgctaagcgctagatagccgcaccgattagccattagatggctcattaggcagctaaccatccttggaggtccttgtgctgctacttgtttgttctattgtgtaacttttatgcaatatgcttgctaattgcttggaattcactagtcatgttggacctagccaacaccctgtcgaccgtctagtgcacagcgccttcttgaacaatgcatgtataatcatcctctttggacccagattgtgtaaagagagaaagcaaaaaagaattcaggctaaacaagttcgatggagaaaacagaagcagtgaggccattttcgaaagttgctccctgaatcagtcaaatatgttattttaacaggataagtgtccagtatcaaattactacgaaatacaaacttaaagagtgtcttctagttaataagtgaaccatgttttttgatatcttgtggcaagaccacaattttagaatttcctttagcaaattttgccttacggaaaacatcaaaggattctaactatttcagaacgcatgaggtgcatatctgcatgttatttttcaaaaaaaaaaaaaaaaggaaagaagaagaagaagttaactacgcatctaagctcatcactcatgaatgcccaaaaatatgaatggcaatctcctctatcaaatcaaggttgtgtggatgcaaaactggccccaatagtcagttctgatttgaaatactaagttgactaaggtcctttataggaagatagcttactccaaaaaaaaaaaagcaaacaagtataaacaatctcagcatgaaatttatgtatcaactatcaaccatacattggcattttctaaccagactctattgctctttatcacacacagggtaactttgggttttgcgcaaatttaatagggttgtatgaggatgataatgttttagtacataatacatgcatgtacctttatgaatcaacaagataaaaagaaaaatgcaccatgtgtaaatctagcaaggcaataactaattactaatatgatactgggactggttctacaaaagatttgatgctcaaaggcaatttccttttttgttttaagaaaaaaggggaaaagtcttgaactgtgctagattcagtttttcaccttgaactacctagtacgaggtaacctcggcattccaaattaaccccagcctccttcaagaccattacctccttattagtcatcctcgactgttaaaacagggaatacatcaagtggcataactaaataaaaggatgtcataaatacctcgtggaatgagttaatgagttcgtttcattattcaacctagagaaaattccttattttccatctcacgatgcactttccatatttttcattcataatttgttattcccttgtacaccactagttcaacttctctacccttttgtgacatccacatcaccaagccacaagagtaccacccttagagctcagaattttgtaaaaacagcaaactttgcccccacagttcaaagttagagctcgtcaactggtggttcaaggcagtggtggcagatctggaggatgggtatgactggcagctcaaagtttttttttacgagaaacggtaggagagactcctaccgttataatatattaaatatagatatgtacaaagttacatagctaggaagtcagcaggctcttctttgtcagtggcagcagccaatacatcaaaatcatgggagtagaggaagaccaggagatggcacacacaaccatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23032 - DNA, 1508 bp, Oryza sativa
atttcattttaagcacatcgggcataaattctatttgttgtgttaaaaacgaaatagttgactttatggtcttagaacctactacattggagagcaaataaaataaataccatgtcaattttgcttaaaaaaatgagccatatttttcatgatttcagtcacatgttttcaccatatgattgctaacataacactcatgtaagtatttcttgactttcgttttcatcttttttttatttatgtgttattttgcactagcatgtcttaaggaatcaagtactcccttcatcccaaaatataagaagttagtactattaatctggacagccccttatccatattcatagaagtgtcccatctaatactagctagagattattatattttgagacggaaggagttgtaggtaattaattgcccccccccccctccccgtttatagcgagtactaagaaaaagttgcagcataagatttgtaatttgcagtgtataaacatatgaattgacagtgtatgtaagacacatgttaaaataactttaccgcttcgatgaaaattcatctaaataagagagaatctattttatatcacaatgatttgccatgcatcgactttatctccctctataatatgctactgactttatcaattttttctacaatataacattagggtggaaacttttcaagaaatgaataaaatatcctttaagtcatacaagggtattgattgacctacttgaagttttgaataattatgaaagttcttttttacatagacttcttacaaaatatagacatttgtgtgcatttcaagattatgtatattacttagtagtattttaatacatgcaaaataaaattttaaaatatacacatgcttttatattatgtaagaaggctatataatttttttttatattttttaagacttatagcaggtcaaccaatagtcaactcttgtaagtcttgaagagcattttaggttttttttaaagagggagactacagaacggtatatcgttccaacggaacagttgttgtcagcatgacatcagcagataccatgtatgtactagatatgacaccctgtaggtatcagatctagtatcaagataccatgctgacgtcagtatgatatcgtaggtatcagatcaggtacctttgataccagacatgataccctgtaggtatcagatctggtatctaggttctatgctaacatcgtcatggtatttctaagaccagatatgatgccttgtaggtattagatcagatatcacatcagctattccattgcaacggtatatcattatgtagtatttctattttcaaaggtatccatctcaatagcatattataaaataattgataaactcagtggcatattataaagggaaacaagatagatggtaaatcgttgatctaaagtaaactcagtctcatgcaataaattctctctcagaaaagaaactggtgtacatgtagccagggctagctaggggagatg

SEQ ID NO: 23033 - DNA, 6410 bp, Oryza sativa
gtgtatgtgtgtgtatgcgtctgactgcagaaataatggctggaaaaggctcgatcaagggaatgaaaaggaaatgcaaaggtcaggaccgatgggaccgccactatccacacgagaattaagtttgcaaatattaatcttgcttgcgttgtttgagaaacacaatcatgcatgttcctcgcggaaataaaagtaaagttaagtagataagggttaatcagtgacgggggctcataattttgtataagaaaataagagcaaaataagagcaacaacttgctgcagaagaacattaaaggaaagtcgtaaccccgatggtttttacacctttcagctgtaagctcaaagccgacatggatcctaattgtggactgtatgtttttttttttgctttgtagaagcatcactataacgtaaattagtgaacaaacaccaaatatagaatataattatataaaataagataaccatgatcttctccactggtgagtggtgactgacagcaagcggtgtagtaagaaaaatactgcataaagaaagggatatgaaatatccataatatgcatcaaatggacgctaagtgatcgatcttatacctcccggtccaaaacgtttcaaagtttgagttaggggaagccatgggccacccatcttattgttagcgacagatcaactaaaatctttcccaagttttgaccgaggttaaaaactaaatggttctgatagttcagattaaatagtatttgattttgaaagttatttgtttttcattcttcacaacgattcgaggttgcacaatggtcctttacttttattaatttctagggaccagggttattcacgtcattccaatttatgtacttggtcataaaacaacatatatattctttcataaatgaaccttgcaaaaaaaaaattggagaaaatattgtgcttttattggttaaataaactatttacaccaactttttcatccacacctctcttgtttcaaggaccgaaaaatcaaacaaaaaaatgaataagttactcttaatttgcaccgggtaaaaacacactgtttcactttacactaggtttagaacatactttcgttttacaccaggttgttttaaaataagtttcacctagcagtaggatacatcaccaaaaacctatagaaatttcatcaaattttataaaatacgaatggaactttgtaaatcatggtctaaattcaaaacatttcataagtttcacctgtagtttataacattttcctttaactatatgactcaatctagtaaatgtcaaacttattttgatataacatggtagaaagtgaaaatttacagtaaagccagtttgaaacaagatacattctacccagtacaaacttcaatttacttaataaaaaattcagctacacaaaaatgtcggtttgatttcgctataacgttagtgtttgactatataattcagtgcgccattgtaagtaacaacgtcttatagtccgatacatttggttggctcagctcgctatccagttattagctacgagcaaaccttgggggactctagagctacacttctgagctttaaaagtctaccaactgaagcaacaaatcaaggtggcatatctacctgatgcgtgagtcgtggatcgattgttcatatattttaagttgtgctcccctacgttaaataatatccaatgtcgggactaactaaaccccaaaaggtggagatcacaaatatgattcacacgggcagaacttgaactttttggtcaatatcaagtacgtactatggcatctaataattgaagaacccaaaaggaagaaaaaaaaaactacctcaattattggcatttcagtacagcgctagtgatgcatgtacacccatccaaggacaagaaaatatgcttggaaagctaggaaatctagcttgacacggatggacatccacttggcaggtgcatgcatgtgtggtaaacgactcaacactcagaggtggcctgtggccacccattttgcgtttgccattgtcctcctctgcatataccacagtgggagaaaattccacggataagacccccaatttggatgcattgctacttcctaagcttgctatcataaacatgctttgctgccatgtgctccatacctcctatagtgcgtgtggatcagaggatggtgcaacttgtatgtgtatctagatgatgtctatgtatgtgtagtactatttggtcagaacatgtctagcctcacaaactgccactactagaaaaataaattttaccaacacgaggacttttatttttccagacgaattaaaaaaataccgtttgcaaaaatagctagaaaccccctagatctagtcccgcctacgacaatcgaatttttctagacagagccttaagcactctgcctgtaaaaataattttggaaaaattttattatcgcaggagggaccttaagtggtctagcggcaaaatatggagatacgtagtagctattaaatccgctaagtcccaagacctccacctctttcccccactccctcttcctcagcctctctcctctcctacagtagaagtcagcatcagagaggggaggacagtggtggaaaagggtgcggcggttcagccctcccctcacccccaacctctccctcccaaatcccaccggagggaggagtgcagtggcggtggcggaagagggtgtggtggagcggccctccctcctcgcccctccctctctccctcctagatcctgtcggctggggagtgcggcggcggtggcggaagagggtgcggcggtgcggcccttccactttctcccggccagatcccgccgggaagtgcagcggcggaagaggttgcggcggcgtggccctccctctccctctcggccagatcctagtgcagcgacgcagccctcccctccctatttcttccactccctcccatcctctccctcccagatctggccagaggggggaagtaggcggcggcgacaaaagagagtgcgaaggcacggccttctcctccccttcctcttcctctcagatccaaccggaggggggaggccggcggtggcaactgcaccagtagagggcagcagggagaaggtaggcagtggcggagctgtgacgacaactccttcattggcaccacactgcgatgacaatgattatgtttctgtttgttgtttccatgttgattgatgttaacctacaagtcggtgttgtgaatttgaatccggtgctcttgtgttgatgtatggatgtttgtgattggaatttgttggatggatgaaaattttgtgagaattgtgatttgttatggtagcaaggggtgtgaaagcgggggggtctggtagggattttttttttttttgctccgagattattttcgtgggcatgcggctatagcgactgggaagatggagaggccgcctgtggcacttggtccacctactaaaagttgatgattttcatagtcctttaggtataggcggaagatttggccacttacggaaacatgttttggtcccctggaaaaaccacttctcaagttttatatttatatataatatataggggtgtgctaaaacgcaccctaggtagtaaatgttttactacgagttatatgttagacttagtacagggatttgtgatggcttcacttagtaaaaaatgcacactgaaagtgcaatcatcacaaatccctatattaagtctaacggtaaaatatttactgtccagtattagagaacatataacgcgtagtaaatcatttactatgtgggaagtgcgttttagttattacgcacccagggttcgttatattttacaccttttagtttgttaatttctcgctttattagaggctggagacctttgaaattagagagagaaaatttccatgtggatctcttggatagcaacacatcaagggcaatgtgcagggtgtctggatgactatatcttgttggaattgctaaatggcatttgacaaaaaaatcaagtgggtttcttacagattttgaaccacctaatttgctcgaagatttttgtatgcccaactcctcctcgatctagttccggggactagcagtgacccaatgagttacgggtcagggttttggattggggtggccgtgggatgggggtaacagccaacattggcaagcagggcaaagcaaagcgtgtggttatgaggcagcggtcatgagcaatggggagccgctggagacggggaagatggtggtgcaagggcacctagctgccggcggatagaggagaacaagaggggggagggggaaagccagccaggatgggccttactggtgaggctagacagtggcgcattggggcggtggtagcggaggagacagggttgaggcgtcgaggtcgctggcgttggtgcggggcgggtagagggaagaagcggaggagggggttagggtttttgggatgtgctcaaatttcaaagggatctaacgatctaaaaatcacaatatattaggaggcttctatcaaattgataatagatggtctcatttcttattgctagcaaccccgctataaggttctgtaggaggacaaaggcattattgtggtcacatataccatgcacacaatgtgcacatcgcaatatgtaaaaaatggctgtgcattgataaaaaaaaagaagatattatattctcggatttagggatatttgtgagcatcaggatttgaagagaatcatacattgcaatatatccatgactctaccattccataagaaatgaatcctccttgcttaccatctgtattacttagaaacaatttataaacatagatgtattgaatattctagccgaagttacaaaataaaagggccctgacagatagctctagtcactagctaccagaaactcaactagccctgacagcccaaacagtcagcaaaatgcataatcacgtcaggaaaatacatcctgatatggcactgttaggaaaattccgtcagaactgacttgtcggaatttttttaattttcctgatgtcgttacttattataaaaaaatatctttttgtcacctaaagagcttaagaaatatattcatgatatatgatgtgatggtcgatttagcacatatataaaaaatatcaaatatatagggttttttagatacaaattagttatagtagtaattttgttacgcatctgaagacacttcttccttttcataaaagaagaaaataattcattaggtaatgtactagtgaaggtatatatgccaggatttagcttgcataggtacgtgtatgatattttactcaatctgtaaatctctattttacaatcaatatgcaacaaataaattaatcattagtataattttactgaactttatttgaatttataatttcattttaagtgatgaaaattttgcatgagttagtcactccagctgaatgttgggaagtacaaagcaagcagttaaacatatcaatgagtgtgtctacattttaggcgacttaaattttaaattatctctgccacttttctcattccttaataacaatccaacagttctcatcacttcctgtaaagttcctcatttcttagatataaggttggatgataaattattctaacttaaatatgtaaacatagaataaacttacaattagtaaaagtttacaacattgcatggaaattattcaaacttggatagacaataaagcaagtctttctttcgtttccatcccatcctcgtgtcagaaaaaaccgcttagtttccaccccatcccacatcaaataaaacgctcaataaaccgaaagaagaaatatgagagagaaaattgaaccatgtttcccatatttaattgcaacccacgggtatatgtgagtcacgtaataacaaaattgaacttaactgagctaaagttatgcattacatacaactgaaattttaagattgacagatacaattctatatgactcaaaactatacaaactttaatttttggcgtgtcaaatctagccaacagcaacaaatagtcacaatttaggtacataggctattgttggttgatatatacattgtatggccactaatatgtcacgatgtaatgataaacacgagacaataaaatattggtaaagatgggtgttagggatgggtctggatggttattaattggatgtgacaatatttctttcatatagttttaaatttagggcctgtttacatcacctggcaagttttttcacactgttacatcaaatgtttggacacatatatgaagtattaaatatagaaaaaaaaactaattctacatattgcgtgtaaattgcaagacgaatcttttaagcctgattgctacatgatttgataatgtggtgctatagtaaatatttactaatgacagat

SEQ ID NO: 23034 - DNA, 583 bp, Oryza sativa
atcggatcctgttaactagcacagttccttttcccctcaactatcaactgctccgcagaaacattttaacttactttttttaaaccaatctttctattggcaatgtagatctataatgaagggtctataatctattgtaagtttttttttcccagcagaaggagaagaagccactaccagtaaaaccatcagacatgaaaagaacgagaagggatcgcagggaactggaaaatatcttattcaagctttttgagaggcagccgaattggtctcttaagaatctcatgcaagaaactgatcaaccagaggtattttttctcaagttatcctaattatgccgagggtggagcatttgttaagaaattgctagcaccaactctagttattgcatgtcctgatatcaaagcctcaactctcccggcttgtttctgtgcagcaattcttgaacgagatcttgaatgatctgtgtttctacaacaaaaggggtccaaatcaagggacgcatgaacttaatcctgaatacaagaaatctacagaggacgctgatgctactgctacttagaagtcttatgcttcggtctac

SEQ ID NO: 23035 - DNA, 238 bp, Oryza sativa
aataacttctacagcagccactggtgaccaagctcttttatattgagtttacccaaaaaaaaattgatggacaaaacccaaaaaacttttaaaacatctgcttttccaagcaaccatgtgaaggtacaaatacatgactaattcctgtgtacattgtttttcttcacagtcctctctaaccagaccattcaacttacatttcttgttcaagcgtcaactcgatcactactctaacctt

SEQ ID NO: 23036 - DNA, 724 bp, Oryza sativa
tcctatatgaaggaaggttccaccgaaaaatccaaggaacaaagaaatgcgggggattttttttttatttttttccgcacggaagatggcactcaccggagggagggggaggcggcggcagcgggagggaggagaggtggtcgaaggcggccttggcggcgatgttgtgcgcctccttggccgaccgcgcggcgtcttccggcgtgcggaactccacgccgttgacggagacggtggcgccgaagagcggggcgtgggcggggcccgcgcaccggtgggtgtactccggcggcgcccaccgccgctgctggcacagctcctgcagccgcgacttgtacatcctcgcggtcgcggcgatcaaatcgagagctctcccgtacgaatttttgattggatggggtttgggttcggtggcgttcctctcgcctcgatccccctccctttttagccttcacgacggagtagtgcctttctttggtcccctgcactggacttggactgagcccacgagatctcatctattaaaacttccagtactttgatagtgtgggagccgaatcctctgcatttagttgtagcttctgcagaggaacctatattatgcacataagttttctcgtatacataggaggtgttctctcaaaaatataaaaatataagtccctcttctagggatttatggttttgtgtgtctctcccaaacacccccatattatgcacatca

SEQ ID NO: 23037 - DNA, 705 bp, Oryza sativa
ttattggcagggggaccttttaacttactcaccaggccacacagcaaatttgcaagtgcacaaagatcccaaaggatggcataatataggttcatttgcaaaagcagcatttagcaaaacttttaaaagaagtaaaaacagtggagtgattaatcagaaattttaatcaacactgaacagcacacccatgctgcacaggcccaaccatcctgaacaaccatacccggctgtacagattaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccccagcgactcccgtgggcttatctccgccacttctcagtctggtgctctgcaatgaaccatgctatacgaaaggtaaagccgttgcccacgctggcttgtggttggcacggttaatgtttcacaataatacctcgcgaacccgtcctt

SEQ ID NO: 23038 - DNA, 731 bp, Oryza sativa
caaggaagtcatctcaatcgggccgaaaagtgcccgactgatatatggtcgcacagacatgttagatgggtataaaacttaagcccgtcacggatgatacccatcagtgacgggccacaactttaggcccgtttgagatatggaatgttatctcaatcgggcctaaagttgtggcccgtcactgataggtatcatccgtgacgggcttaagttttatacccatctaacatgtctgtgcgaccatatctcaatcgggcacttttcggcccgattgagatgacttccttgtgacggcccgctatttctaagcatattagagcccgtcacagatagaaggatctgtactagtgtggcaaggacgagcagtcgagtagaatggccttgttccagcctgccctgcgctggcgaggttgcaaacctttaatgttattactacggtcgtcgccttcatctgaattacgcagaaccgccgatgcatcgtcccttctaaccgccgcctcgtcaagtgcctcctaatcgactgatttagtctcgtttgtccaacaaattttacctattaaatgacatgcaatttgtttcctaatttacttctccaccgcggtggtttcccctctcaggcatgggggaggtggagttttcgccggcggtggggagtggcggcggcgagggatcccagctagacgccgtcgccggatctagacggtgcgtcggtggcggtgtcgtggggcggc

SEQ ID NO: 23039 - DNA, 3292 bp, Oryza sativa
ttcctttttatcaaattgtccttcgttaacaccactccacggtgcaagtaccaaagaaaaatcttaacttttaggggtatctttaatttccaaagatggttattaatgttgggaacaatgctgtgaattagagctagataatgagacttcactgagaactccccatttgaggttaagttccaatgaaactcatcttgctcctgagttaaatgaaaaccagtgatgcacggtaataaattattccacgccgctagtttgatcctataaggtctcttcgccatgaaaaagatggaggattgttttcgaagacttgtgcaactgtagcgtgcttatgcctaactatgttgtaaaggcaaggatactgttctttcaaggttgaattgcccaaccatttgtcttcccaaaacctaatttgggagccatctttaattataaaggatccaaaacggtgaaagtcccgtttcaccttcatgaggctagaccaaaagtgtgacccctgccttccattgagcttgagaaagaggtttatcaccaagatacttattacgcatcaactgttgccaaaccccttccgtggagagcaacttgaataaccacttactaagtagagccatattcttaatttccaaatcatgaattcctaatcccccttgttccttgggacggcacagtatgttccatttagcaagacaatacttttttttttaccatcactttgccagtaaaacctggagcgaaagtagtcaagctttgtaagtatccctcttggtatggcaaagaaggacatcatatacaacgggaagctacttagcaccgaattaatcaatgttagccgtcctccagtagataggagttttcctttccaactgcttagatgcttttcaaagcgttctacaacctccttccaatcggcatttcttaatctcctataatgaatagggatacccaaataccgaatggaaattgaccagtggaacaaccaaagagttccatgtattcgttttcaaaatctttcgcttcaccaaagcaatataattcacttttatggaaatttatcttaagacccgataattgctcaaagacaaaaagcaacaacttcatgttacgagctttttctaggtcatgatccataaagagaaccatatcatcggcatattgcaaggtagagagaccatcattaattagatgtggtactactcctgcaatttgaccatcctctttggctctattaatccgtacagtcaacatgtcagctataatattaaataatataggtgataagggatcaccttgacgtacccccttctttgtctgaaaaaaatatccaacttcgtcattaacctttaccgctatgcttcatccagaaatgaaagactcaacccaagagatccacttaggcgagaaacctttcatatgtagagtttgtaagaggaaaggccatttgactttatcataggctttttcgaaatctactttaaaaatttccccatttagttttttacgatgtaattcgtgtacagtttcatgaaggatgacaactccctctaggatattccgtcctctcgtaaaggttgtttgagaagagctcaccacatggtctgccacgaattaattctatttgttgcgaccttggtgaaaattttgaaactgacattcaaaagacatattggcctgtactgttgtatacggtttgcctcatgaacttttggaagaagtgtaattatcccaaaattgagactaaacaatggtaaatcacccacatggaaatcccgaaatagattcatcaaatcatctttgatggcctcccaaaaattctggtagaactccgccgggaaaccatctggaccaggggctttgttgtgttccatttcaaacacagctccctggatctcatcctccgagaaaggtgccgttaggaattcattttcctcattcgttacctgcagaatatcctcaattctatattcatctagtgtgatggaagtatcctcaggtggcccaaaaagattttaatagaatttagtaatataggacttcaatgctatattaccttctaatttcccttcgtcctgatcgaggcaaaaaatacgttttttccttttcttaccattggcaaccatatggtaatacttggtgttgttgtcccctcgtaggaggtcagtaacttttgccctttggtaccatttgatttctttttctcgaagaagtctagataactgatctctagattaagcaagatgctctctctcactatcagttaattcccgtacctcggctgtgatgtctaactcatcaatgatattttgtacggtatttttttcttgtttgtaagaaccactggtgtgagccgcccaaccttgaagatgtcttctcaaagcactcatcttattgttccatctttgaacagggttgtggcccttaactggcttatttcagatttccacaacacggtcacgaaaatcatcccgaaggaaccagccaagttcaagtttgaactgtgcacggttccccgaaaaagctgctgatccagtgtctagtagcaatggtgtgtggtctgatagacctctgtctaagcttggacagaaaccaaaggatatttggattcccattccgtagtcatttcttaagagaaatggcaatattttctattagtttttttcctctttctttttaatacaaaacgaatggcgaggaaggggatgaaaaataataaatttacctagatggataatctgttatctaacaggtccaattactttcttatttttgtaacttgtttcctatgtattcagcacaataggatgccattcaggacaaaaccttgatgtacgtacttagccagggacattatttgtatggggaaaaagtacgaattaccctcccgaactatcgcggtcgtccgaattatacccttaaaccaaaaaaccggacattcttcacccccaactatgcaaactggacgaattacctccctcgacccaatccatagtggttttggtctacgtggcgtacacgtggcagtccagtcagcaatttatttattaaaaaataggtgggccccacctgtcgtactcctattgcacttttcctctctcttctcttctctcactcttcctctctctctcttctctcactttgtctcacaaatcacgcccacaacggcaagcggggggggcggcgagcggcggcgaggcgaggcggtggcggcggaggaggcgagcagcgggggatgaggcggcggcggcgacagaggcgaggcgagggctcgcgctgctcgagcgaggcgaggcgg

SEQ ID NO: 23040 - DNA, 4310 bp, Oryza sativa
  unsure (1)..(4310): unsure at all n locations
gccgccgccgctgccccagcccgcctgggatgccgccgccgcttcccccggctgtcctggacgccgccgtccgattccccctcctcgtctcacgccgcgcgccgccgtgcatcctccgccacgagagagactgagagagattaggaagagagatagaggaagagagatagagggggtatgatatgtgggtcccaccatttaaaaaaataaaatgctgactggactgcaacgtgtacgccacgtagaccaaaatcaccgcggattaggtcgaggggggtaattcgtccggtttgcatagttggaggtgaagaatatccggttttgtggtttaggggggtaattcagacgaccgcggatagttcggaggtaattcgtactttttcctttgtatggtgttgatacttcagggacgaattctgtgcgttactggaattggagacaaaaaattaaacaacttgcagagttgatagaacaaatatagacttcttcctaagatatttttttgttgttttgtcaatcagtcaactaaataagtacaggcctttcaaaccttggtttacacccaaaattcgtaaaaatgcggcccatatttgcaaatgaaaaataatttgtgataaaacttttatatatgtgttcttagcgatctaaaaacaaaggctgataaataaacttcgatgaaaaaaaacaaaaatcaactccaaatttaatgctgaaaacttaaattttagctgataagtataagtataagataagcgtaaaaataagaccgatggcatcgtcatgagttaaccacgcggatcatttagattctgttgtgccatggtgatgaattctgcattagtattacatgtattggaaaataacttcggtggggcctctttagttcaaccaatataaactagagtacatggctattaacttttgaatatggtgttggaccctttgtatttttttttcaaaacgttaatgtaaatatgcaaaatgtaagtcatcattaaaatacctttagagatgtgttacaagtcgcaccaaaataaatgatacttctatttttttaataagacaaactatcaaatgttatattcaaaagtcagtagctcaatttaaaggcggatatattgttatattgcacacgcttgatgcatgcttgtgtccaaattaattatgaacaaattgaaaaatatccttaattagaaccaaattccaatgtactagttgcttgtgccgtcacataactgtataccagcatgtgtcaacttaaatgtgtatccgcataggcatgacataaacaacgaaagagacctggtggcatgtgcttgtgggctgaggaaggagagtaactgctaaatgcagatttgtagggacccaacaaataaatcggaaagaaattttcatgcaagtaaagaagaaccgagatttgtacgcaagtaaatcatactggaacttccatccaaaattcataaaaatggtgtcatggtgagttaaagatgtggattatttaggttctgttgtggcatggcgatgaattttacattagtgttacttgtatgagaattgctttggtggtcgcctcctttatagtttaaatgatatacactctttttttttcagaaaaagtgtaaatatgaaaaaacttttgaatacgacatttgatcatttttcttttttcaaaaaaagtgtaaatatgaaaaaacattagcaatgattaaaatatttttaataataaagaaaggtcaaaaaataaataatacttacataatttatatttttgattaagatgaataatcgaatgttactttcaaaagcccataccgttgtttattgatggaggtagtacgatcttgcatattcttgatgtactagtttatgtaagatcaatgtgtgttttgattcttattctgtgatgaataattggcatctgtgattattggttttgatatttggagattattgtcgaagtggttttggagatgattgattttcaggtaatgaacagggttgctgttttgtcgggtccggtcagaccgggcaggtgttgctggtcagaccggcgctatgtgagtggtcagaccggccagcccgcggtctgaccggccgacgctgtgtcggttttggtttcgggttgtttctttggatatccgtgattgtttcatgtttatggcttctagatggatactatacgtatatgatactgttgtttgctaacaatgagtcaagttggggatagcttggtctcgaaatatggtttctttgtttattgcatgtgtagttgactcgatgcctcgggagagtatttgcagtgatggatcgggagtcggcttggtggtaagacgatgtccgtggtggtcagatatcatgcgggatacttaggttagagttgatgcacgtggttggtgaagattccatatggcatacgatggaggtattgtgtgcgtatgggatgcgaagtcgaatttggaaggagtccaaatttggtatgattggttatgtaaaatttgtttcttgcactaggaggtttcctatggggattaggacttctagaatgagtttggttcgtggctttaggctgtctatctcatgtataaatagagagggagcatgaggcttcccggtatcgctttgagaacaattgtgttgatagtttagttaggctttcgagtttagtcaagatttttgtaagaagtgctattggtgcactttgtaaacacagagagaagtaataaagttgtcatctactttgagagtttttcgatttgtgttttctcaggtgcggcggtccaaccggcgagttaccactggtcagaccgatggcatcggtccggtcagactggcgggcatacggcggtcagaccgcggcggcatcaggaggctgaggagactttggggcggtcggaccgggcaatctacatcggtcaaaccggcggcacaggcacggtcagaccgacgggactactccggtcagactgatctacatcgaaattgaggggaacttttatttccgctaaaagttttggtttttgagtacaccaaccatttaccccccccctcaggttggcttagttcctgtgtttcgatcctacaagtggtatcagagccacgtttgctcttcttgatctttaccgatcttgagtttttgccatggctcttaagtttgcaattaagcctgatgttttcgatggaacggattttccttattagtgtagtaagatgcaatcttatattcaacctgagtatcttgatatttggagaaaagtttctaatccttatgtgattcctgaacaaattaatactgctgttttaaaacttgaatttgaacaaaattgcaaagctcgcaatattcttttaagtgggatttctcgttcggattttgatcgtgtctctcatcttgaaactgctcatgagatttggaaagctttgaaaaactttcatcaaggaacaaataatattaaagaactttgtcgtgatcttttcaaaaaggagtacattaaatttgagatgaaacctggagaagctttggatgactatctttctaggtttaacaaaattttgagtgatcttagatctgttgattcttcttatgatgcaaattattcacaatctgaggtttctcgtcactttttgaatggtcttgatatgtctatttggtagatgaaagttacatcaattcaggagtctgttgatatgtctactttgactttggattcgctttacacaaaactcaaaactcatgagatgaatattcttgctcgtaaagttgattctaggtctagtgctttggtttcttcttcgacttctttgaatgttggtgcttcttcatcatcttcttctgtacttgctttatttaatgccatgtccgatgagcaactcgaacagtttgaggaggaggacttggctttgttatctaacaaagtttctcgagctattaacaaagtttctcgagctatgaacaatgtcaggaacagaaaaagaggaggtcctaatcgttgttttgagtgtggtgcacttgatcatcttcgttcacattgtcctaagcttgggagaggcaagaaggaagaaaatagtagagtaaaagaggttgaagtggacaagaagaagaacacgaaggagaagaagaagaattgcatgcagtggttaatccaagaactcatagcagcttttgatgaatcagaagatgaagacgagagcaaaggtaagcaagttgttgatctagcttttattgctcgtaatgcaagttctggtgttcatgaatctgacagtgatagtgaagaannnnnnnnnnnnnnnnnnnnnnnnnnnnnnnnnnnnnnnnn

SEQ ID NO: 23041 - DNA, 1042 bp, Oryza sativa
ttctttgtgttctttgatgaccctttcaccttctgaaggtctcatactctcgtgtcaccatacaggtcctcactattgatggaggaatggtaatgtaaaaaggcttgagcggtcactggcaatcttcccggcagctgtagtagtaaaatcatcatgtaatgaacatcttttttgtgaagtattatttactgttgagatacccttacctataagagacttgtttcttgtgtagtttataatggtattggaatagctctaactctgttcgtctttgattcgagatcaattgtagagcacatagaaattttggacattggtttcctttttgcgaacaataatgatgtataatgatctcctagtttatcttcgcgttcgataataaacggattatatgatctgccatgctcgtaccatagtagcatcctgctaccatttctcctttcatctgactatttgaaccctgcaagctgttccaaactgatagtttgtttaaccgctctacaaatttcataacgacaaccaccatgcaaaagcaccacattcagttcagcacaccacataattcgtattaaccaagttaaccgaagacgacgatatgagattagatatatcaatgttagcatgcaagtactcaaacccccgtcacattgtacttgaccacaaggcatgtccatacatgataacatcaaaattcaaggaactcgagggcagataaattgactgagtgatgtgctaaacataacattctctcatgttccctgacctacgccttgatggcatacttcctcatggggaaatacttctcgcgcttcttttccctctccgtcttcagcgaaagctgtgatatggcaaccatggaaaatgtcagaagacggatgcaagtataacataactagattcattacaagacactagaaaattgaacataagtttaggatgacaaatgacttcatgtttctataagaattgaaaaaggtgagccttcatttttcaaagaatgcagcaaacaagtcctttatctacccttctctcttaatatctt

SEQ ID NO: 23042 - DNA, 8549 bp, Oryza sativa
ctgcagcccgttatctactgcaatggtagtaagtacacatttcatgcaaaaaaaacaaaacagcccaagttaagctaaaagtttgaaggaagatgacaccatgtgaatctctatcagcatgagttttagatatcagtagtaggtgtgcacggttttatgaaatcttatacctggtgcttggtgaggcggcggcggatggcgcgggtcttcttggggcggaggtcgagggggaggaggctcttcttcttgtacgcctcacgcagcgccgccctctgcttctgcgagatcaccgtcagcacccgcgcgatcgacgtgcgcaccaccttgctgcaaaaccacagagattcaatcaatcacaagggcacacagaaagaggagagaatgagcgcgagcgcgagcgcgaagcgcgtacatcttggagagcttgttgggggcgccgccggtgaccttggcgacgcggaggagggagagctccgccttgaggtccttgagctgggcctgcagctccgccttgttcttcccccgtagctcgtcgaccttgatccgggctgcaccacacacgcacggttagatccgcaggcgagcgggaggagagaagaacggaatgttgtagcttacccatggcgacggaggcggcgcggcgggcggcggcggcggcggcggcggcggcggtgctaggaaggggaagaggtgaggaggcggcggcggaggcttatatatagaggagagagagacagcgagacgccgcggagtggaaaaaaaccctaggctgagttgagatgggctttcatgggccttgttgggctttatgatagatggctgggcccattgactgtttaaggtgagttgaaatgggcttcccataaggattcgaggatttggatttgtcggttttgatgttaacagctcggagatgacagtttaatgcaaaatttaagttttagcttgagtttttatatacttgaccggattttagtgaacttttagcttgagccggagcaataaagctgatgatacctgtggttttcgagcagttatcatcggttttgtgaatgtcgtatttcacgactatgctcgcactatcagaattgtactattgaagtacttacttgacaaatgaattgtggagatcatggataccccatacatacacggcatgtatagtttgactgggtatggagtgctatatatagatagaatatctttaaaatgacttgggttaaattctaaacttgtatgtcaaggtaatacccaagatcctagtcggttacgattgtattttatttgtaactacctattccgttagggatatggactgtattttgtaatacggaccccttcttctatataagaaagggtccaggtgcctctaggggcacgttttttcacccagatcatacgatcaataatatactcggcagatcaatccccggacatgagtagggtactacttcttgattaaaaaggcctgaacctgtataaaattccttgtctcttaaaccatccacttttccagtttgatagccaccccctttagtattgtcgaaatcttgttttgacagttggcgcgccaagtaggggtagtgtcaagtacttcgccgactaatgcgatgggtttcgtttccgacatcgacgacttcgtcttccctcctaggcaggcgttccggttcggcagcctcgacttcatcaccaacgacctcgtcaagatttctctcctcgactcggattcgaaccagtcgggaagaagccagatctccgccccgttcggtatcccaaactcggccaagatctaccccaagatcgtctccaccgagtcggcttcaaaccactcgaacgagatccaatctactccaacacgactcgatcaagacgatggggcctatccgccaatcctgatgaaactccccgatgatttggctgctgtcttcaccacaagggcatcttctccccgtagatctaggcgggatccggcctctaccccgatccagcttagcaccagagaagtcggcatcatactccagcctctcagcacggtttcgacggaacaactggatggctacctcagctcccccggcgtcgactcacggccaacggagatcattgagtacaacgacttcggctgccgctacgactaccgcaacctcgacgacttcgacgaagactttgaagataactacacgcctctctacttcggcatcttcatggctgacaacgagatggaagaacagcgtaaagcccaagaagcagaagaacaacgcgtgcaacaggaagccgaacgacgccgactggaagaggagcgccaagcacaagagcaagaataggctgcaaaagaggctgaggaccggcgatagcgcgctttggatgccgggtgacgagcacgagaacttatcgggcaacaagacgttgacggaacggcggtttttcgcacccctcaacagaacgcagttgcaacgatcaccctcctcgacaccctcctcaaggaagacgcactcaatcaagccaatcacgtcgtcaacatcttgaaccagaccaagatcatgatcgccgtctcggtcccggttaactctgcaagcgtccgcacgccgactggcagccgagttccccctcttcgatctcaagactatcaccaaccaagcctcagtgtcgtcggcgcgggatctagtcgcaggagcaggggtcacgacgagcgatctgtccactcgcctcctgaacgacacagggagcgtcgagttgaacgacctcgctccccacatcgcaggcgccctgtcgatcttcgcgatattatcaaccagcgccgcgcggcaagaggatacgttccccaccattcaccagatcgctacgacgacgacgtggatggagttgctgccttcacaagtgaactgcgtcgagtggattggccagccggcttcaagccgactggaatcgagaagtatgacggcaccactaacccggaatcttggctcaccgtctatggtctcgcaattcacgcagcaggaggagacagcaaagccatgacaaactatttgcctgtggccctagcggactctgcccgatcctggcttcacgagttaccccgtggcacaatcggatcttgggcggaacttcgcgaccacttcatcgccaacttccagggtatctttgaacgccctagtacacagtttgatctctacaatgttgttcagaagtctagagaatcccttcgagattacatcagacgcttttccgagcaacgcaacaagatctccgacatcaccgacgacgtcatcatcgctgccttcaccaagggcattcgccacgatgacctagtcggcaagctcgggcgcaagcctcccaggacggtcaagcagatgttcgaaaaagccaatgagtacgccaaagccgaagatgccattaccgcgtccaagcagtcgggcaccacttggaagccgaagaaagatacgccgactacaggggggagtggaagtaccaatcacaaggatcgcaagcccgaggaacttgtggcaactactacaccatcctcccggcaacattcacgggtcaacacttttgacaagatcatgaactcccaatgtccgcatcatccaaactccaatcacgcggccaaagattgcttcgtctatcaacagttcgcagaacaatacgccaagaatgcacgcaaggcctctgacggagatcaaagcacgtcaaagaagaaggatgatgaagacaacgccccgactggttttcaagaccatcgcaaggaactcaaccacatctttggcggacccctggcttatgaatccaagagaaagcaaaagctaaccgaacgggagatcaacgctgttcagcccgacacgccccaatatcttcggtggtcagagacaacaattaagtttgaccgctcggatcatcctgaccgagtggtccacccggggcggtaccccctggtactagacccagtggttcgcaacgtcaagcttcgcagatccctcatcgatggtggcagtgcactcaacatccttttcgccaagactctggacgacatgcagatccctcgcacggaattaaagccgagtaatgtgccctttcacggagtcatcccagggctatctactacaccactcggccagatcattcttccggttactttcggcactcgggagaacttccgcacagagaacatttgtttcaaggtcgctgatttcgagacagcgtatcacgccatactcggacgcccagcgttagccaagttcatggctgtcccgcattatacctacatgatgatgaagatgcctggtcctcgaggagtcatatccctgcggagtgacatcaagcaagccgtcacgtgtgacaaggaaagctgcgagatggcccagacctgcgagatcacgctcgcccgagaagaaatccaactggctgcgtccacagcaagcgaaggagaagtgcctgcgaccaagatgccaaagagcggggaaagcgacaccaagaccaagaagattcctctagatccctctgatcctactaagacagctgtaataggcgctgagttagattgtaaataggaaagcgcgctcatcacctttcttcaaaataataaagatatctttgtgtggaaaccatctgatatgcctggtattcctagagaggtgattgagcactctttacatgttaaggatgacgctaaaccaataaagcaatgactccgccgtttcgcacaggataggaaggatgcgatcaaggaagaattgaccaagctgttagcagcgggcttcatcaaggaagtccttcatcccgactggctagccaacccagttctggttcggaagaagacggggcaatggcgcatgtgtgttgattacaccgacctcaacaagtcttgtcccaaagatccatttgggttacctcgcgttgaccaggtagttgactcaacggccagctgcgagctactcagttttttggattgctactcgggatatcatcagatccgactaaaggaatccgactgcttaaagacttcattcatcacgccctttgaggcctactgctacatcaccatgccttttggattaaagaacgcaggagcaacttatcaacgcatgatccagagatgtttttcaactcagatcggccgcaacgttgaagcatccgcgcttttaggatgaaattaaatcctgaaaagtgcatcttcggagtaccgtcagggaagctgcttggatttatggtgtcccatagaggcatacaagctaacccggagaaaatcaatgccatcctcaacatgaaaccgctgagctcctagaaagacgttcaaaagttaactggctgcatggcggtgctcagccggttcgtctcacgactcggcgagcgggggatgccttttttcaagctgttaaagaaaaccaacaatttccagtggggacccgaagcacaaaaagcctttgagtacttcaaaaaacttctcactactccaccagtcttagcttcaccacatccgcaagagccgttgttgttatacgtgtcggcaacttcccaggttgtaagcacagtcctggttgttgagcgtgaagaagaaggccatgttcaaaaattccaacaaccaatctacttcgttagcgaggttttggctgactccaagacaagataccctcaggttcaaaagctattatatggtgttttaattaccgtcaggaaattatctcactacttccaaggtcactcgattacggtggttacatcgtttccactcggggacatacttcacaatcgcgaagcaaatgggcggatcgcaaaatggaccttagaattgatgtctttggatatatctttcaagccgcgaacttcgatcaagtctcaagctttagctgacttcgtcgccgagtggactgagtgccaagaagacatgcccgtggagaagatggagtattggactatgcattttgacgggtcgaagaggctttcaggcactggagcgggagttattctaatttccccgactggagagaggctgagctacgtattgtggatacatttttctgcgtttcacaacgtggcggaatatgaggcgcttcttcacggactaaggattgcaatctccttgggaattcggcgtctgatagtttgtggagattctcagtcggttattaatcaagtcatgaaagagtggtcctgccttgatgataacatgactgcttaccggcaggaggtacgcaagttggaagacaaattcgatggacttgagctcacccatgttcttcgacacaataatgaggcaaccgatagactggctaattttggttcaaaacgagaagcagctccttccgacgtgtttgttgaacatctctacgagccatccgtaccaaggaaagaaacaatcgaggccacggacactcaagacataagcatgattgaagtcgactggagagagcccctcataagatttttgacaaaacaagaactccctcaagataaagatgaagccgagaggatctccaggtgcagcagactttatgtcatacatgagaccgagctgtacaagaaaagtccatcaggaatcctgcaacgctgtgtgtctttagaggagggaagacaattgataaaggatatacattcaggcatctgtggcaatcacgctaccgcacgaaccatcgttggcaaggcttaccggcaaggttttttctggcccacagccgtgtccgacgctgacaaaattgtgcgaacatgtgagggttgtcaatttttcgcctgacaaactcatctaccggctcaggagttgcaaaccatcccgttgtcttggccgttcgcggtttgggggctcgacatggtcggcccgtttaaaaaggtagtcggtggttatactcatctctttgtagctgttgacaagttttccaagtggattgaagccaaaccggttatcacaatcacgacagacaaggctagagatttcttcatcaacattgtgcaccagtttggggtacccaatcggatcattactgataacgacactcaattcacgggcggagtatttaaagatttctgtgaggacttcggcatcaaaatttgatatgcctctgtagcgcaccccatgagcaatggacaagtcgaacgcgctaatggtatggtacttcaaggaataaaagcacgagttttcgaccgactgcatccgtatgctggcaagtgggtagaacagctgtcattcgtactttggtccctgcgcaccactctgagtcgggctacgggccagtcgccgttattcctagtctatggagcagaagcgatgttgccaagtgaggtggaatttgaatctctacgatttcgtaacttcagcgaggagcgctacggagaataccgagtagatgatctcaaccgactagaagaagcccatgaagcagccttaattcagtcggctcggtacttacaagggatgcgccgttattacaatcgcaatgttcgatctcgagcttttttagtcggcgacctggttctgagaaaaattcaaactacacaggatcggcacaagttatctcccttgtgggaaggaccgttcataatttttgaagtcactcggccaagttcttaccgactcaagcgtgaagacggtactcatatcgacaactcttggaatattgaacatcttcgtcgtttttatgcttaggcattacttttgtatcttcctctttgactgttaacatcaagttgtcccttgatttatcagtcgggggctactataataataatggagtgtgatttttatcaattcaatttgcttacttgatttatcattgccttgtttgattttttggcttagccaatgaggactggaagtttttaaaaaaacttttgcgggttctaggctcaataaggtttgacaaaaacttttaagaaatctggagctaagtttaaatcatcaagcacagcataaatttatcagtattgcacaaattgtgcctccatcatcatcatcattatcatcagaatacacaatcaattagactcagttctttcatcatcagaattatcagactcagtcggcttaagattgttgtcctggaatctctcaactacatcagcggctatcttgtcagcagccttttgcgcatcactgatgaggtcaagggcggcctcttcacttgtcccgtctgcaaagccgtcaacagcatcaatatcaattttcgggtataaggacttggtcatcgccagcgctaggcctcctcccatactcccagcttctttgatgttcttaaaatatgtatccggagtagctctcagcttgtcgaagatttcgacagcatcaagtgaactcagaccgttgttattgaaaaacatcgcctggacgagtggcgtagcggcattggcgacttcatctctggctccttcaagcttcttaattttgttaaccaagacgttgaactgagcctgggatttgattttgcgatctgcgcaaataaattcacattaaggactgggcatgaagatgagagtggtttttgaggtttcgactaccagtaccttcgacatctttcagagctgagtccctctgttttgccaattcggccttgtctttctccggagcttgg

SEQ ID NO: 23043 - DNA, 2514 bp, Oryza sativa
agactcatcaaattccatgaccaatcatccatccgaatacatctcgctcacatcacagctgacgattacaatctaaccaaagcgaaagataagtttagaaccaaatgaactacaatcagagcctacgttttcattagggatggagaactggacactgtcgccaacggagaagaacaaaaccttataagtagaaggaacaaattcattatcaacattctttagaaaactttttaaattatcttttcaactttccaaatacttaatttatttgttcgtgcctccaaataattatcacaaactttagttttatgaaccatccatcattcattgattgaacgcaccgggacttgagattaggattaaactagtcaaaagctcgcgcgttgcagtgaaaatttataaaagtgaagttgtgatgaaattttaggggacgaaaaaattgatagagtggtataacatatttataagacatgtgtgtgaattgaagcaaaatttgcaataatgatgatcaactatgagaaagttgttgaggcatacttagtgagatcagcattagaaagataaaaattgtcatcgatagagcttacctcaatctcgaaagtactcttaaattatgcctcaacaaatatcattttaaatataaaaaacttaccatgtgtcactaattatgtttaaagtacagcctggtagcaggagccatgaaggtagatttcgtgcttaaattgttgagattattgaagagaaagagcgagtgattacttgacggtttatttgagcattaagataagtaccactatttaatcatgcaatgagcaacaatcaacatcatgaatagaggagggattcatttgcagttaatgtgaggaatggagcacatgttattagcttctctattgtatcggatggttaatatctgagatgcacaatatgatctaacggctataacattcttgatgatgtggttttacgaattcacaactaattggagtggttatatagaaatagtagatagttgggatgtactcccttcgtcccaaaaaaaaaaatccactcatagcatgtcaaggtggaattagtggagatgaagagtgactaaaatgcccttaatcattttaggtaaagaatagtgaagggataaaacttctctttttacgtgctgagagtagatagtatgggataaaacttaaactcttaaagttgaatttttttttgatggaggcagtactgattacgatgactccttcctagtgagtagggaactatattatatttatatttatagggtatacatagtatgggttgcgcaagcgtgtgctctaagttaagtgaagtgatctttattaggagatcgaggacccattcccctgccacattctcctcttaatgacttgcatactcaattagtggattagtcgtcgtactactactaattaatttggtttggctgctcacatgacccaatatatatgcatatatatgcatcatggtcccatgtggacagagagtgccatgccacgctacctcacaactacccatcatcatcatcatcgatcatcgtcaccatctcaccattgcatccatgcaaagcatggtcccaaaccaaccaacggtagatagatagcgatgctgcgctgctactgtccaatactgtacagctacgcctagctgtactatatatgaattttctcagtgctttttgcgagtgaaagagagagagagagagatatgagaaattgagaaggaattagcataaactagtacgtactataggagtattatagcatacatataccaacttcggtactttttgtacttgatttctgatcaatgtaattagaaagtcttcggtcatactcttttgggggttcggcaatgggcaagctcaatccctatgaaatgaaatgcaaattcaatctgcagctaatagtgaattatttttagccgtcatgcccttccagtgagtatgcttcgttattacatttttaacaatcaactatgaaaaccatttttcgtgacggccattatggatttttgctggcggaatttacagccgccacaaagcaaaggccagtgaaaatcaagatcttcgctagcggttattgaccaccagcaaaaatccattttcgctggcggtcgtcttaagccagccgccagcaaaaattcattttcgatggcggctgtgttatatcggccgccagcgaaaatctatttggggaacaaaaaaaacacgcatgcaactgcccagccgccagcgaagatttggagaaaagacaatagattcattttcaaaattcaaatccaattcatatacatatggctgctcatttccaaattcaaacacaatataaaatcatcattagcacacatgtacacatatcaaacatcacaacatgcacaaaacatctacatcatcaggaaacatgcaaaaaaaaaaaaaaaaaatcgtgccgccgccggtctcttgtcgtcaccacctcatcgctgccagtggggagggaggaggcgccggatctg

SEQ ID NO: 23044 - DNA, 34289 bp, Oryza sativa
ccccgtcgtcgcggtggccggatccggcttcccctagccgttgctgcgccgccccttcgtcgttgttgcccgccggcctcccccgtcatcgaggaagcagatccggcctcccccgtcgtcgcgacggcccgcgtcggtggatcaagagttcgcggatcgagagacggagaagggagagaggcggatcgagagctcgcggcggcctgcggcggagaggtagaggctgcgcctcgccgctgctcccgaggcggtggagctgcggcaacgggagccggcggtggtggggagagggagaagggggaggagaagggagaagggagggaggagaaggtggaggagaaggataaggacggagaagaataaggataagggcgggcggtggatttattggcctcaatttttttcagcggtcttcactacctgccgccagcgaaaatcacgttttcactggcggacagctaagaggcccacctcaaaaaatagagtttttttttatggcggatctcttagcgtggccgccagcgaaaatcggttttcgctggcggtccatggccccccacccctcgaaatatttttactggcggttttcgcgtatggccaacgccatgaaatatcgtttttctagtcgtgaatgtattataaaaatgataaaaaaaaactaactatggagaagtgttttttaaagataaatttactttagtgatactatttgcacatatcaaatcttgttactttgatatttattgacgatttaagtttttaagatttggctacacttattgtacgacaatgtgatctatttgaaaacagttggaggggatatctttgatttgccctcttcagtttcgtagttcttgatattttgaacaacgacacagtgttctaaacatattttgactatatttttctattataacatataaaaataagtaaatatttaatattatcaaattacttttaagactagcgttttcaaaccaaatattttaaaatctatatatagttaaagttctagttattttatttaatttcaaccttacctaaaatatgaagaattatagaaccagataaagcaacaatatacatactatatacatatagtaatatggtaaggacacaagagcatatgcatatcagcatatatacttgtatacatgcacgcttactttgagatgatcaccacctagcctagcccttttttttccttttttttttgttgcagtgagcgagcaagcatgcaacaaagtgtgcctctcttttggcacataccattattgtgtcttgttggaacagctagcagcatgcctgcctgcctgccttgaccacacacacactgcccggccagctcaaatgcttctgatgaacagagcgagagatcagctttgcaattcttaatcgcccatatgtaagtacgagcaaaagctcacctgaaagcacaccggacactagcaaaaggctgggatacgttgcttagtttttggtttaagataataataataacaacaacgttaataatacacagtagccgatagcgaaagagcgcagctttccgcttggccatttgtgactactccctcactcccaaaacaagcgcaaccatgacttttcctgttcaactttaatcattcatcttatttaattttttattactattagattataaaatgtaataatactttatacgtgacttattttttatttttttaaaaaaaattaaataaaatagacaattaaagttggattagtaaacttatagctgcgcgtattttgggactgagctactaagtgatcgtggtttttttttcactctagctcttgtactatgacagttttactgatgtaccccgggggtattttacgcaggaaaccctagaggttggggggtcgccgccgccgctgggcccacgtgtcagcctcactccccactcccccctacacggtagccacacgggctatttgctcgcacgcctcagtccacctcccctgagctgtgctgctgcgctgcgctctcggactcctcccagatccccaatccccccacgctctccggccatcgcgggtggagcagggccgccgccgagggctgggggggagcgcgagtcccggggatccgagccatctgccggtgggcggcggcggcggcggcggagttggggttcgtcgtcttggtcttgggtcttcttcgtccctcgctgcgggtgggtagcgcagcgtcggggcagatccggctagccactgcgacgctgaattctggagatccccgcacatggagtcgcagcgaggtccgccgccctccctccctctctctctctctctctccttatttagtagtagtatgtatgcctgtgctgtgctgcctcgagaacaaacgttcaccgcgtccccggcggcggcactcagccggagcacgcggctgcggtgtggatcgccctggctttcaggggtgaataagggaacaatttgttgtgaagactagtagcttatagtcaatttattcaattccttggtctatgtgtgttgtttataattcaacataaggaatgctagttttgtaaagtaggattaattcagtgctagggttgccactcaattgaacttcaaggccaataggcacattttagacgctcagagcgcaagaactaagataatgatttagctcaagttattctgtgggagacaaggaaaacatcagtttgtacgattagtttcaaaaatggtgccccaggagacatcgtataagctcttttgagcctaacaagtgttgtgcatttcacattacaaacaagttggccccctttgatttgtaggaaaaacataggaaatttggaggatttcaatcctataggaaaaatatctatgaaggtctttgaaacaaaggatatcttatccttccctttgaaattcctatagagattttgaaggaaagttagcaagagctctaacctcttggaaaatttcctttggagtctatctctctcatccgattcctgcgtttttcctgcgccctaataaattgaccattcttgtatttttttcctgtgttttgcaatcatctgttctgcacttatattcctttcaaaatcctgtgtttttccaaatcctcctttttttcaatcctgtgcttcaaaggagcactttctgtgttacaatcacataacagcacaaacaagaccttgttctttgttatactcaagtgaagatgccatctataatttctatacactacatcttattatcagtatgccaatttttgtgcacttgttgcctctgtttggttaataaatcatctcaacagtagttcttgaatctgttgttaatttgatgaatatatatcaacttgagaaatctattttgtagatacgttgagcatgagtgctcttactttgtccatatacaaatttctatcttctctattatacatttgcttgttggtactttaaagtaaaatacaaaaattgatgtgcacaatgtgttgtacatttaactttctggctcaactgggaagccgtgccctttctttacctgaaatttatttgtttgattgcttctcatttgcatgatgtagcactaaccaatgggacatctaaacttcaatgctgaattgctgatcatatcatttactttctgttacctacttacctgtacttaactaaaaacctaaaatttcttgaagccctattgtccaactgtaacatattttttgacaatttttttaatgacatttggcagggcaatctcctgatcgtggatcagacgcatcaggaccaaaacagtctagtgtttcatcacatggtagacaaaggaattcatcatcttctatctgtaaagattttctccggaagtttgtggacaatgaactattgacatcaagcctagaggactggttctctgggcacagtgaagactgtggtttcaagaagccagcatttgatgttccttttgacctaagtgaactacaaaattttgactatgctatagaaggtgttactttccaacagctagtacggatgccaaatgctcttcatgcctcaacatcagatatttttgaagctactgcacatcttgctttggaagattttcttcatgcaagtattaagggtttgtgggaaactttctggggccctgatgaatcgatgcctttctctgttgcctgtatacacagcacaagctccaaattttatcctgctgagaaggctattagcagtgggagacttgatggcgtttgtgcaacggctgtattgctgaagagtttaaagcattcacaaggaaggtgggatcatattgttgtactggctttgttgagacctgatattggaatgttttcggggcagaatgaccaacagccatctccggctgttttgggggaggcactattctttgccttgcgtgttctactttctcgaagccttagtaggtcttccacagttcttcaaaattcagattgtgtttacgtccttcttgttgattcacagtttggaggagtggtaaatgtccaaggtgatctgaacaagcttgattttgatttgaacaatgtttatgactctgctgcagagtggataaaaaagcatgcacaaatcacagtttcttccatagaccgcgtatggaacaaacttggcaatgctaactggggcgacattgggactcttcaagttctccttgcaattttccattcaatgatccagttctgtggtgcaccaaagtattctcttgatgaactagctacagagcatagttcccgattacagagccgaagatcagaaagacatttggttggcaggcaagctaatacaaatggtttgtttcgattccagcagcaaagtcattctcctgaaattgttgaagtacaagaggagggagctgttaatgtaaaaccaaaggaaattttgaagcttgaggtaggatctgttgtattgatggaggatgctgattggcagaagggttttcaaatcaatgatattcttacagacagcgaacctcctatctatagtgctactcctgtagaagaacctaccaaaacccatctgttgtatgtaggctccagcccttctcatttggagccagcatgggaagatatgaattcttggtatcaagttcaaaggcagaccaaagtacttactttgatgaagcaaagaggcatttcaagtagatatgtcccacagatggttgcttctggacgtgtcgtccatccaggcccttgtaacaagcctaactctagtgcgagttgtggccatccatggtgcagtactccaatactttgtcacctcgccagttggtgaaactatttcaaatctgattcgtaatgggctgtttggtgttgaggacgctctgagatgttgtcatgactgtttgtctgcgcttgctgctgcatcatctgcaggaatccgtcatggtgatatccggccagagaatgtgatccgtgtgagcaatggttcaaggcatccatattttgtacttattggatggggccatgctatcttagaagacagggatcggcctctaatgaatttatttttctcatctacattggcttctacaggaaggcaagttatgtgcaacatctgatgcaaaaagctaaattaatctgttattcttttgttgtggtggagtttgcccaaagcttgactcagttgaaggtgcacttcaatggagggagacatcctggtccaaggagagttatacagcagaagttgggtgatgtctcagcagtgctgaaagcttttgcagactatgttgacagcatttgtggaaccccatatccgatggactatgagatatggttgagaaggttacgaagaaccatcaatgaagatcatggcaaggagattgatacatcaagttagtactgcagctcatgttagtgcggaagtacgatatggaagatcaagaatggtcgttccataccctgtattgttgttgtagataatttattcgcctgtctcgtaaaaggtccataacttagtatccccctccatcttgctccatttcatctaaagggtatttccatagtcacaatctgctgctgatatcctcaacttggatttctgaaaatggtgtcgcctttgcacaagactgcagtagagatcttctgaggatatctgcaacatgatttattttggcgagtgctcctcttaagtctttgcttttcttcgggtctcgagtgtgtggtatagttgatcaatttttggtccttttgcttttttgaaattgttccagaatggatttgtgattagaggtggtgtggcagagtagcattttgttctgactaaattattttgcgggtgctatgttccaagtgcacctagttcttgtaaatgttgttcttgttcagctgtacaaacttcaatcatgctaggctgcaactgctgggtgttgatatgttcgatgaaatgtcaaaaaaaaaaagttgttccccttatgtgctataaggagcaggttttttacctgacgggcatatattgttgtgagaatttcaggccatagataatctggatatgcagacaaattattgtttctttggagattcagttaatggcgtgacgaatagaattcaactgtacgtgtatcctactcccttcatctactttcgatagtcatatttccaaatctaaaaattttatttttttccaaatctaaaaaatttatttttgataggcatatttcaatccaacaacttatcatctcaataactttctcaaatttaatgcatgattcttcattgttccacacatgattggctacatgaacattgagaaatgtaaatattaatgaatcgcttatttacgaggaatgactagtagcatgtttaaatggatgataagtagaattacttatccttgatctatgtgtcaagatgaaatatgactatcaaaagtagatggagggagtatcttatttttgggggcaatttggcttgactagttgggtttcataattatagttctggaagtttgctagctccctccaccttttccaacaatgagcaatagaatcattgttgttaattactccctccattctataatataagtcacaactaccgttctatatattataaggcataactacctttttttttattttagatgttttataatatatggcatacatgtatgcatacaattaattaggacttcttctccattaaattattatttttttaaatcctccatcctcaatatctctaattctattggatgcatacattatatttattagggtgatctaaactagaagatgataataattattttttcatctttgggttaagggtggttgtgctttatactattatatactattatagaacggagggagcaatgatataatagtagcataattttccatggtattgaattccttttgatgttctcgagtacttgaaatacttgtacgcagcgcacatagttcatttcagtgacgttcgcagattttgctgtaaaaaggtacttcaccctgtgcgagcatatgcatatttctgaaaataaaaggcattttcggagtgaatagtcggtaatacactggtggacaaaccctttttaatcccgtttcacaaccctcctatattcccgcttatataactgggactacaaatcaaatcatttttagtcacagttgaaataaccgagactaaaaatgaatatttagtcccggttggagttaccaacatggactatagtccctcttggagttaccaaccgggagtaatgttctttttttcttttttttcctgctgcttgcatgatttcgagccccacaaatcactcatattatccaccaatcattcgaacaccacgcatcattcacaaaatccccaaatacatcaagctgcattttctatccccaaatacatcacaaatcattcacaaaatcacaaaatcatatccacaaaatcattcacacatcacacatcacacatatcagaataagaaatccacatcgctcagatcggccgcacatatcagaaaaagaaatccacatcgcatagatcgaccgcacacatcgcacagatcagaaaaaaaccacatcgcagagatcaggtgccgttcatccgccgccttgccggcctcccgcccggccgcctcgagctccgccgccgcctggggagcgttgccacccgccacccgcctcctcggcggccggtgcccgcccgctgccgcctcgggctccgctgcccgcccgggaagcgccgtcgccacgccggacccgccggcctcgttggccgcctgctcggccgcccgccgccggcctcgcaggctgcctgcccggccgcccgcctcgctggcctcgctggccgcccgccgccggcctcgcaggccgcctgcccggccgctcgccacttcgcggccctccctgccgccgcgcgccgcccggcctcacgtggtaggaggaggaggaggaagagaagagaagagaagggagaggaatgggagaggagaagggatggaggattgggtgaggctgaggatggagaagggataagggaggctgtttaattaatgagaggggaggggagaggaagggggagagaccgaggcggccgcgcgcgggcgcgtggcttggttgattttttggtctcggttggtattaccaaccagagctaaagatcaaaaagtttttaaccgggactattgtggattttgggcgaccgagtaaagatggtttcttcaccagtgttagctcagggaaagatcgtttatgtgagatttttttttgaaataatacgattttaatggaaaatcgcaaaaatataagtcggttaggcgaaattgcaagtttagcaccctatcgaacatccgtggttcgacagggtacctattgaacaaccgcagttcaacagggtacctatcgagagttcgacaggtgataaaataattttataaaagagaaaaaaaacactgtagagcactgtagccgtgctcctatcgaacattgcctgttcgatatgtcctgccgcacacctatcaaagttttcatgttcgatatgtccctgctgggtactgtagcaagtacttttttttttttaccaactaccggtcgaactgcagttgttcgatgggttcccctatcgaaccacggttgttcgacagggtgctaaacttgtgattttgactaaccgacatatatttttgtgagttttcattaaaatcatattattttttaaaaaaattcgtttatgtgaccccgaaagtccgcaagttaatagttcggtagagccttttagcttagcttagctaatcagctgcacggaaaacaagatagatatgcatgattaatcaagtattactatgaatatgaataaaatatttgtttaattttgtgaaaaaaacttttatgtagatactccctccttccaaaaagaagtgaatataggactggatgtgacatatactagtataatgaatctagatagatatatatccagatttattgtactaggatgtatcatatctgttattatgttagttttttatgagacggagggagtagtttgtcacgaaacataacgtttaaccattccaaaaagaatacatactcacgtaaaacgagtagcccagcttgtaagctttcccgagcgcaccctatactaagcgtgggtgttcggtttattcggtttgtttttttaagctatatggaattcagtttcttaaaatgtcaaccgatcgatgcaaagttctaggaaaaaaaaaagaaccgagcaaaataaaatgaagaagttcggttcagtttttctggggcttggtttttaccgaggaagatgttgatcgtacgccgtggtcgacttcgagcgattacgcacgcttagcgcccgcccagctacactcaaggggcccgcttgatcaaggaatggggtttgtgtacgtgttagctctcatatattttaagggccttagtaaaaattgggttacatgcatgttagtgggtcttgtgccagttggattggctacagagtgcacacccatttagaccatgttcggaagataggtaaagctgtaaaagactaggatcctggcttttttcccagcctagaagggaaagcccaccacgaaggggaaaaatccccagactacccaaaagttcattttgcaaggtccgggaaggtaagtttcctggctgaatacccccaaatcctaaggaaattcatccatgatcctacctcgtagaacgaatcccacacgccgccatctcctctatacgatgcgaacgccgccacctcctcttgcagcgaatgctgcctcctctcaccccatccaccggagctgccgcctctagatgcatcagccggcggtgcttcccttcctccctggtgctgtcgccgcctcccttttttccttattgccggtgcccggtgctgcccctcttcctccaccactgccaaggatctcgggtacatgctgctgggcatcaacgcggccttctccaggcctagaaccatggcatcaagtacgccccttcactcctctcgccgccgctactcatgtggaggaagaagtggacaggaagcttatgtttttctggcttctctccttgcaagatctttcgccacttccttctccgtccggccaccggatcttccctaaatccaataaggaccttgagaaactcggcatcttctactatctcatccaggtgtatacatttcaattaattttacgtggatatatattttcctactgttagaacttgtgtggttaagtttgctgcatattgattatcttgattctttcattattcagagcgtatgttagttgatatcttgctaagttaaaatctttaaagtctagttatagaactccaagttgttagttcattgttttcacttgcaatgagatgctattattcataccttttgaatatggttttctgatggcaagcagcgcatgtaattcaaaatgtgaaatttcatccccagtattgctctttggattgtagaataattcagattcagaattatcgtactgttctttactccatgtccaaatactctgctcagaccatgtttcaggctatggctgcacacgcagatgaagcattttgtactaatcactgaccaaaattcctcctaaaatttgcacattggatgaagcttaagattttcgtggcacgcttttcaaactgctaaacggtgcgtttcatgcgaaaactttctatatgaaagttgcagtaaaatatcatattaatctatttttcaagtttataataattaaaacccaatcaatcgtatgtaaataccacatcattttacgtaaaaaacttaatcttcatcttcttctttttcttcttcatctttagaagaaaaaaacaccaatgtagttttgcagcaaatctgacgagttaaagctctgaatcctaaaaaaatccccaaaaaacactctctgtatctgaagagtgaaatatctgaatatgtagatgtaaagtcatatatgcagcagttaagcacgtagaatagcagtctaccagttgccaataaacaatttttttttcatgtaatgattggtgaacttatatcctgatgatgatattttaagttttaccttttttgacatctttgcaaggatcactcttttcctcactacattttttactactatcaatgggaggtattgtctaatgaggaaatcaattttatcttgtatacctctgaaattttagctaatcccttctatacctttgaattttgcttactttcttatatacctctaaaatttggttttgatcccttccatgcccctttcgtcagttgaccatctaatatccataagagtgaaatacatggccggtccttaaacttgttgtgtggtgtcacttaggtccgtgaacttaaaaattgcacgattaggtccgtaaacttggtttaatgtaccaccccagtccaatcgtcctttgactatatttgaccgccaacgtggcataccacgtaggcaacacttttattctcagcccctccacatataccttcgcacataacttaccctgaccagtgcatttcaacccaaatccccccaaatatccctaaatcggctagggttttgatggtgagtttagcggaaggaggccgagaggtagtggttgtggcagcctcggcggtgagattagcggtaggaggcagcgcagtgaaacggggttagcggtggcatagtgcggcgggaggcagcacagtgcagcgggaggtagtgcaatgcggcttgcacgctaggcatccccatggattctccaagctcgtcctcatcttgaagtcgctggaagaaggtgttgttgatcaagtacccgttgcataaggataagattattttggagtgcagagcaatgtcaattgctaatcgggaccacatcttctatacatgcaaggagaagaatgagagggaagaacaatttgagattttttcttgggattttggtgtcgctatatagctacaaggagatatatgtgacatgttgtgatgtggaggggcctaagagcaaaattgttgcctacgtggcatgccacgttggcggtcaaacgcagtcaaatgacatttggactagggtggtacattaaatcaagttcatggatctaaacctgcaattttcaagttcacggacctaagtgacactactacacaagtttagggaccggcaatgtattttactctttcgataaaaatgaccattttaacttttggatgaacacataaatttatgaattacataattgaaaatgtaaaagtttgtcgcatgagactattatagttatgagtttgttgtgcgatacattatttatgacaaaatttatttttatataataaaataaaaatatatatttatttttttaagaaaaaaatcataaaaatgaggagcattcatacaaagataggactaccaatgctcacgatattttctttatgaatgctcccaataaagaaaatctattgccctattaaaatttcaaataaaaattttaatttattacatttttatttatgtcaaaaatttctgcactaattatttagtctcattagtttcataaaatgcacgtactatgcattaaatttctgcactaattatttaatcttattattttaatcattttttaagcttatattcaaacctaaataatcaagggcataaaagacatttgcaaccaaacttaacagtgaaatgaaggaatcaagttgaaatttcagagatatagaagggatcaagaaaattacaggtatatgaaaggaattgagtgagttttaatgcttaggtcttgtgaactctgtgaaggatctgttgcattgtctagtgactagtggcatgtagttagtaaatttgattaaggtgcataagctactatggcactaatgagaattaattatgattcattattggatagtcactaagttattaaataaaattgtagaagaattacccacaatcaaaagttagcactatgccagaaccctacatctgtgacagcataccagtgacgggcctatgaattggtcacagatgactgtcacctttgacgggttgctaggtttgctgtcatcggtggggcatccggccacggcccgtcacaggtatcccctcacctgtgatgggccagaaggaaaagccgtcacaggtgaggaagtgacgggttttcctcccaacccgtcactcgtatcctctcacctgtgacgggccgtggaattatgagccgtcacaggtggtggtccgccacctgtgacggattttttttatggctcgtcacaggtaggtcaatacctttgacgggcaactcaattgaagcccatcaaaggtatgaccaacacctttgatgggcttttttaatctaacccgtttgaggtgtgttgggtctataaataccccacaaactgccaactgctttccatcccgaccagttcaatgttcacaaatcggttgggagggcaagggggggcgaatttttgctaaaattcaaggtaaaaaacacattattctccattcattctcaatatatcgatcatcatatatttttctttgtatgttgttgattttagatggatcgtagatggatgtactatgcgcatcgttcgtctaccgagtatagagagggggtcactgaatttgtcacatttgcggataatgacagaaaatgtaggatgcacatgttgtgtccatgtagggactgtaagaatgaacagatgatcgttgatagcgatgaagtgcatgctcatttgataatgaatggattcatgaagaaatatacctgctgaaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacaatgaagacgcagaggacaacgacagagattttgagaagtttagtaagttagtggaagattgtcagatgcccttgtatgatggatgcaagtcgaagtacagcaagttgtcatgcatgctggaactcatgaagcttaaggctagtaatggctagtcggacaagagttttacagaacttcttgagctgtttaaggacctgttgccagaggggaacaatttaccatagacgacatatgaagcgaagtaagtattatgtccgttgggcctggaggtcagaagaattcatgcatgtccaaacgactgcattttgtattacaaggaatacgctgacttggatgtctgccctgtctgtggggcatcaagatacaaacgagcaaagagtgaaggtgaaggaattaagtcaaagaggggaggccccgcaaaggtggtgtggtatctcccaattgcggagcgcatgaagagaatgtttgcgaataaggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagtagtcgtcacagtacatggctagttctgcttgttaactataacctttctccctggttgtgcttcaaaagaaagtatattatgcttgccatgctcattcaaggaccgagacaacctggcaacgatatcgacgtgttccttgaactaataatcgatgacttcgaaaggctatgtaatgagggcacacgaacataggacgcatatgcacaagagtatttcaacctctatgcgatgttgttttgtaccatcaacgattatccggcccttggcaacctttctagctaaactgtgaaagggaaatggacgtgttcgtgagtgtatggaggaaacaagaagcaaatggtgtctacatgggtcacaggagatttctcccaaggtatcacccgtataggaatatgagaaagaatttcaatggacacaaagatacagccggacccccagcagagctaacagggatagaggtgcacaacttagtgatgggaataaccaacgagtttggaaaaaaagagaaaagttggaaagtcaaaagagaagagcatgtcaaaggaaaaaacagaggagcatgtggaaaaacaaaagacaaaagagatgagcatgtggaaaaagaagtcaatattttggagactaccataatggaaggatcttgaagttcgccactgcatagatttgatgcatgtcgagaaaaatgtatgcgagagtttaatgggattactgcttaacccagctactacaaaggatggtctcaacgcctgacgagatctggaagaaatgggtgttcgctcggaactacatcccataaccacggaatccggcagggtttacattcctccagcctgctacactctctcgaaagaagagaagattgatttgctaacatgtttgagtggtataaaggttccatctggttactcatcaagaatcagtaggctcgtttcactgcaagatcttaagttggtaggaatgaagtcgcatgattgccacgttcttatcacacagctgttgcccgttgcaataaggaatacttttcctcctaaggtgcgacacacgatccagcggttgtgttccttcttccatgcaatcggccagaagatcattgatcccgagggactagatgaactacaggctgaacttgtgagaaccctatgtcatcttgagatgtactttcctccaactttctttgacataatggaacatattcccgtgcaccttgtgaggcaaacaaagtgttgtggtccagcattcatgacgcagatgtatccttgcgaaaggtacctggggatccttaagggttatgtacgtaaccgttcacaccccgaggggagtatcatcgagagttacaccaccgaagaggtcatcgatttttgtgtggactacatgtcagaaacatcttcaattggattaccacgatctcatcacgaagggaggcttgatggtgttggtactgttggaagaaagactgttaggttggatcggaaggtgtacgataaagctcatttcacggtactgcagcatatgactgaggtggtgccgtacgttgacgaacaccttgcagttctccgacaggagaacccaggccgatcagagagttgggtcagaaataagcacatgtcttctttcaacgagtggctgaagaaccgaattgccaggttgcagaacctttctagtgaaacacttcagtggttatcacagggtcctgaatggagtgccaccacttggcaaggatatgacataaatggatacacctttcacacggtaaagcaaaacagcaaatgcacagtgcagaacagtgggttacgcatcgaggctgctagtgacggtggttggcgtgatcaatactatggtagagttgagcaaatattggagctagattacttgaagttcaaagtcccgttgtttcgttgtcaatgggtcgatctttgcaatgtaaaagttgacaatgaaggtttcaccactgtcaacttagctaacaacgcgtacaaggatgaaccgttcgttctcgcccaacaagttgttcaagtgttctacatagttgacccgtgtaacaagaaactacatgttgttcgtgaagggaaaaggagaattgttggattggacaatattgcagactaggatgattacaaccagcacgtccacagcataggtcaagaaatacctctagaagatgaggaagaagaagatggcgttcaatatgcacgcgtcaaccatgaggaaggattatttttgtaatttatgtacgtagtttatgtctacatgtctgttatctatatgactctaatatgttcgcaatgatcaatagtatattgcttatgaaatagtcaaataaaataattaagtgaagcacccactagaagtgaaataaaataattaagcaagtataaccatcggaacaaaaataaaataaaaatgtagtgtatgtggaaatatgttaaggaaaataaaagaactaagtgaaatagaataaaattaaataaaatattgtagtccatgtagtcaaactcacctgtcacaggctctaactgtgaggccgtcacaggtgcccagaacgctgggcccgtcacaggtggcctcagctgtgacgaacccgctctttgcgcccgtcacaggtgacctcacttgtgacggccccacagttggcgcccatcacaggtgagtttgactagggttaacctagggttggacctcttctagatccagatccggccactctctcactctcactcactctctcgaccgccacctcgaccgccgacgctgctcgccctcgccgcctcgccctctccgccctcctctccaccgtcgccgcctcgccctctccgccgccatctctgccgccctctacgccttcctctccaccgccgcccctcgtcctctccgccgtccatccatcgacttccccgacctccccgaccccgacctccccgacaccgggatccacgatgccgtccacctccacctccacgacgccgggaccccgaccactgccgccctctccgtcgccatctccaccaccactggcgcctcgacctctccaccgccgcccactctgccaccatctccaccaccgccctcgtgtgtttgccgccgtccgtccatcaccggccccgacctccccgaccccaacctccccgacgcctggattgacgacatcggcctgcaccgccgaccgcctcgacctcttcgccgctgcctctccgccctcgtcttcgccgccgccgggatccaggacgcctacggcctgcgccgccttctccaagtacgccaccaccctccccccttcctccttttttcgatggatgaattgcattgtttagatgaatgaaatgtgatttgttgtttcgattgttggtgctgctgtgtagatgaattaaatgtgatttgttgtctgtagatgttttggatgaatgtaggggctagattttggatgaatgcaatattagaggaattattctattggtattagaggatcttagcatgaattttgctgcagtggatgttcttttctttatggataagaacagattatctacacttgttgatttatatacccttgttatctatgaataggtgaattgcatgaattattgtttatatacatgatttatatacccttgctgtctatgaataggtgatttgcatgaattgttgtttatatacatgatttatatacccttgctgtctatgaataagtgaattgcatgaattgttgtttatatacatgatttatatacccttgctgctgctgttttagaaattattgtgggctgttttattatctacacttgcccctgcttgataaattaattgtgggctgtttaagaaattattgccatgggtatgataattttttttgatgccttgctgtctatgtttgcccatgctgctgcctatggttgccttatattaaatagccagtgatgaatgctcaagaacagaaatacctctaaacttgttctttttttaatgcataagaacagattatctacacttgttctttttttttatgtacacttattcttttttgatgaattgctgttgctgctgctacccctgctgcccctgtgccccttattcatttttttatgcatagattatctacacttgttctttttttaatgcataagaacagattatctacacttgttctttttttatgcataagaattgcccctgaatgcctgattttgatgaattttgatgattgttataaaatgaattgatgctgctgctgctgctgctgctcttatagaatgagtgttctttttaatgcataagaacatattatctacacttgttcttttttttatgtacacttgttcttttttctggattgataagaggagactatctacacttggttcttttttacgctttactttgggttgcttttccctcctattagctgatttcctcttctttttcccttcatgcaaatgatggtaattgatgcataatttctgagcaaaactgaggccatatgtttcatagtataccccgtattacattggttctaatgttatttagtataatggtaggaaatttataagctttttggggaaaattagaccatgacaacgcccggcgcaaacccgccctccccaacacctgcaaggatacaggaaaagcaaacccagccacggagacagttgccgaaagtcatccctcgacaacggcggtcgaacaatccaaaattcatgataatttataggataatttttcaccatatgaccacaaaattttagctagcaccccttagcatatgttgccttctgtctgcgctgcagaatcgccccaggaataacatacgtcgatgtcggacgggacaagtgcaagtaggtcgagtagaaatccccggtcacaaaatatatggccgaccacattgcaagttataagagaggttgacgctagtggtaggcccacggcgccgaggactgtcattggaagatggtctaactgctgcgggctggcggcacgtgagaatttcgggatcctccataaagatatcgacaaggtcacaaaagccgagaaagagcgagcttggacggcaatggagaaatggttcacatttccggctaaagcaaaggataggctcaagcggaaggcattccataagatgggcaaagcttggaagaattggaagtcgaagcttttcaccgagtttgtcaacctgcccggcaatcatacgccgttcgatgaataccctcaaataaccgaagcagtgtgggaggaattctgctctctcaagaacacccaagagtttagggaatcaagcgaggcacatcgcctactgcagcagcggaatgagcacccgcatcggctgggcaccgcagggtacatcggcaagaaggcaatatgggcccaagaagatgcagccgctgcagcagcaaatgtccctaccccgttttcagacatccctgaacaaagagctcgcaactgtgcgcgggaaggggtaaggtcaacccagacggctctgtcacatttgagaacaaaagtgatgccgtcgtctatcaggaactggtgagttcactacttaacctaactaatttccgttcgtataaagtagaagttcgtataaacgactcttttttttctagttgggcttggttgctgaacaagcttcacaaagcgaggttgagtccgcgccgaagaggcgcgaagatgacatcctcacaaaggggctcggaaccaaagaacatcctggccggactaggggaattggtagcgatgtgccctggaagcatggactcccgcagtacagctcccaatacaggaaacggaaagtctccaaggaagaaagggacgctcgtttgaaggccgaacttaaggttgaggtcattcaagaactagaagctagcatgaacgctagggtggaagaaaggtttaacaaggtcctcgccaacatgaatataccccgaggcacaacacctgctgtgcatccaactcctcgtgcacaacacgacgcgagtccgtcacagcataggagtagttgtgcatccacagaggtgccggcccctggtctcccggtcgcaccactagctgcagtggaccacatagaggtaattgatgttatccgatctatatctaataaaaaacctttacacgttccaatattaaattcaaactttcacatgtgcagggcgtagcacagtgtgtcctactggcgagggtccacccaactttcgctcccgaagtcgctgagggcatggctttcaagccctcggttacagacaaggtccactgcgcatacctgctagctgggtatgccaaggtgtccaacgatacagtaaaggacacctggtcaggctatccgctgcccgtgccccccaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcctgatggagctaatatggacttggcagatatagctcaaagcttggctctaataaagaccacaagaaaggctgatagctccccgccacttatcaagggccagaagcgtgaacgcggcaaggggaaggtcgggaagttggcaccggagccaaaaaggggcaaggctgtgacgtcgatgccggtgagcaaagcggggaaggtcgtgagggcgccggcccaatttgagctaggcatgctattggtggaggacaatgtgttagccgtgatgggtattgcttgccgagagctacataagcaatacatgaagctaagcaatgccaagcaaaaaatgagggtcatccatagttggacatcacgaccaccaaccgttcctatcatcgcctgcctatataactataggctttgatgacctcttcgacctttttaggatccggaagttggacactggtcttctaaaatgctactccttgtaagtgcataccttctatacttgtgatatgattggactatatctcctaattaaattagttctaatatgtaaatgttttaaggttgtgttggatcgagagtcgtcgccttggtaatcaggttgggttccttgatccatccatggtgaacgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcactgaaatcaccaaggccttaaatatggcttggggcccatatgtggaaaagggtggtaggcacaaggagggcaaggacgaactttatcatgacaccaagttcgcatgcgcacaacagatcgaagaccaatgtggtttccacgtgtgccacaacatgtcaacacttctaagagaggtgaaagatttcgaccctgaggttgttgctaatggcgaataagctcatttcaataccaacattgctattcaaaacgtgctaacctcttatttattaaacagaaaggtagaactggcttcaagatctcacccatcaaccccccccccccgctatcagaggcgaagtgtgcgccttcattcttgcagaaataatgaacaagaaaggacgttttcacgtcaaatagactcatgaatttggctagataatttattgtgacgtaaaaaagatgtttttataatttcttgtgatgtaaaaaaatatgtttttatcgagtgcaatgtaatttactttcatatgtgcaatatttatggtagtttactaaattgtcatcaaatttaatcaactacgatttacgttatactattcatttattttctcctttttttttcttattgacaggtcgtggaggtcgaggacattatgactttaatccatttggtaagtatatatgcggttctatgagcaatgaccgaaattgtggctttcaagaggtgtgaatttgctgtgcaaaattgtggcatttgaactgcatatgtgaatgatgtcaatttttgatatggatctgtgttgttggggatctgtgatatttgagatggatctgtgatgttatattggaggggtgactcgaatatatctgtgatgtatctgtgtttcagagggcatggctagcaaatcctgaggctagccaatattgagcatttattttttttctggaattaactcatcagtgacgggttggaacaaaaatccgtcaaaggtaaactcacctgtgacggactagcaaataaaggcctgtcagaggtgacctacctgtgatgggcctttacttttgaggccgtcacaggtagatcacttgtcacagcttctatctacggagaccatcacctctgacggcctttatttaaagggccgtcagagatgagtcacctgtgacgggtcccaactcgccctaggctagcggagaccaacacctctgacagccttctagtaacttgcccgtcagaggtgggtgtcacctgtgacggccggccacccgtcaaaggtgggtgtcacctgtgacggtcggccacccgtcaaaggtgactggactcatcagtgaccactgatcactgaccatgcgcgaagccgccaaagatgagggtttgggcccgtcacaggtgaccttggccagtgtagtgtagattagatggggctggtcatgggctgaagattagatgaaatattcctttttgtgactatcaacatgcatgcagttagctgattattaatgaagagttaactgccatgatgcctggaatttttagaagtgcattttcaggtgcctgtcatgcttttgacacaaatgaatacattgactttgccatattcttttggtgtgcagttttctgatatgtgatgtctacgggccttttgtttgctgcaccaaggatgcaaggaaacgtcttgtgttatacctgggaaagtgttgttactatatactccctcaattccaaattgatctctatatattttataggtacaccaaaaccaagaaaagctaataactctctcatactatatttactctagcaacaaactctatgcatgcaccatccccactatttcctagctaatagcaaatcaagatattgcatgtgggttataaatacttgtgtgcatggatgcatgcatcaatgtccatttactccaatgcacaaataacgaatatacttaatgaatgaacacaaatatatagatcatttagcaataacctaaaaaaactatatgtagatcaatttggaatggaggaagtagaactcttaaggaaaccaagctcaaattaatattaatgatttagctttagttaacatagttttatcttgttcaatttaatacttgttattgtgagagacatgtgcgtgttctaaactcaatgtgcattggcttctaatgttggttgcctgttctttttccaatactgtaacaattatgacatggattttgtagctggtcttcagtatcatttttaattttccaaaattttcatagttttctaggcttttttatgtatttttatgcattttcctgaaaattcagatttttgttgtgcagtatttcgaaatttctacgtgatatttgaattttttttaatgaaattataaaactgaagtgatatctcacggctcactattattgaaacacaccaatacacaaagatcccatggtggaggggattgacgaggggattgagtgttgggaggggatccacccaagtggtgtacgttttccctaggaaaaaaatcctccccacatacttatcaaacaaggtctccctagtagtgttttccctggaaaaatcctccccatataccgaacaaggtctcaatgagtgtttttgactaggaaggctttaccatcccggtccttgtaaatttatgagctgagattacaacagtttgcgtatctgttcatctagagctattcaatctcgtgtttctgactaggaagactttcccatcctgatccttgtaaatttatgagctgaaattacaatagattgaatatctcatcatctagaactattcagtctctagacgaactttatttagccttatcgatctgttactattaaatggtgacctctctctctagtggagtaaaggattgggggtctttgatattgctccgtatggctacgctgcaacctgcagttgcgttataaatacgttaattaacttgcaaccagcagtttaccaaacaaatataaacgttttcttttttgacaaaatatatataaacgtatttgcggcatcaaccgcagcatcattttctatggctggctactgtggctacagcgctgcactattgcagcacggccacagccagtgctctaacgagcaggtccattcgttacttcgataattaagctaatagatggggtaatcattatcataaaatccaaaaatgttgctatcaaaacaatttggctcatatatctcgctatttgaccgcctctttgttacttcatccgtttcacaatgtaagtcattctagcattttccacatttatattgatgctaacgaatttgtctagattcattaaagattcattagcattaatatgaatgtggaaaatactataatgacttacattgtgaaacggagggagtagaaccatagccacattgcccccatccttcccaaaatagtttgtggcagtggatcgacacttccatttttttcatctttcgtagtggattggacaccggaccgaccggtactacgtactctctggtttgtaatactttctccactccatttcatattataagatatctttatttttttaagtctattttttaagtttaatatatttatatagaaatatagcaatatctgtaacaccaaaatagtatcactaaatataattttgagaatattttatattgtatttgttttatattaaaaatgttgttacgttttcatacaaacttgattagaattacataagtttgatttaggaaatactaataacccttataatataaaacggaggagcactggtcggcttaaatatacaccaatatcttacattttagatggaggtaatataatttattttgtttggacttggtaaaacattagagtaacactttttcatatttaaatgaaataaaacatttaaatatatgtccaaagaacaacagcgtaatctattaaaaaaattaggggtgggtagatatgttatacacactctttttggcttcacacacacactcggacacacatctccaatcttgagcacacagccacacacacacacaccatatcgctcaagttccaatggaggtacaggaactagtaccgtcgccatggtcgtcgtcctcgtccttcctagtgctcgtgctggccaccttgctcttcgtcgccgccttcctccggcggcgacagggagcgcggcgcaagtacaacatcccgccggggcctcgcccatggccggtgatcggcaacctgaacctgatcggcgccctcccgtaccgctccatccgcgacctctcccggcggtacggcccgctcatgtccctccggttcggctccttccccgtcgtcgtgggctcgtcggtggacatggccaggtacttcctgagggccaacgacctggcgttcctggaccggccgaggacggccgccggcaggtacaccgtgtacaactacgccggcgtgctgtggtcgcactacggcgagtactggcgccaggcgcgccggctgtgggtcacggagctcctcagcgcgcggaggctggcgtcgacggagcacgtccgtgccgaggaggtgcgcgccatgctgcgcggcctgagccgccgcgcgggcgccggcaccgccgtggtgctcaaggagcacatgctcatggtgacgctcaacgtcatctcgcgcatggtgttcgggaagaagtacatcgtcgaggagggggagggttcgtcgccgacgacggcggaggagttcaggttagggttttaaatctccagctatagctgccgttatcttcggctataataagtttgagaagggctctagctattaatttgctctcatttataacttagccgctatatatagctccatttagcctggtcggtattgctgctgctataaactatttgagaagactaactgctaaatatcttagcccgttattcaaaacgttggttggttcaggtggatgatcgaggagatcttcttcctcaacggcgtgttcaacatcggcgacatggtcccgtggctggggtggctggacccgcaggggtacatcgggaggatgaagaggctgggcggcatgttcgaccggttcctggagcacatcctggacgagcacgtcgagcggcggcggcgagagggcgacgggttcgccgccagggacatggtcgacctgctgctgcagttcgccgacgatcccagcctcaaggttcccatccagcgggatggcgtcaaagcattcattctggtataactacttgtttcattattaaatatacttgacgttttatatatacttttatatatcaaaaacagaggaagtctatgctacaacatactgtttcaattcatccaagagaataaagcatatgcagtttttttttaaaaaaagatattaagattgtggttagaaatggttgcgtggttggttgagataggaagatgacggagaaattaaattaggagaggttatggttgattaagatgggagtatgtgctagtaaaagctttgtaagcatcttgaaaaaaaaataggtgaaaccccgcacattgctgcgagaatttactatgataacaataaaaaaataacttgtaagatagctagataacatcagattaagtaaattaatgtggtttataataatttaaatttaaatagtatgtagaatggtgattcaaacgtaaaaagtaaggttgtatgactttatggaagaagaaaaatagagagatagtttggacgtagattaatcatctaaaggttaaaaataattgatgtgatttgacttaattagaaaaaaaaagagaaagataatttgtaccatagattaatcatttaagcactaactaagtgagaatgaactatataagtatataggatatcattaaacataataaagatatacattgaaacattatgtgaattatgctggatgataatttaatatgtttgtatttgaaaagctcttaaattataaaaactataaagatatagcaagtttacatgatgtttaaatgtgatgattgttagtggatgatgatgtggcatcttgttaattagtggatgatgatgtgacatcttgtttagtgaatgatgatgtagcatctttgcatgttaagtttaaggagttagtgggggataactttatagtaagataggatttaaaactccaaatgttctaataaaagcgctagtaaaagcattgtaagcatctgaacatacttacatcgaccattaacaaaactattgaatactccgcgtgtttgtagcaagaaatttacaaaaatgttttggacagctcgtagaaaaaaattttgaaaatcacagtaaaaaaccaatttataactcatatattctttttttgacggtctaaccatcaaatgtaactataatatatttatagtgtaattatattataactaatatataatcataaatgtaatttagatgtaaattatatgtaactataaaaaacaagttagctcgctgatagtgatgggtgcctacgactaaaagatcacggattcgagtcttggcgcgtgtaagtggtttttgtttctcttgtcacatgcaggaatctcagctactccgttctttttgaagcagaataaaatcatgaatttatatgttaattaatgtggattgcacgatagtatttgtcatcttgtaaataatagtacatggattgttgtgatatccaaattaatgatgcgtggcggctgcaggagctgatcacgggcagcacggacacaacatcggtgtcggtggagtgggccatgtcggaggtcctgaggaatccgtccgtcctcgccagggccaccgacgagctggaccgcgtggtcggccgccgccgcctcgtcgccgagggcgacatccccaacctcccctacctcgacgccgtcgtcaaggagagcatgcggctccaccccgtcgtgccgctcctcgtcccgcgcgtctcccgcgaggacgccttctccgtctccgtcgccggcgccgccgctagctacgacatcccggcgggcacccgcgtgctcgtcaacgtgtgggccatcgggcgcgacccggcggtgtggggggacgacgcggaggagttccggccggagcggttcgccgccggcggggagcgcggcggcgtggacgtgaaggggcaggacttcgagctgctgccgtttgggtcggggcggcggatgtgcccggggttcggactggggttgaagatggtgcagctgacgctggcgaatctgctgcacggcttcgcgtggaggctccccggcggcgcggcggcggaggagctgagcatggaggagaagttcgggatatccgtctcccggttggtccagctcaaggccattcccgagcccaagctcccggcacatctctatgatgaataattcatgcactgacgggccgcatgcatgtatgctcgtatgtgcgctctctctctctctctctgagttcatagttatattttactgcagagtacttgtttatttatcgatctacacgcagatgataaacggagtacagtataatgaaaaaaagtttttctttttttttactgtacctttagatggtcctgggtcgtctactagttcagatccaaagaccagcgatataatttgttttttttaaacagtagacggtaggagatctaccggatatattagaagaagagagttgatcctgtttattaggaaaatcaggtcaaaaaccatacaactgtacagcttactaaaaggaaaccggcaaaaaaccttacacaaaagacacgaaaagcatgcgataaaactacaaaccacagtagtgaccgaggggagagcaataccttcaaggcgaagcctccaaggaggtgaacaacgacataagccactgtcgactcccgcccaaagaactaggctgggttttcacccaaagggagagagagtccacaaggcaacacctccaagaaggaaacggcgcccgcaggcatcgatgtcgccgatcctggaagaccagacaaggctttcgcttaagattccctcaaaggtgtagagcctataagaaaccagagtcaaagtgttaagtgttatcgttgcccagctcatcggctagacccgatgcagcaactccgactccgtcttaacacagaaactctagcattgtagagggcaagcaccccactcaaaactcggcactacgacaggttcatacagacacaggacacttaaagcatcggcgagacccaaaagccttgactacagacacactggaccccaaacacggacaaacacttctcctcaataaccgaaaggctccacgaccgggtctggagacggccaaaagaagagaggagcaccaaggagtgaaggagtcgtggccggcatgaaaaggaactgagagctgaagtcaggggcaacaaagaccactgtgtcttccatgattccggcaaggaactccggctatcgcgggacaatccttacgactgcagcaaccaccaccaacttcaccgccagcgcagagaaaggtacaccagggcgagcagaagagcaactaagaagaagcgatggtgagaggaagggaggaagggatgtggggtggggggaggaaggaaatgaggggcctcagcagctgccggcgatggccggaggaacagagaggaaaagagaaaggaggaagaaagcaaggaagaagaaacgggtggttgcagggacggcttccgcagttgccagcgacagggggggtggccggacgccaaactcgccaacccggagccgactgatgccgcgctgccacgcgggcactggcaatccgccgcccacgctccggcgcccgcacggccgagcatgaccgccacctcgtgagcagacttgcgcgacgatccggccgcctcgcaagtcgccagacgccgcagcagccgccgccagccgggccacctccgcttcacgccgccccacgacaccgccaccgacgcaccgtctagatccggcgacggcgtctagctgggatccctcgccgccgccactccccaccgccggcgaaaactccacctcccccatgcctgagaggggaaaccaccgcggtggagaagtaaattaggaaacaaattgcatgtcatttaataggtaaaatttgttggacaaacgagactaaatcagtcgattaggaggcacttgacgaggcggcggttagaagggacgatgcatcggcggttctgcgtaattcagatgaaggcgacgaccgtagtaataacattaaaggtttgcaacctcgccagcgcagggcaggctggaacaaggccattctactcgactgctcgtccttgccacactagtacagatccttctatctgtgacgggctctaatatgcttagaaatagcgggccgtcacaaggaagtcatctcaatcgggccgaaaagtgcccgattgagacatggccgcacagacatctcgaacgggcctcaagatggagcccgtcacaaatgaccatcatctgtgacgtgcaccaacttgaggcccgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataattttacgggtagtaaatgatttcaaatggaaaaaatgtcaacaacaaagttgtataacttatcaatatttacaacttttagtttggtcatttttcaatataacatttttttgaacagtttgaatttgaatttaaaaatatgacaacttcaaacaacattttcaaatactaaatgatttcaatggaaaaagtcatcaacaacaaagttgaataactcatcaagatctaaaacttttattttggttatttcttcatctgacgaaatgttattaatattattcacaaattttacatatatgtgttatagtttataaaaccagataagagatatgtcctttttataaacaatgttactatcactttgtcgtatgaagaaatgaccaaaataaaagttttagatcttgatgagttattcaactttgttgttgataactttttcagttgatatcatttagtatttgaaaatattgtttgaagttgttatattttcaaattcaaattcaaacggttcaaaaaatgttatatagaaaaatgaccaaaataaaagttatagattttgatgagttatacaactttgttgttgatgactttttcagttgaagtcgttcactgatctaaaattctatttgaactttttaaactttgaatttcaaatttaaaattgtttaaatagagtcagatggagaaatgaccaaaataaaaattttgcacctcgatgagttctacaactttggttttggtgacttttccatttgaaatcatttagtaaccccaatttgacatcctggcctagggcataataggattaatagaatactcataccaacatgttacaattacttttccagaagccaatctctaaagaattttgacgttaagtatgcttggtctggagcaattttgggatgggtgaccgaccgggaaatttgaaagcgtgggtgcacacgagtgagggctagccaaaaaatgaaatttatttaattttggaatatactcatctgtgatgggcattactcaaatttgaacttcctgcgtgggtgcacacgagtgagggctagccaaaaaatgaaatttatttatttttggaatatactcatctgtgatgggcattactctagcataagttaatgtaatgcccgtcacagatgattaatgcccgtcacagataagggtcatctgtataagggtcatctgtgacgggcgctagttgtggcccgattaagataggtcatctgtgacgggctatagtttgactggtcgtctgggtcaaaactatcggtgacgggctttacttatggcccgattgagatagaatcatgcgtgacggccgtttgcccgattgagatagctcttcacatcagtgacttctagcatgtgacggacgccatgcccgattgagatgggacttaccgcccgattaagatgagggtatccgttctagtgcctgctccaaaaatcccgcgttagccgttgcttagcactaggatgggcgcctgcgattggcggcgcggtaggaggggtggtgccgccatgcccgtgctcgcgcgaggggaaggagaccgatggcagatgatggccaagagcacgagattgtggcggtggccggccgtcctcctgcatcgtcaaatcatgatggattgttattggacctgcaaactcagcccgtttggtccatcatgaataagttcactttgactccattactctgaaccgcaaaactagatatcttatctctaaactgttaaaaccggtgcaatttgattccctcgacgattttaacgtggcatgttaaaaaaatcaaacttataatatgaaataaatagtcccatgaaaaaaaattagcagcccactcccaataacaaccagcaacccatagttctaagaagaaaagaaaaaaaataaaaatagcagaaaagcaaaataaaaataaaaaggggcaggcgaagagaggaaagagaagacgaaggagaagggagatcctcttcccgctctattcccttcccttcccttccttgccgacccccgtaatattcccttctcctcctcctcccgcttgctttcctttcccctcactctctctagctcgctcgctcccaccacctttctttgctttctttgaccaccaccattgtccccctccgctccacatgctgtggcgggcgctgtggtggtggcggcggtgggtcgccgtcgcgggcgcggtggcgtggttgttggcggcggcggtgcggccggcgggcgcggcgtggtgcatcgcgaggagcggggcggc

SEQ ID NO: 23045 - DNA, 7003 bp, Oryza sativa
  unsure (1)..(7003): unsure at all n locations
cctcctacgccttcaactccgtcttccagcgcgcccgcgccgcccccggcgcctgcgacttcgccggcaccgccaccatcaccctcaccgaccccagtcagtagtcctctcatctcctctaatcatccaccgccatgaaatccatccatgattactgtagtatcatcggttcattgtcctgcgtatccatccatctctgcttctcttttgcttttgcttttttgttttttgcttggtctccgagtatgtctgtctcttttgcttttttcctgcttcggtattaccattgccacactatactagtgctgctttggtagtagctgcttttcttttctgaagctttggtgttgtttcttgcaacgtctttgccgggttcgtacgattcatatccatctttctttctctagtttcctgtttgctaacttttctttctgttttctagtacgtaatcatgtgataaaccgataaagacaagcaatgtcagtcagcatctttttttgaaaaaacttttcgattgtttcttgtgtgctatctttgccttcccgctggtgataatcctgtagtatatcttcctttaatcttattgttgtagtgattaatcaggatctatctaagctaataatgctcactgccagtgccacaagagcatggatttcccttttcctgtttgttagttgttacattcattgcgcaatctgcaaattattctttgagaaaggaggagggaatgctttcaactccagttcaaatgaattcaactcaggccaatattattttcactattatttatgctccacaaaatcgatgactaactgtagatgagtccatgttataaaactgacataatgaagtgaagtggcagaacatacttaacatggctaatgtaaatctaatgacactactgcaaacacccgaacagaacaaaactgtattagggccatccatgtctattctaagctctttgtatttatgttaaaaatgatttttttcccttggggtaaatttggtgagacgtaaagaagtcagttcaagataccacttaatacttgatttgggggagaaaaaagtatgcatgactcttgtgctagttagaaccattgaggtggcagcctttctactattggtgttaacatgttgattgattggcttaaatgatgtttcctgacggagaatttcagataacgtattttctacaaaacaaaataccttcatcatgcaagtgcaacaggtgaatttatttatagccatcccaatttatcttcaatcctctttcgaagtgaaaaattgaataaaacacaccataattatacagtcagaaacgagtgatctacatggacatttttgtgattgtacatgcactcaaggtaagtttgtggtatgtatgtcttcaacaaaaacattcttaaggttctaagttctagacgttgattgctacctagcaccttctatatttctagcctacatgtttacatgcaattggcaatgtaacaaatgagttggatctgtaatggaagtattggaatcggaaataggtcttgaaattctcatatctaagttccctttcttctgatatagacatgtccttagtttttcctttttgtttctcttttagttttcttagtgcattgaggttgctttatattacatctactgtgtgcatccaatcatccatgctttcttgttatcttcttgagatctctcaaggtgcatactattttaactctgtgggtacttctctcggtttttttttttttttgcgaggtgaactgtgtgtacttactctgcttgttcctgtatttcaggctatggatcatgcacctacccagcatcaccaaggtacacgcatcacatattatcagtttattgatctgctccatatggagtacattggctgaacgttcatctagaaatcacatctcatataaccaagcaanatagtcttttagaagataaaattgagtaaaagcgcagcagcatacagagtgtctgagttgtatagatactagcttttagagctctctgatattcagttatttcacttcacagctattcttaactcccaccacaatggacagtgctcacttaattgcatgaattagacctgtacatcaaaataataatgccagttggtgtaactaatgggatttgaaagtaaacaccttttgtaaatgcattaagtccttaaagtgaaccaagtcagatccaagaaaaaagtttcattacagtgctctccttacagaaaatttctggttttccaaggacacagcctaatacacattgtcagtgtttgtacagaaaaaatcgtaatgatggtttattttttggtttagtatataactagttgggtggcccgcacaattgcgcggctagcacccatataaaattatatatttttaatataattttacttcaaatttattaaatagttatctcattgtcttaaaatttttaaagactaaaccttattatcctcgtgtttctattttttttagtttttaaaagtcacaacggttgctaccccttacttctgtcatattattctttatttgcttgcttgatctaccactagtttctatttattctccttggaacctttaaaaattggatcgaaaaacttataggtttagagtttattatcctgttcggcatcttttttataatttctagaagtcccgtcgaacactgccattatactcatctacgaccgtccactgcatcttctatttattgtcattgctattttaaaaattgaacataattatcgtttaggttcattttttttactttctagaagtttcggcaaaacgtcagcaactttgtcactgtactcctctacggctcacctgctgccgcccttctttattgtcgttgagattttaaaatcaaacaggattatcattggggtttttttttatttttttagaagccctaacctttaaaaattggaccttatagtttttaagtttattatcttgttgggttttatctttttataatttttagaaatcccgtcaaacgctgccaccatactcctatatgacccgtccgccacatactctttattgttattaggattctaaaagtcgaacataactatcattggaattcttttttttttactttctagaagacccaccaaccattggcgactttgccattgtactcctatacaacccgccgctgcctcttatttttattattattgagattttaaaaatcaaatatgactctcattggttttttttttactttctagaagtcgcgccacccgcctcgaccgattgcttcacgacctgtctgttgtaattccttttaatcgtcattacgattgtatttggtgttttattaatagtttttagatgtcccatcaaccgccaccactctgctcctctatagacctgttacttaattaatctcgtcatttgtttcatatggttttttcttttagtaatctttattttttatcaccaaatttagttatttataaattgtattcctagttgatatcttatttttctttttctcatttcagaatttatattatttttcgtattgtgttctttgatatttttatttttattttcagtttagttgttttaaaattgtattcctactttaactctctttttatttgcctaatttcagattatattttattttttattccgaattttagttaatctactattgggttcttatatgtactcttatttcaatattgtttatatttaattctaaattttagttaattttaaattatattcctacttgaactcatcttttcgtctcttttttctaattttgattttctttatttttattccgaattttaattaatatggacccttcttccaatattccttatttttaattccgaatttcagttatttttaaattgtattcctacttggacttttcttttcttttttttttgctaatttcagattttattttatttttattccgaattttaattaatctcgtattaggttcctatatggactcttctttcaatacttattatttttccgaatttcagctatttttaaattgtattcctacttagactctttctttttgctacggattttatttcatttttatttcgaattttgattaatgttgtattgggttcctatatgaaaatttctttcaatattgcttacttttaattctgaattttagctatttttaaattatatttctacttggactcttcttttcttttttttttctttttctccgattaatgtagaaatttctagcccccacagcgaacgtggtgccttctttcaagggtgttttaataatataatagatagatagatgttagtgaggttagcttgttaggatacacactacagccagacaacatggtttaacctgagttagaattcttgttttgagtaactcgaggaatattgtccaagggattgactattgatcaatccatgtatactcaaaagcgaaggggggacaccacaaaatagatttctgattgaaacaccaagtattcacaatcaaatttgatgtttattcgcaaacagttgtgtgaactctgcaaactactacaacattacaaaggaagtttagtatgaagctgtagttcttttctagaaaagaacctctgttcatttttaaatgtatttttgcctatcttttgtaaaatggaaaagtattttacgaaattgtattagaaatggattcactttgtgtagccgtgcattttatttattaatcgatgttttgagaaaaataaactgcatttatttttctgaaaaaaaaacatgtgcattttagcccttaatcgaccgacacgacacacatataaataagtttttattattctactgtgctttggattcaccagaaatcgtaacattcaaacctgtaatgttgctcaatcgcattacaaagcagatcaacagaaattacgttactgatgactaaaccgtaagacagttgaatataacaaaaagaaatagtcagtctgctgatcaaggtgagatctctgttttttttttctgtgcagcactgcagggcagtcaggatcaaccggcggcataccatcaccgccggccgccgacggcggtggcctgagccccccggacctcggctccagcgacgactctggcgccgccgcccgatcccgcctcgccgccgcgccattccttccccggcttgctctgtcctgtctcctcgtgtacttgctgcacacgcagcggtggtgatgaagggtgagagatttatatagcattgcatacattgttgcacaaagcggaatttgtaagaaaaagaacaccacatttttgttgatgggagacttggagagtagtggctcgtgtcgtgggcgtacgtagctagccgttggtgagaacctgcccccgttcaagctgaaaggggggctagagtgagtggcaacttggatcatgttggattcatatattctcttttgtttgtcaatctgtttgttgtttgagttttaagatttttcgtttagttttctagttttgcttttgcttctagttgtctagttactccaaaatatcaaataattctattttttaagtgtataataattaaaactgaattaattttgcgctaatggcttatacttattttgcatgcccttacttaatcctcatattcatgggttgcaaacaccacctaatgtgtgaaaccagcccaccacattgggccaattggcaggcaaattccttatttctcatgacccaaaaggacaatagatgtcaaataagattgtgtattttgttttctgttaaaatgatagtgtcaagggagcagcttagaatatgttcgccaaataggttaggaaatcatatctgcatccatttcaattttttaatcccacttctcataattcatgtcgaaacaagatttcggcaatactaaaaggggtggctatcaagctgaaaaagtggatgggttaagagacaaggaattttatacaagttcaggccttcttaatcaagaagtaataccctactcctgtccggagattgatccgccgagtatattattgatcgtatgatctgggtaaaaaaacgtgcccctagagacacccggacccttccttatataaaagaagaggtccgtattacaaaatacagtccatatccctaacggaataggtagttacaaataaaatacaatcgtaaccgactaggatctcaggtattaccttgacatacaagtttagaatttaacccgagtcattttaaagatattctatctatacatggcaccccatacccagtcggactatacatgccgtgtaggtatggggtatccataatctccacagtagcccctaagacctttacagtcaacgaaatagtcttctctcatgatccaaaacgataatccaagtactccgacttcttctcccctgatctcccgagtaccaaaatcaaagactgtgaaggtctgaaaatagaaaaaaccaggtgcatcgactagatgcacctaattaggtgtagcccccgactatgtgattagttaaaaaactaaacatatagtcaagatgcaaacaacatccaaccgagtggttttataaccgaatatcatacagcaaagaatatgcggcgttcaataaagcatccagccgaatgctttagctttaatatatcaaaaatggagatatgaagaggcctgagtgagaaacactctaaagatctataaatccacacatatgataagaatccgagtaaaaactcttaaaaagatccatcaaacgtggtataaatgtgataacataacaggtgatgagtctaaatagcctaggctatgactcacgccataatcaaaataagcatataacatgccgagtaaatgactgtattaaaaccagtcatctcaataaaacccaaacagcctttgcagcctaaaaaggtgtcacgcccggaaattcactagtaatttccgaacttatttgtgcataaaatcctcgtccaggaatcagccgaggtacacaaactgacaa

SEQ ID NO: 23046 - DNA, 9236 bp, Oryza sativa
  unsure (1)..(9236): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtgtgaaatagacttctaccattaaaaacgatataaaagtttgaattcatgagttggaaattagggttcccatggaaattcaaaatttttactagaaaagtttagaaagttcgagctgaaagtttgagtggtattgttgaaagttttacagtagattgctaaaggtaaaaaactcactgctcaattatccacagaaaataaaaaaacaatccctctatttatgtgttagcgatgctaaaaattaaggctgtcaaaagagaaactctaggctcgtgagccacttgagctcagctcattcaggcccagttcgggctcagctaaaacttcaaacaagcttaactttatatgacttacgctatttatttagcttgtttatttgttaattaaactaataggtaaaatatgtattagtactccctccgtttctaaatatttaacaccattgacttttttaaatatgtttgaccatacgtcttattcaaaaaataattaattattaatttttttcctatcatttgattcattgttaaatataatttatgtatacatatagttttacatatttcacaaaattttttttaataagacgaacagttaaacatgtgctaaaaagtcaacggtgtcaaatatttagaaacggaggaagtatatatgtacataatgattcagtttgtgtttgtaccatttttttattgatatgattagaaaaataattaattttatgaaaagcattcttaaaatatatgttatacacttatatactatatactacttactgcccagctcgactgcatgagctcaaattgagcctgcttaatagggaagtggattttttttcccttgagacaacatccccttgttttgtgcatggcgtttaaaaagttataaaaaattttaaaaaattatcaagatggatcaatatgtgatatatcttttcgcaaacatgcgagttaaaattaggcttatacaattcaaaacaaaaatgacaaatttgaccgtgaattacatgttctattaatagttaaatttgttatttttgtttctatttgtataagttaaatttgaatttgcatgtttataaaatgacatatcacattttgatctatcttattaattttttttatgaggagatatcttttttaagggatgaattgagttttaatagctccaatgcggaaataggccggacctagaactagggtttaatatttcgtttttttctccatttgtatcgaaggtgacaatattccaaaattatttttttaacaaaatttggtgaaatgtgaacaaataccgccaaattaaaaaaatcggttaaaataatatcattttttatgggggtggggttggggggaatttttttgaaaataatacgattttaatggaaaatcgcacaaatatatatcagtcagacaaaatcgcaagtttagcatcctatcgaacaaccgtggttcgacatggcacctatggaataaccacagttcgacaggtgataaaataatttttatgaaaggaaaaacactgtagcatcacacctatcgaacactacctgttcccttgttcgataggtccctaccgagtactgttgttcgacagtgtattaaacttgtaatttcctcccacccatctatatttgtgccattttccattagaatcgtattattttcaaaaaaaattcggggttggggggggggggggggtttgcggtgtgtggggtggtgaacttgctgacgagctggatcgagggcgccacgtggacagccctaccatcaacaaggcatcagcggcgtcacgtcatgctgaaaaaaacttgtgagccccatccccggaagcgacatttcactcgtagtactccgcaccaacacgcgcaagcatgaccaaagcatttttgtactcactatgcacaaggagctgatgagctggtcggggcactcctcggggtcctgcctctgcaccgacagcagcacgccgatcatgctcctcggcctcgccgccgccgccggcagctcacgcccgtcgccgtcgtgctccatctccttcctctggtcgtcgatcagcccctgcaggaacctcgtccggctctcgcgcagccgccacagccgccgccccacccctcccacgtccacccaccgcagcgccgccggcaggaagtcccacaccgtcgacgccccgctcagcgccatcgtctcctccaccatctccctgaaccacctcgcctcctcgctcacctcgccgtcgtcgtcgctgcacagagttataccagatccatggtggttaaccaaaagaacttacgagtcatgcatcatggtgatcttacgcgccgtagtaggtcttgtcgcagatcatggccatcatggtgttcatgagcagctcgaacagccgcgacttgagctccacccgcacgcgccctgcagccgccccggcgccgtggcgctggcgcgacgccgcgcggcagaggcgtcgcgccgtggcgcgcgcctcgcgggcgtgggcgccggcgaactgccgcacccggtgcgcggagaggatctcggcgacggcgacgcggcggacgtggcgccagtagggcccgtaggcggcggtgcccatggtggaccagccgtaggacaggatcccggccgacggcaggcgggggcggccggcgaacgcgacgtcgtgcgcgccgaggcactcctcggcggcgggcgcggacgacacgacgacggcgacgcggcgggatcccaggcggaggcggaacacggcgccgtggcgggcggcgaggcgcgccagggtgcggtggagcggcttcctgaagaggtgcaggtggccgacgagcgggaggcccggtggctccggcggcagccgcagccgcagcctcccgcttcgccggcgtcgtgcggtcagcagcagcaggaggaggacgagcgtgagagcgatgaggagagtggaggtgtccatggatctgggaactgacgattattgtagcagttgcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtatttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaatttgtatttataaaggcaaacgaatttaaaaccgactcatacacggatgacgtaccaaagtaccggcaaaaacctctttaatttttataatagtagagatttagagttttttcatctcatctctgaaatttcttttccctaacatttatttccttgttcatttttccttttagcgttcactcctacgcttggatatataatcctcatgtaccttgagatattacgtactccatctatcccaaaatatgagcagttttagctctaaatttaaacaataatatatttataggtaaaagttattatattttaggacgggcttagtagtcatggtcgatcataattgataagaagtactatcattaaaaatttacacatatcatcattggtatctaacagatatcattgttgataaattgatatttatcatcaccggtacctcacgtgtatcatcagtagtacgtacatgtatcatcgtatattcattggtgtttacatgtatcattaccagtacttcgcaagaatcattactgattcctacatttagagcgtccccagcagatctttcatccggtactccatccgaaatatagcgcatgagaggagaaaacggcgctccagcagatacggtatcaaggcctcaaaaaatagaggatgcaccaaatcagggagagttcggccaaatatggcgattctctctcctcacgccaaacctcatcgcccgcgctcctgcccacatccggagttccggatcaactttcctccatcgcaacctccctttcgtcgtcgcccggaggtatggaagtagagaggagagacttactggatctggcggcggaggctcggagtagaggcggaggcccgcccgcccgctcgccgccggctgccgttcctctgtcgcgacaccgccgcccgcgcccgtcactcctccgcccgcaaacccgccgcccgcgcctgcagccatgcggccgccgcccgtcgctcctccgcccgcaaggccgccgcccacgcccatcgctcctccacccgcgaccccgccgcctgcgcccacgaccccacggccgccgcccgtcgctcctctgcccgctccgccaccgcccgcgcccgtcgctcctccgcccgcgaccccgccgccgcgcctcgccgcccgaaaccctcgcccgtgaccccgctgcctccggttgtccgctgagggaagagaagaggagagcagtagtagagaagacaagaggagagcagaagaaaagagtagtagtagctgtacacgcggctgctatattgattttggaacgtttacaaacaaataacgattttacagtgtcccatatcattttatttgtgttgctatgattttttttttgctatgattcactcaattcaaatataccaattaaaaattaccagttaaaattatcactgttaaaattatcgtgataaatagcaccgcgttaaaatttagttgttcaaaatatatcccttaaaaatagaaatgtaaagttagttaaaagatattataaaaaattggatatggtatagatgatctgctggagtaggaaaggatacgagtgaggaatcttttttggatggctatccatatgggcatatggaggatgagatttggatgagctgctggagatgctcttatggtcattggtacctgcatgtatcattactcctacctacatgtactatctgttatccgatactactctgtcaaaaaaaaaacgaattcctagctatgaaccttgacacatataggattggtcttttttttaggacggaggggtaagcatcatcactcgtatttatatctatcagaatggatgttacggtatcatataggtgtcaccaccggtacctacaaacatcatcattggtatccgcaagtatgatcttctatatctatttatatcatcaccgatatttgacatacattattagacgacattgttagtgtatagaagtgcaaattttagggtcatatgtatcatcactttatataagcaaatgccatgatgtaggattgaatagtaagaactaagccaaccagaggggtggatgaatggatgtagtacctaaaaaccgaaacttttagcagaaataaaagttaccatcgaattcaatggagagctcgacgtaatcggtctaaccgccagatctactccaatctgactgcagtgccgccgctggtctgactgccgcattgtcgccgattggattgccttcctgccgccgcctcctcgctggttagaccgcctgtattacttcagtcaaaccgtcgggacctaggaaagcacgtatcgatgaaatacttaaaagtagatcaactttattgcatcaatatgtgtttacgaagtacaccaacaacactcatcaccaaaatctcgactaaactcgaaaccctaacttttctctcaactcaactctctcaaaaaccaatcccaagaggccacaccctccgtctctatttatatccaatataggcagcctaaagctacgaaccaaccttgtacaagacatcctaatccactagaaaacatgtccgtaaaaaaaaattaaactttactaactcgaattgtatcaaatttggacaccctccaaattcaactccgctttccatacgcacacaacaccacatgtattccatatggaaaccttcacctccacgtgcattcttctctagattgaacattccgcgtgatatccttgaccgcccggacctcaacctcccgatcctcccccaagcctagtcccgatccatcaccgactatactcccatggcctcaagcaacacttgcacatgaacaacaactaaactccatatccgagtacaagttcgcactacttgactcacatcagcacataatagcatcacatacaaaaagaaaccaactagaaatcatatccatgaagcaatctagaaatcccacgagaacaacccgaaattgattcccacctagagtctgccggtctaaccgtcgggcaacacgatcagatcgctccaacactaccggtctaaccggcggcacctgcccggtctaatcggccacacaaagtcgagaaacgaaaacactattcaccttatttttataaaataattacttttgacaattgttcatcaccatgattaaatcattacatgactctacaatccctccgtgatgaacacattggcaaaatcctcaaaatgcaatttggtgtttttaaaaaatgaaaaacaaaaacaaataaaaaaaacacaaacaactcaaaaatcacaaaagcaaaaaagaaaaactctctcctttttcaaaagaaagaatttcttcccatattggcaaacaaagcacaaaatcgactattttttaaaagcaaaacaattcaaatccccccggtgacttggtaacaaaaaaaaattcaaatctccccctttgaaagcatgcattttgtatatttctccccctttgacaatgatttcatcatgcatttgcattttaattagtaatgttcaagagcttagcatcatacatagagcaattcatgttatgtgttgtaatagaaagaagatgaacccatcaattaaatagcaggcatgcactagagtataatcatgaatcaaagatattactatcaagttcaaatcaacaatcaatattcataatttcaaataatttataatgcaatatattcacaagcacataggtttaaaagtcaagcctacacatatctttctcaatattagctctagcacaaaacaaccaatagaatttgtaacatttatttgagcctttttgttttactcatttttttctctcatttattctggaaacgtccttgtcatcaagactatttttgaggattcggcacccattattttcgctcacatcgaatacgtccttgttgtcaagactgtttccaaggattcagtattcattttttttctctcatagaaattattttattctcttgcacgatgagaaaataaagagcaatttgaggaataacaattcaacaatcatatacataagcattcatcatccaaactatgtactagcttcaacattgcatttttttcttaattcaagtaaaagaattagtgccatgcaccatctcacttaaaagcaatatctaagcctcataaaaacactaaaatgcatacacaagaatatacaaaatacatggcaaaatattatgaaccttcataatattgctagcatgcacaagaatatacaaaatgcataagacaaagctctccttttcttaattttttttgttattttcagatttgcttgataacaccaagagcaaccccccctctcaaattaaccttcaattttccccggacaaaaatcaagaaggaaacaaagcttttgaaaaagacacccaattgccaacaatatcaccaaggttctcatgaattgatatgtatctacttgtattaaccaaaactactacctcaaacactagcatacgaaaagctaataatcaag

SEQ ID NO: 23047 - DNA, 6754 bp, Oryza sativa
tctagaagttatatccataaagcaatctaaaaatcccacgaatccaacccgaaacctactcccacctagagtctgtcggttttctcatgtgatttggatcgaacgatgtatgcactagcgttgggacgtatccaaggtgtattgagaggcgtatcgtcgagtatcctgaattaatttttttttcaaaaatccagaaaaatacggatacatataggatacgtatcggagcatatctgatacgtattcgtatccgttcacgtatttgacacggatatgcaccttccatgacatatccaggtaacgtaggtgatcgaagaagagcatcaccaacacccaacggcttgtggcaagggatgaaataggagtaactggactgctcatttctgtattctacgtacagatttttcatgtaatctggaccacaatttggtcagattttgaaaatttcgatcaaatcagacattggtgttttcctttttataaaaaaaaatccaaaagaatttcttgggtctactatcactgccttgtgcacgcccttaattaagctccagcggcgctcatactcatttggatatgttttcacaaatccatgcatattttaaagctaaataaaatagatctgggtgccatgacgaagtgttgtgattcacgtttgtggaatcttggtagatcttggtgccatgacgaatgagtgattaagcatatatgccgtgtgaatcgaaatgacgaaccgaaaaaagtaaaagaaaatgtggatagatagaccacgcacccagcttcctatcgagaaaatttgagatacggacaaggagttgtcgtcgtagcaaggtcaatcacaaacaactagtcagtccagcaactcagggcttcaatcaatcgttactatctccccgggaagataatacttgtacttttagacaaggatcaggttaaactttaaaatctttgattataaattatttttaaaatatttatttttcaaatatgattactacatgtataaattagtgttaacacttttatacatattataatagaaaataatggtcaaagttattttttagaccgtgcttttatctaaaacgacaagtattatcaacccggcgagagtatatatgtggaatcgattggcaaatgcaaatctgcagggatcaggttctggtggagtctttagtgtgactactacaatttaaacagtcacgttgagactactgacacagtcacattgagactactgaaacgattgagatcgtttaagcactgttcatgaaaaaaaaaaacaccaggcatctactatgggagatggcgctatgccgctataacacttaatctacacctaggaaaatgaatggatgagatcacatgcagtgattaacttacggtcttgtgattgcattcgatctcaatccaatctgcagctaccagtacatcctactacgcaagtttcaaaatgattgaaaaacgagaggagtcacaggtaggtgtgttttaagaggaggaaaagagaaatgtagagaaggtactgaaaacaatatgatttattagcacatgattaattaactgttaattattttaaatttaaaataattaatatggttttaaagtaactcttttatatatatatatatatatatatatatatatatatttaaaaaaatactatttaatcgttaaaaaatgtacacgcaaaaaccgaggatcttttcactactacataacaccacatcaatgccagttgggaaccccacacaggaaccggcacaaaagaggcggcactgatgtgaatactcaaagatgccggtttaggtcccaagaatccaaaaaaaaaaaagggctcaatgcatcggctcgaacattgagtcgttccccttcaccccgagacccgtcaccccgagagatccaaagcaaatcacagatccctcaacaatttcatagaaacaatcaccgttgccgccacgtcgccggatccgtcgcgggagccaccgccgccactgctccgcccgccgatgccgatcccagatgcggctccgcccgccgttgccaccccagccacctcggctcgatttgggtgtcggttttttaattaaccgacacctataacatattataggtgctgatttttttaaaaaaccgacacaatatataataggtgtcggtttttattataattgcttaaaggtgtcagtttttttgcgatttcaacccgcggaggtaggaaaatgcctatatgccggttttaacactatcgacacctatagtggcgacacctatttaatgttttgtagtagtgtttcttgtctatcgacagtctcaaacaagtggtgaagaaaatgttacagaagtggcagggtgattataccggtcaaggtttaaatcacgtacacccaacatcctaattatttttatattttaacacagtattcaaaatgttactttgagcaaatttcacaaaacttcatatattttaaccaaactattgcaaaactatagatttaaagtgatacatcacaaaattacatatacaaatttatggtagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggtgtctataaatattatgcacgtgcgagtgcgttttcaatggaaatttagtgaagtcaaaaatttatcgctggtcttcgtctcgttaagagcattgtgtgtgtctgattgcggtgtgcgtgtgtcatccgtgcaatgaaaaaataacaaggaaagagagaagattgggaaaattgacaagtttcaaagttcaaactggcataccgtctacccatgtcccgcctaccgtcttcctccccgtcctcgttgcctccgcccgcccaagcacccatcggccatcgcagccttcaaaacaaacccgcgacggacgacgcccccgcccatggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgttttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctctagagtatctgatgccgctgcaacctggtctaggatgtgcacgcctaaagtttctctctgaagaacataagataatccatgcaaaatatttttccaatgcactaatactagacagatttctatatctgtataatagctctcatggttttcaccttttcctaattgtagcatattatatatgtagtgaatttccaatatatgagtctacaatatgcataacaatatttacatattcacaaccgttaaatttccgtcaaattccgattaatcgtccgtattccgattaatcgtttggcggtacccactctgtccaacatccgcattccgtcttccacaacactagttttgattatgttttcttgtaaggtttttttctatgaaattttctaggtttctcttgtgatgaaacttatattttgtatcattggtgatcattaccattaaaaagatgtgaacattagagaatgacctaatatcaaataattagtaattagaaggggtgaggcttcgaacccaggtcgtttagcccaccaccttgtggagctagccggaagacccccgggtgtttctcaatgatcattaccattcaacatcatggttcaaaattttcgaatttggattttcccacgcccaacagggattacctctggttgaaaaattttagtcgcttgaatttagcgggaatttgttcaaagtcagcaaaaatctgttcgaattttaaaatacagcactgaagtattttgccgagtcaaacactgtccaaatgcccacatgttcatgatacgacattatttttagttttaccttttgttctttttatcttttaccaacttcgacaacttcctttttgcttgtcaatactagttattcactcttacgaatatgaaggaaaagttgaatggtttgacatgccacaaatttgcttttaaatgtttaaccaatcgtaacttcctatttctcgtagaacttggctacattgcagttagcttaatttaatttcgtttaggttcggttggtgcttaaagtggagttgcgtgggaaatgtgaactggtaatggtagttcacatatactatatatatctgttattagacagcataaacttatcttgttgttttgtattttggaatatgtaatgcttaagatttatatttatactgtttcagttaatcttcttttgcgaaccaaaaaaaaaaagtgttactcacctaaactatgccgtttgcaggtgtaagaactcatgttgcagctgttgaacaagcagtggtacaagatgctattgcacagtcagaggctccagttgttgttgttacaggtgcttccaggggaattgggaaagccattgcattggcttttggaaaagccggctgcaaggttaacacttagtaattgatttatgcttatacatctatagaaattttatcaaaagggctgatgcttatctgagccactgcaactggcttatctgagttacagcaggctggaaacttaaatggttaatttatatattcaataggatcataggagtatcccaaatgactgttattgacaatctgaatagatgaattgatgaaaactttagttgcatgctaccctgtgaaagaaatttaccttttatttaccttcaagtttcatgattgtgaatcatgtaggtgcatctagaacaatacaaagaggattgtatctggaaaattgggttcaaatatttatctgttgcctagttgttatgctgaactagaataatttccctgagtataacacaagttttacaatcaaaggggaaaaaaaaactctacttacctttcaggtcttagtgaattatgctcggtcttcaacagatgctgaagaagtctgcaaagaggtaaagctttgtgttgactagttactttgttcatattttttttaaagcagcataacgtagatgatttgtaatacgagaataccacgaagcattaatttaaactaaaactgcgttatgttcttatctaaagtaaagagtaaatttcacaaaaccataaataatcaaaggaaaatacaattgaatgttgtttccggggtgcatgtgttttgaaaattttgttctgttgttctgccttaaatagatggaagaagatactgaggtttccgtattttacagattgaaggatttggtggtcaggcaattaccttccgaggagatgtttctaatgaagccgatgtggattctatgattaaagcagtaagcatagtccattcgtgatactctgtgatactggttttctctcttcaaatttctgaccacgattaatcatccaggctgttgatacatggggtacaattgatgtacttgtaaacaatgcaggtactcctagtggaatattatatcttttttttacacaaaaaaaacaatttattttacttttaagttttaaccctgaccattctgatattcaggaatcacacgggatacattgttgctgagaatgaagaaatctcagtggcaagatgtagttgatcttaatcttacgggcgtattcctttgcacacaggtactaatcacacattttctcatattttgtacttaaaatgctttatgcatcatactgcaaatgttttttttgcaggctgcgacaaaagtaatgatgaagaagaaaaaggtactccatatagttcatttctttaccagattgatatttgattgttttttaatatttttatattttttttcacgctgttctgtactgaacttcaatacggcaaatttgcaatatagggaagagttatcaacatagcatcagttgttggccttactggcaatcttggccaagttaattatgctgctgccaaggctgcagttattgggttaacaaaaacaactgctagggaatttgcaagcagaaatattacagtgagcacattttctttcattttattggttcaaa

SEQ ID NO: 23048 - DNA, 10023 bp, Oryza sativa
ggagtttattagagtagaagccttttcttttccgttggtcgtgtagacgctgcagcttcggaagatccgctcttcgtggaagttgaagccgacgtttgggaaagcgagcaaggcaagtcacatcatctttgaacatattgaatcccagtttataaaattatgttgatttaaattattgcattatcgctttatttaaattcccgcgttatcactgttttatttagccatgcctatttacctttgttatgaccttaatattgttattgttattatttccttgttcaccctagaataaacaaaaccccaactagtggacactctactcatggtaccactagtatgattttaggtagatgcttcgctgtttaattacgtaacattaggtgattttacaactctagactttgggatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtaatcgagatgtcatggcacagggccggtgtcctgctgctaggggctcagtcctgcctgcttgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttagttcttaaaacctgcttaacaactaaaaggtggaatggttggcctgggttggcttgggacgagctgggacccagggtcgggttgccagttcggtctgaatcatcgtaggctttgggttaaggcaggttcgtgtgggttcacggccttgattaataattgtatagttctagaatcgtgtttacaaaatagctttgagcaactaaatatctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggagcatgaaggctttggtgtctagctcgtgcctgccgtcaagtgcctgtagtcgtcgccctagttttccgctgtttctcgtttgtctttgtgtgtgctgggccttcgctgcccatgtaataaatgaactatttacgcttccgcttgttaaactctgaattgtatcaactcttggtgtaccttgcctcctgggacaaggaataatacacgcacgtaaggaacgcccgttgggttaattccggtcgtgacacgccgccgttccggtcgtcgtcgtcgctcgggaaggccaccgtcgggatcgccaagtcgtcgctgtcctcgtccgccgcttcaccatcgccgaagatcgccggagcaccgtcgccgccgtcgacccgatctccgccgccgtttcaacctcgtcgccgtcgccgtccgttgctcctccgccgctcctttggtcaccggtgagttcgccgcgtcgccctctacccgttggtgctctccgtttgtgccgaagcgccgccgttcgccagcgagcgtgtgccgtccgagccgccgagccgccgccgccggtggtgacgtcatcgccgacgtcatcgtcgccctctcccgtgagccggtcgtggaccgatcgatctcggccgtccgttttggatggatcgatctcggccgtccgttcccgtgaaccgttgccatgcacccggttcacagcgaaaccctagccgctgacgcaataaattcccttttccttttcaaaaataattcattattgcgtcataattcaattaaaatcaatataagtgttttaatccgatttatctttaaaaattcataactaattcatttgaactcagtttaatgtggttcaagttgcaaaaattatataaaataaagatctacatattaaaattatccataaattgaattaaatttatttaattctttataaatgggctttaattagatttaatcttgtaaaattcataataaattcatttgaagtcagaatgaggccgttcaagtctcataattcatctaaaattatgatctacatgtttgtttactttttatgtattgtttatttggtttttattagtcttttttctcgttttgcgtattagcttgtcgtttccgtcgttgcgaaggttcgcaagtgcgtcggaagtattcaagaagattaattgaagaccgattattgcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaactttcgtatagcatggttcattgcagagcaccagactgagaagtggcggagataagcccacgggggtcgctagggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagccttcatgctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagatatttagttgctcaaagctattttgtaaacacgattctagaactatacaattattaatcaaggccgtgaacccacacgaacctgccttaacccaaagcctacgatgattcagaccgaactggcaacccgaccctgggtcccagctcgtcccaagccaacccaggccaaccattccaccttttagttgttaagcaggttttaagaactaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaactcccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaggggacggtgtgaatccaattccacaatactccaacaattccaaagtgtccaggttatatgaatatcctaaagtctagagttgtaaaaccgcctaatgttacctaattaaacagcgaagcatctacctaaaatcatactagtggtaccatgagtagagtgtccactagttggggttttgtttattctagggtgaacaaggaaataataacaataacaatattaaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactctatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggtggcgcactcgcgccccgatggtcgccgccggcgaccaccggcgcggcggagcggcgcccgaaagaggggagggaagggggaagcgaatcggcggtccacggctcaccccgggtcgacggcgacgacgggaaggcggcggcgcggctcgggtagacggggacggcggcgttccggcgatcggcgaccgaaacggagaggtggacgaggtcggcgaggttgcggcgaacccgaaggaggcggcgccgaggcgggagagggttcggggcgacgacggcggcggaccggagctcggcggcgacggcggagagagagagcgacggcgcgagctcgattccgacggggagagagagcgacgagtggcggaaacggtggagggaggcacggggagcgtttatatagggttgggagtgagagagggcagtcggatgagggggaaacggccgcggaagatccggccgccattgatgcgccggcgaggttgaggggaaaagatcccgaacgaatccgatggagagagagagggaaaagtggggggaaagagggagggaatcacggggaatatttcccccctcttgattgcacgcggggcggacgggagcggcgggatttgcggcggcggcggcgctagggcacgggcgaggcggcgggagcggcgggaggaaggggatgacgggtgggccccacccgtcagcgagggtggcgggcgggcccgcccgtcagcggggagaggagagggagggggagggagctgggccgagccggcccaagagggggtggggggaaaaaaggactttttaggatttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcgaggatgtattttagagtcgttttgggacgcgacacggcggcgcacggctggagcgacggcggcgacggcggcgcgaagctacacggcgctagggcactacggacgatgagaggcgaaggcgagggtggcggcgggtagagaagagcttggggaaccttttaaaggggctcggaggcgacggcgaaggcccacggcggccggcgacgagaaggaaagatcggggtttgaaggaaagagaccgatccgattcgaactcgaatcaaacacattccaaaccgatttagccgatgtttccaaaggagaaaaggtagaggagatcccaaagattgtttcccctcaatcaatttcaccggaaacggctgcggcgcgaaactagggtttcgggcggcggcggcggcgcgaggagaacgacgaccctgacaggtggggcccgcctgtcagcgactgagagagaaaaggaaggagcgcgggctgactgggccgactaggccggggagggagagagaggaagagagaggttttgggccggctttcggcccaaagccaaaacagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcttctaggcttttaaaatcatttctaataattccttttaaacaacaatttataatttaaggattttaaacaagaaaaactcttaacaaatataattagatcattaatgatcaaataattactgaactgttctttgtatcatttaggaattgagctccgaaaaatccgagaaaatttcagagagttgacttaatcatggagaatttaataaaaattaaatccatccatgctttatattaaggaaattttatttcccacatttaactttacttgtaagttaatgaacatttaatataacttctaataataatttattaaataatttataaatcctgaaacaaaaatcaggatgtgataaaaggcctacaaaattagtataacacttttctgcgtcaaaaaggattttaacaacattgggctatattgtcgtgagcaagtgttgccgaagcaaaaacaaatgcttaagtccctaaggatcacaacttaaccacgctgatagcaaaactggctgaagtactgtttaggcccaggcccattagtactcccgataccctaaggaaataacaccggaagcaaagcgtcggttcgtcttccccgccaaaactctcgccactttcctcattctctgctacagtgcaaaaccacaccggcggagctagggttcacagattcgctccaatccagccttcaaagctccacgaaaatctcccacgcaaccaccgcatcaatctcccatccattcccagccacatttcgaaccaaatcacatcatccaattcgcatccatgacggaagagagagaaagctttgagagccagtgggcgccatccgacgtaacggaggaaaacctgaaggagatggtggcgcacggtgttcttccggccaaggagatcatcgggtggcgtccagcatacggcaaaatgtttccaacccccgacatacacgaggtggttgtattctcccatttcttttacggcgggttttctcttccaacctcaaacttcttctgaggaattctggatttctatggtattaacctgcatcacctaaatcccaattccatagtccacattgccaacttcatccacgcttgcgaagcttttctagggattaggccgcatttcgctctattccgccgcatcttctttctcaagccccagccaaacaagagcaaaccatgtgttgttgggggagccggttttcaactgagggggaccttgagccaaaaatacttctccatgccattcaagacctcgaacaaaggttggcatgcgaactggttctatgtacaaaaccccgagccagtgcttcccgggtactcttgtctgcctccggtatatcaagatacctggaattcgcttcccattggagatgaggcagcccaagcacttgcattgatggatcgcatgctgaggctcaaagagcaaggtctgcaaggagaacagatcacccagcattttataaaaagccgactagcgccaattaaagagagatcctgcacagcctttgaatttgacggcaagcatgaccccaaccgtgaagatccagattctcttgagtttaaagtcatgaaggagagaatgtacaaaatcttctcgaatgctatcgtggtcagttattcgcacttgctgctagtggtgccatacaacgccttcaaccctcctccaccggtatgtcttatacaactcagctattctcaaagcatacttttatcttctgtaaggtcaactgaaaacttggaatatcatgcacaggaattcgctttgatgaaatctgaccctccaattgctcaacgccgctcaccccgttggaagacaagccaggccagtggagggccaaaaatcaagcctgctgatcaatctgacacttcgaagttgactaatcagtctgactctcggaagaggaaattgatttcaagcgacgatgaaggtgatgatgcggaaaagatgggtaacaaaggggtgactggaaaatagtcaaagcaaaccaatccgaagaagaaaacgtccagtcgtcccatgcaaaaaataaggaagtcatccaggtatgtgtcatctagcaatttcttctgtttcgctagtcactcactattgaagcaaagctgatagcatgtctcaaatctgtagaaaaccatctgacatagatccctctggaaaagaccccacgtcaactgacacagagactggtccttcagcagaaactggactgactgccgaagaccgcccgggtaataatcaaccggcaaccgacaatgtagataccaacaacgagcccccgactggaaaccagtcagccgagactgaagtcagtgctgatcaggagcccccgactggaaaccagtcgggttcagaaccaaatagagatatcccagaagtagaagctcaagctaacaaccctcccaagacggacactggtgctagccctggaactagttctcctgttagggtgcaagaacctgctcgtcctcgactggaaattatcacaggtaaacacgtcctccaaacctgctttgatccgacaaactttcttcaattacttcactattattcatgactatctaagggccaatgattggcaatgaagaagaggtcctccggatacaatcggctgaagattctcgtccaccaatattagtcaagtgatgggatgatgaaatgcatccacagggaattgtaataaataagcaaaaggaagacgaggaagtatgcctgctgaaaaagacactcggccaagccactcgtcttgtaaatgtaggtctccctatatatagcctcaaccatcctgtcggtcactttagatgaacaaagataaatttgtggtgcagagaatccatcttaggaatgaggcgaagaccgcaaccctcgaaaaattagttcccccccttggaacccttgaatccaccagagaccagctacgcgaagctaaggagctcgccggggtgcag

SEQ ID NO: 23049 - DNA, 3268 bp, Oryza sativa
atttcccccctcttgattgcacgcggcgcgaacgggagcggcggcatttgcgggggcggcggcgctagggcacgggccaggcggcgggagcggcgggaggtaagggatgacgggtgggccccacctgtcagcgagggtggcgagcgggcccgcccgtcagcggcacgcgcgcggggaggaggccggatgggccgcgggggagaggagagagagggagggaggtgggccgagccggcccaagagggggaggggggaaaaagacttttttgggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaaattattctaggcataatttagaggatgtattttagggtcgttttgggacgcgacagtatagcatggttcattgcagagcaccggactgagaagtggcggagataagcccacgggggtcgctggggagtccatgcctctggtttttgagggggtgattatgatccaggaatggtgcactgtggttgattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggtgggttgagcaatgtttttcgtgattagtctcacacctctcacaataattatggatgttatacctggtaataatttgcttagctcctggtttggagttagatctgtacagccgggtatggttgttcaggatggttgagcctgtgcagcatgggtgtgctattcagtgttgattaaaatttctgattaatcactccactgtttttacttctcttaaaagttttgctaaatgttgtttttgcaaatgaacctatattatgccatcctttggtatctttgtgcacttgcatatttgctgtgtggcttgctgagtatgtcatatgctcaccttgcaataatcaatcaacctcagttgaagaataaggatccagaaggagaagacgtttggcttataccccagttgagctgcctgtgggagtggagccggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctttctctttcaacttgagtagttctgagacattgaaacttgaagacgccaatgaggtctacttaaacttatggaggccagtcaagtggatcgaggaagaaccgaagtgccaagtggtcaagatggaatgaagtttggatcctaccttagaacctatgccgccaaagtgtctttgaggaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtattaacctggttaaggtcttgtctttagtgtaacccctctccttctatcttctctaatatgcaacagatggtgaacactcgcgccaatggaagtggaaacaataacaatgaagggaacccaactcttgctcaagttctggctcaacagactcagttaatgaacatgatgatacagcagatgcagaaccagctcaaccaagggaacaacaatgctccaccgccgcagaacaagttagctgattttcttcgtgtgaggccacctaccttttctagcactaccaacccagtggaagcaggtgattggctatacgctgttgagaagaagttggaattgctccagtgcacggatcaggagaaagttgttttcgcttcacatcagttgcaaggacctgcatcagaatggtgggatcattttcggatgaacagagcagaaggacaaccaatcacttgggtggagttcacggaagcattcaagaagacacacatacctgtaggagttgtttctttgaagaagcgtgagttcaggacattgaagcaaaaggatcataccgtggcagagtatcttcatgagttcaatcgtctggcacgttatgctctagaagatgtgcgtactgacgaggaaaggcaggagaagttcctagaaggcctgaaggatgaactgtcagttacattgatctcccatgactatgttgattttcagcagctggttgacaaagcaattcgacttgaagacaagaagaacaggatggataaccgtaaacggagaatgactgtattccaggaggcacaaggtagtagctagaggcagcgtatcaagccactccaaattggtgaatcttcttccgctggtcaaggacagtcgcaacaattgaacatcgctggtgagatcaaattagagactaatgaaagcaatgaagataatgttgagcaagctactcaattagtgccagttcagcaggatcagtctcaagagaataacagtagtggaagggagcagcaggtatgtttcaactgttacaagccaggccactttgcaagagagtgtccgaagccgaagcgtcagcagccgcaaggtcaggtcaacaacattgtcgtcacaggagccaatacagtgccagttgcgtcttcaagagttgcgttttcaagtgttacagctcagccaccagtttcaaagcagcagtagttttctttaaagccttagaataattatcggagttatggaataagatagactgcagtttacctatgcccttttctttctagccgttccgaatctcgggacgagattctttgtaaggggggtagatttatcacatcctgatttttgtttcaggatttataaattatttaataaattattattagaa

SEQ ID NO: 23050 - DNA, 1477 bp, Oryza sativa
ttaacttacaagtgaagttaaatgtgggaaataaatttcctttaatataaagcatggatggatttaatttttattaaattctccatgattaagtcaactctttgaaattttctcggatttttcggagctcaattcctaaatgatacaaacaacagttcagtaattatttgatcattaatgatctaattatatttgttaagagtttttcttgtttaaaatccttaaattataaattgttgtttaaaaggaattattagaaatgattttaaaagcctagaagagaagatctaattttaatttgttaaatctcaatataaaattgggctagataaaattttgttaaatactttgcttaattctataattcctagatttttctaggatttatttgagctaaggaagtatttttaataaatggaattgcatttcatgaataatttaaattgaaaaaggtttttaaaagtctgttttggctttgggccgaaagccggcccaaaacctctctcttcctctctccctccccggcccagtcggcccagtcaacccgcgctccttccttttctctctcagtcgctgacaggcgggccccacctgtcagggtcgtcgttctcctcgcgccgccgccgccgcccgaaaccctagtttcgcgccgcagccgttcctttccaaatccggcgttcctttccgtttccggtgaaattgattgaggggaaacaatctttgggatctcctctaccttttctcctttggaaacatcggctaaatcggtttggaatgtgtttgattcgagttcgaatcggatcggtctctttccttcaaaccccgatctttccttctcgtcgccggccgccgtgggccttcgccgtcgcctccgagcccctttaaaaggttccccaagctcttctctacctgccgccaccctcgccttcgcctctcatcgtccgtagtgccctagcgccatgtagcttcgcgccgccgtcgccgccgtcgctccagccgtgcgccgccgccgttccggtcgtcgttgtcgctcgggaaggccaccgtcgggatcgccaagtcgtcgccgtcctcgtccgccgcttcgccatcgccgaagatcgccggagcaccatcgccgccgtcgacccgatctccgccgccgtttcaacctcgtcgccgtcgccgtccgttgctcctccgccgctcctttggtcaccggtgagttcgccgcgtcgccctctacccgttggtgctctccgttcgtgccgaagcgccgccgttcgccagcgagcgtgcgccgtccgagccgccgagccgccgccgccggtggtgacgtcatcgccgacgtcatcgtcgccctctcccgtgagccggtcgtggaccgatcgatttcggccgtccgttttggaaggatcgatttcggccggccggttccgtgaaccggtggtaagcacccggtttcactgcgaaaccctagccgctgacacaataaata

SEQ ID NO: 23051 - DNA, 1258 bp, Oryza sativa
  unsure (1)..(1258): unsure at all n locations
nnnnnnnnnnnnnnnnnnnnnnnnnnnnnnnnnnnnnnnnnnnnnnnnnnnnnnnnnttgcatgccacaagttatactaaggttggattatgcaactttaagttatcttaaatttacttaaaagaaccctctttccagaattccatgttctcctttttatgcttttcttttccaaatgaggttcagttttttcattcgtgatgtcaggccaactcgattgcacaacacttgggcaacaccaacgctataaattgacacctccaagagagttagttaaaaacaaatcctcctcttgattgcttcagaagaacagcagtgatgcaaacaaagcaaatgtccatctcatcatcaagacatcagcggagcagtagggtctcatactctaattgcatgtcacattgtatccattctttcctttcaaaaaaaaaacattgtatccgttcagaaaagataggtccaaagaattgctcttgttatctctactacttctcaagatatatgattgtatctgaatcatcttgcatacaatgtatcttgccatcacaaaaattattgaggcaaagctcaaggtataaaagaaaatgtgttcctgattttacagtactgtaaagtaactacaagtaacagtaacatccgacaaaattgtaccagtgcctatatattcatcttgctcaatcctctaatgcaaaatgtccaactttgatgttttcttttcaaatgaattcctaatatcgtcctcatggacaaaagagaagtggaaataatcagttgttcaagaacaacccaaatctctcaactggtatgtacgtgttgcgctcatgcaatgactcagacaaaagcaacgaaattcaacttgatcacgagcctacgtcagtacagtatgtacactgattaaaattgaatccttcgtgcccaaataatgcttgataatctgaaaacatctgcttcctttgtgattgctattctgattagcagctggtggatacaggattccagacaccttagccttcaatcctctcatagaaaagaaggtaagcctcgcgcttgagaacttcttctaaagagacttctgtgatatcggtatcacttgcacgaaaccatgaggaagagccattggtctgctgcggaggacttggtctcacataagcaacataatgccctgcatacatgctagggcccaggtgctcaacaaaaccaactagacgatagcgggaattatctctgtcctcagagctgaagattagagaaaataaagatg

SEQ ID NO: 23052 - DNA, 825 bp, Oryza sativa
aaattttaatgcctttcaacgtgaatatcacaatgatggatgtttctattaattagactgaataactgatttgtttgttaattacactcagtttcagagaggtcatcgagtaaaaccagcaagttctattgaaccacctgatgtccgaatcaaatctttcttatctgcactacttgccacaataaggattgggcagctggtttttctatccttatatgattcagttctcagctggctcccgtgcggcttcttttggagaagaggagggccacaagcccctgagcctgaatttagctggatctctgttatgggtgatcccgttattaacactgatggtaagtgttgctatcaatgctttcattttcagttattcctatctttatatggatcattaattgaatgaattgtttttattttaggaagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggatttttttggctagagagaaatgtagcttttggaaaacttgagtttatgcgcctgctgtatgcctatggtcctcttctcagcaccctttggacagatgatggttatgcacaaacgtttggagaccgtgtctacagagggctacacaaggatcc

SEQ ID NO: 23053 - DNA, 792 bp, Oryza sativa
cccatctcaattctcaaaccgagacggggattaggatcagagtctggattccgatactgtctctccgtccccttccccctacaactaccagatcgatcaatcaatcaatcaattaatctcttgttcttcttctttggacgctcggttgaatctcagcgagaagcgatgggatccgtggtgtcctccgcctacgccgcgctgcgctcgttcgtggacgcccgcattgagaaggtggggtggtgggcgtggcccatgggcgagcggcggcgagagcgtcccaagactgacgccgagttcgccgcccggattgcttggattattgaacagtcgaatcgctgcaatcaccggggtcgccgccaccgcgaggaggaagaggaggaggaggaggaccggccggtggggtggtgggcgtggctcatgggcgagcggcggcaagatcgtccccagaccgacgccgagttggccgcccggattgctcagtcgcatcgctgcaattaccggcatcctcgctaccggatcgataaacaacaatcgccacgggatcgatgaatatcccccatcgcttatggatgttatgttagtctaagtttttttttttcattttctgaaagcctagacgagatttcattaaggggttatttggttgatgcctaagcttaccataactaagcttaggcaagttgtatcatgtggcaaaagtatggctaagaaatagttagccacaagtgtggcaatgttagctctagttatctgagtatgacatgtgggacctaagggtaggaaagtgtggca

SEQ ID NO: 23054 - DNA, 701 bp, Oryza sativa
caaccatgtgttccaacaacaataagcagctgacacgtaaccagaacacacatcgggtgtgtttagttcacgttaaaattggaagttcggttgaaattgaaacgatgtgatggaaaagttagaagtttgtgtgtaggaaagttttgatgtgatggaaaagttgaaagtttgaagaaaaagtttataactgtacaactcgataactttttaaatataaatatttttcctttaaaaaaactccctctatctcaaatataagcatttctagctataaatctagataaacaattgtttaactttatagctagaaatgtttatattttaggacgaatatagtaacattttaaatatgaatatatttagctatgcattagtacattcagatgaatagctagaattgattttattttggattaggaaggagtatgaagttgagcggttggcttgaccgatgagtcggcgtgtgcaccgactggccgggccatcttattcgtggctgcatttttgccgtgttgctgcacaagaaagatcgaaagaaagagggctagctagctggctgggtggctggatggctgtctgtccgttcggccggttggatcggacaggtcgagtgagtgacagacgtacttaaaaaaaaaaaagacaaacctttatttccgtgtccaatgtttgactctccgtcttatttaaaaaaattataa

SEQ ID NO: 23055 - DNA, 1423 bp, Oryza sativa
cgtaccaccgccacgccgctggtggtggcgagacgccgccggcaagaagaggaggcgggcggacaagcggcggcggcgggtcgtcgtacagcgtcgagcactcgccgtcgccgtcgccgctgcacccctactccgacagcgggagcggcagctacggcggcggcctcgtcgccaactcccgcgccaagggcggcggcggcggcgccccgcgcggcaacgagacagtaagctagcttccctccgctccgctcgacctctccgccattgatgacgcttttgcaagcttcgtgaccttgttgttgtgatcgccaatggcagccgacgagggggtcggcggtgccgcggttcggcgactgggactcgaacccggcgtcggcggacggctacacgcacatcttcaacaaggtgagggaggagaagcagaccggccaggccgccgggaagccggcggcggggctcggcaagggcggcgccgccgccgccggccacggcaacgccgccaagcgataccacgacgacgacttcgcctccacggtgagccactccaccaaccaaccattgcacataggggcctcatttttagttgcttatatttatcagccaaaatttaaattttcaaccttaaatttagctgattttaaggttttttatcaaaatttattttttagcctttgcttttaaatcgctagaacacgtatataaaagttttattaacaaattattttttgtttgtaaatatagtgtttcacttattccgcgaataagcgaaacgatggctccgctaggttcttgatttcttttacatttctgatctcatttgagctctacatttttttttaatttgcagaagtgctcctgctttggatggtgcaaatagagatggattttgaggctgttatcaatgtacttgtaaattgcagagaatgggattttcgtttccccagtgcgattcatcagcttcgaaactgcatttggtcatagattatttatttggaagtggggaaatatacattacagtatagttcatgcctgctgtaatggtagattacgtattggattgtttggttccttctgtactggatttacatgcttgtaatggcaggttaaagcttgggctgtttcttgttcttatcgtcatttaatttgtcccttgtcaacacagaaagtccattatgcacgtattaatctatgaaactagatttctggtagatttggagttttttgttttttggatagctttttattgctgaagctggcagtctgctgcagagctcccttaatctgaagactgatgaacggtcgcatcacatgcactctgatcctcaaaagttctagaagcaatctgttctttttccttctgaatttacttaaacaaaacagtgtaaattgaattgcttgaaactattatcatacaaaaaagaaa

SEQ ID NO: 23056 - DNA, 594 bp, Oryza sativa
gaaaccagtactcatcattctctacatggtttcagaatatgtatccgctacatttgataattaggagcttcttttcttcaaggacctcagcatgtacttaagttaaccaacaatatggagaaaattttattagatgaggacaaggaggactcaacactctgagatatcttccagtggcaatagtaactgctacagagctttgccaagttaaatctgctgaactatcatgtttgtttaatacgtttgtgtagatatcctgaaggttttgttgtttctgcaattaatatatgaatcaaatccttagacattttctctatttagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaa

SEQ ID NO: 23057 - DNA, 1094 bp, Oryza sativa
  unsure (1)..(1094): unsure at all n locations
aagtttgtattttttaacaagcagtcaagcagattaaacatagataagattatatacaaaaagacaataattcagaataaaggttggagaaacattaaatgctcaagaacaccaccatcacatcattacacacgcgaaatacatanaagggatgtagcataatgnnnnnnnnnnnnnnnnnnnnnnnnnnnnnnctagaacaaatatgaaagcatattagttgatcaggacgagagtttgtgagaagataatatgacagtgtcaccaccttttcctggcattgctttggtgcagatggttcgttcactttcttagtagcaggaagggccgcattaacagggggttccctcttttggacaggttccctcttttgaacaggtttagcgctcgttgatatctccggtacagactttgggatctgtacagtactattcaactgaggccgctgaactccagacaatttttcacgaagatctggaactgatgatttcctcataacctgagtgttttgctgcaaatgtggtttctggtttccttggatatttctggaaggaactccagcttcaccgtgcaaaacgaaagtaatacagtaatggtaaatcatcatgcaggaagcaaaaatgaattgtatgtttagaaaatatactatgaatgtcccttacatgaactttgaactcccacagagtccatataaagttcacgtctccaagtcccatctgcctgacgaaacctgtccaaaccacaaagtagaagatataagcaataggattgtgtttgcttctgtgctcacaattaatctgggaacatataaaccaaccgatcataccaaccatttgtgaatcttacacatcaggtggaaacactgcagtgatgcagcaatttaaacatgacttaatgatgcgataactaaagacaacacaagaaaagtgacaatactatagtaactataccaaggcgtgcatgcatatagactggcagatagtgataaaggttagctgcagcaacaacagacgacacggctgtccaaaatgctacactctccacagtttcaaaacgaatttaaagcaaatgcagtattctaaccaggtcactgg

SEQ ID NO: 23058 - DNA, 853 bp, Oryza sativa
gaaaaatcattttaccatggctacaggaagcatgcttattttgccttaccggttcaattggaaaaacaataaataaaagtacatacagtatacagtgatccacaaactcttaaaaaggtcacagaaaaaaaaataaacagacaaaattactcagtacctggggtccatgaatggctccacatcaaggatctccttaaagctcacatgtccactcactttaagaggccccaaagatctgttgagttgaatgactaatacgggtggcagcttgctaataagacatgttagaatcgcaccttcattcctatcttgctgatcatattggttttcttccagttggtgtgcattatgacccagatttacttgattccccctttcctgatcttctatgctgatattttgacactggacactcaacaggttggcctgcttctcagtcagacggcagctagatgcatcttcttgagcacctccaaggcattcaggttttttattggctatgctgcaagaggacgagtctttttcaacagagctcatccctgaagtctctccacaagtttttatgtccactggcaggcatatcatgattttgtacaccagaaccatgtggctggctacttgaagaactgcattctacagaaagtctgatcaaatcgctagatagctccctttggcatgttttcctgtctgactgttcagcctggtctccataaaccgtcctattcacattggtacttgccatcatctgttcaccgtctttaccacttatagtgcttgccttctgggcaaccttggaacagttctcacaggtccactctatcatctctgattcaatatgcaacttcaagcactc

SEQ ID NO: 23059 - DNA, 1332 bp, Oryza sativa
tttaacggttaatttaaccgtccatgtcctcaattattatcaagaactcagtttcatccatcatccgacaccactttagcaagccatgatctttacccagagagtcaaaaggcagtaggttggcaatgcagtatctgaaattctgaatcatgttgcagcatataacagtggtatagattgtccatcacagaagaaaaaaatctggagtaaagctcatcgaatcaagtacgatctcacagagtgtgcgcacttagaagtacaatctcacagaaccgtaccaatgctgatatgatatacacaactttctcacttcattactcctgctttgtttttaagtttttctttttcgttcaaaaaaaccctaatatattcctcatggacaaaggaaaaaaaagaatgtgaatgactgtaaccagatcaaatgatcaagaacaccagctaatatccccaactaggtacgtacatgttggcaaagccctgcaaggactaaatatcattcagccacaacgacaaaactggacctgatcacgaacccacgtcagtatatacaatgattgggtcactgtccatccaaataaaccttgatactctcaaatatctgcttcatttgtgattgctcttcggattctttggtgtgtatagaattcaagacatgtcttacagtcttagcagcccattctctcatagaaaagaaggtaagcctcgcacttgagaacttcttctaaagagatttctttgatgtcgtcatcggttgcacaataccatgaggaagagccactgccctgctgctgattgtttgctctcacataagcaacgcactgcccaatatgaatgctgaggccacggttctcaatgacaccaactaaacgatagcgggaactgaatttgtcctcagaactgaagattagagaaagttaaaaaaatactatcaaaccagatacaaggaactaactcatcataggttgatgtcaacaacttgtctttgttgatcttatatcttaggaactgaatattgttaaaaagaaatctataccttatctaaaaaatacacctctattagatatgagtgaaagactggtatagatcatgttgaatgaataaccatgtaatgtgtttaaacatcgaccagctatttaaacagaacattggatatagattcacatatatccatggtagttaaaagcttcctttatctaaaaaaaaatatccatcatagcacttgcacttaaaaaccatgaaaatatatcaaacaagttggattcaaggtaccccattcaccctaaaatagaaaaagcagaaagcaatcatatactagttcagaattattcctaa

SEQ ID NO: 23060 - DNA, 12049 bp, Oryza sativa
gacggttcagattgatccaaacctacataaatatctgtagccaaaccctaaccctagattttatttccctccccacctccccactcgccccgatcccctctctccctcgaatcgaaaagcgatggcggccttacccccgtagtagcggcgacctcccccaccgagcagcgttggcggcgccctccccccacgagcggctactgtggcgcccttccccctctccccgcgagcggcggcggcggccgctccctccacgctgtctcgcctccctcgccggcagccgctccctctacactgtctcgccactctcgcccccttctcctctccctcggtggatacggcggcggttgcggcgggttgatggtggccgcgggcggatcggcggcggcttcctccacccccgtttgccttcctcccacggcaaaggcggcggcggccgcggtcggatccggcaacggcgactccctccgacggctgtggtggcgtcggcggcggttgcgacggccgaggacggctatggcaacggcggagggtggctgtggcgatggctggtggcggatccggcggcttcttcttttttatgtatatttttgtgaagttttgtgacgtattttgtgatttggtgattattgtggttgttttttttgggcaaagagtggttgagttttggttgtgtcgattttgggatgtgtttcctgtatccgactcagagctattgatttggaggctgcgaagacgccccgccaacggacgaaagcgccttcgtgatgaacagaaaaatccgataagataagatttgcttccttttttctgtgcagtagttttttactttgtgggagcctacataataaaataatagaaaaagaacaggaatataatgggtcggtttccatgttctgaaaagaaccggtctgttgtaaaaaaagaactggtcggttttaattttcccggtgaagaaaaaccactccttggttcgattagatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaaggattttgaatctgtctctgttttttttttgtttggcgacgcaatgaacacatgtgtgcgggacggaggatgccactcggatttacggacgataatttttgggtgacgattggaaaaatatcaatcttttaataattattattaattattattattattagttaagattaagatttctcgtccgtcaatccgtttcgtccgtgcgattcttccaatcgtcaatgtctgattttgtcgttggcgtgtaattttccgatcatcacagtataaaggaggggagcgccagaccaccacacatcgctcccccgttcaccaagaccaccaccaccttatccctttttcacgaccgcatctcccgcacacgcgcagtgatccggccgcttcccccgttgccgctctcttgtactaccagtacctgttgcctcgcctagctagctgctggcctggccggcgtcgcgtgccttcatggcctcgctcctacccagtccggtgttccccaccgccgccgccgccgcggcgtccacatcctcgtcctcgaggtgccggtgccggtgccgcatcacaacgtcatcttcggcgcacggttggtccaactgtcagggctggagactccatcaccgggtttgggccgcccaggctgctgatcagcaaggaggggtgcagcagcagcaacaacaagaagaaaatgaagacggtgtagtcgacagcaacgtgctcccctactgtagcatcaaccggaaggagaagaagactattggggagatggagcaggagtttctccaggcgctgcaggcccgtgccctgccctgcccttccctcttgttgaatccggctacctcctaccttacatacactatacttacaagtcaattgagtcacaatttaattcgattagattcctctttttccttctctttaggccttttattacgacaagaaggccgtaatgtcgaatgaggagttcgataacctcaaggaggagcttatgtgggaaggaagcagcgttgtgatgctaagtaagtggtataaaatattccttttcttctagcttgtacgagatcccggcccttactgtacactataagtgtgcatgccgctgaaaagaaaaagattattgttggaaattcagagataatcctatctatatccctgtagctagtttatttagctgctatcattttctggctgtctggttgcgcatgtcgtgtcatgcgccgtgatcggggcgtgtgggatggcacacactgagaaccgatcatggtgcactaaggtgtggatcgtggcgatttgcccatccgcatatatcgcaatggaagagaaacataaaatggccatcttatcgcagcacaaataccttgtgttctggatatactagttcatatcgtcttgtgttcgatatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccctagtaaccttatacttgctaaaatgtgtaatattaagtgctgtaaaaaatgaatgctattctaccttattatttaatatcagcgatagatttggggctccgctaattgtacttctcagtgctgtagcatggtaatgatgctaaagttgccttataaaaaacatgagttataaggctcagcattttgagttaaacggtaaattttagtaatttctatcatgatatttggttgtcagttagcttcagtgtaaaaatgagatttaaagatgaaaccatacatataaaagacatacattgtagcagtaatgtaaatccgagactgaacttacctgtcaatctgttattatttttttctcttggccagaaagagggaagtgaaatcgtacaagaaggtccaagatgcagtcttcgaagtcgaaaggttgggattgacttatttgttttattatactaattcatttttttttgtaaactgcagtttagttattacactaatctattgaacataacagatatggggaatttacaatagtaaagcttcagtttagcagccctaaaaagtagttagccaaatagcagtccattgttgtggaataaaaactgttgaacatgaaaagtacggtaagcaatttccattttgataagcatgctgcaatcatctggttaacaaaaagtattgtgtttaaattatgcctcttcgaagaactcggccccaaagggaaatacctccccagggtagtataattaagaagtatatgaaaccggggccaagaaaggtcacgaaagccaatcctcccgatgataaatcctaagctccattcgagacactcatggctatgattgacccgatctttcggtgagttgaatataactacgatttgggagaaacgttgacgaccccctacaaccgtacgagacattgttgtgttgcgccttagcgatcgatacatctctccgtgggttgttgatctagctggtgtagatcaaccttaatcctgcaagtagatcgaagaaacaagcaagaacaagctaaaagcaatctaaattgcaaataagaattgaatacaaatgataagttggggtttcgtaatgagcaaatcagcgatttaaccgatcacgggattacacagcaaagtagcgaaactaaactttaatataaacaaaaccctataaaccctgaaggggtacctagctatttaaggcggtgggttgacgacctaggggcccctagggtcgtgttccacctggttggggtccaccccacatgggcctcacttgggccagggtcccaaacaaagttacaagcccaaaggcccatgacaagtggcgcaataccttatttctctatttgccgatgacttgctaggaatttggagatgaggttggatctgttggaaagaggattccaaatgctttccatcaagtactcatggacccaaaacagagcttgtatgcacatttggcggtagtttgaagtcagcactgtagcaggtggccgaattagattccagaacttggtcaacttgatcttgatgtgagcgacggttgtattaatagtaaccatggtcacatctccctacatggggagcttcccctgtgtagatatctataagaatatttccagcaacatgctatgatctagtgtcaaaaaccatgtcatgtcaaaattaaaacaagaatagtttagcttagagaactattttgtagagacatgaccttattcacatcatcactattttgggtgctaatgtgatgctgtttagttaatctatcctggagtaacaaatttgttattttcgcaggtctacagtgacttgactgtcgattacttcaagatgttcctgctaaatgttccagcagcagttttagctctgacactgtgagaatcatatgacatgatgtcagagatacattttttttttgcattacgccatgtttaatatattttttcttgactagatttatggtcatttttcacttcgatgaagaatcattattgtttttggcagttttgtttatgtgtactaaatactgtgtttatatctaatctagatttcgtcttcacagattcttcttcctggatgatttgacaggttttgagatcacatatcttcttgaggttagttctaacaaattcaagataatataccaattgagatccatacagtactgctcactgacatgtgggcccgagggtctgtggggccctctctcataataatacttcttccttcccataataagttcatttttgcctcccatttgtcctaaaataagttcacttttaagcaatcattgtatcgtaatttgtgaaagtagggtataattgcactgggatttggtaaagtgagagtattataatcttttttggttttgtatttgtatgtgtgggatgggtaaaaaatgaacttattttaggatggagggagtagctaagtcaccaatatataatgtttctttagttctttacatgtataaaattctgaggatgttatatatatgacatcctcaggattttatacatgtaaagaattaaacatacattatagtcctataatttgttcactcacttgaatagattttgaaaagtcagaattaggtgcgacctttatacctctattttaccgtaatcaatgggccaggtggcagttaaagacgacgatttggctgcccggcttggtttgctgcatggacctaagtgcgcactaagacatgtgcatgatgggggggggggggtaattccagctaggaagtgagagttaggagtgatatgatggagggagtgaggggtcagaatttgtaatttgcataggagacaggaggggagggctgagggcaggcttgtttgggcccatctttccatagaagtaatgggtggtggatacatggttttcaatttcatcgtctcactcaagcacctgaattttgggaaagattgagcaccctctaaccactaccacatgcaccgcatgctttgctgcctctgcccctctgcatattgcatgcatactccatcctctctcccacttacccctcctctaaccacttcattagcaaattttaaatgtttttttctcctaaattacttatgcaatctacggtccaatttacatagttatatttgttgtaattaaatttttacaacaagatctcacatatgatttaatttttgatgaaaaaatagaaaatattatattccttattgaaatatttttatataatatatgaaacatcgagttgtaattgttgaaacatcacaaaatatttactgaaacatccaaaaaacaccatgtgcaacatttacaaatgaactagtgaaacattagaaaatactcattgaaacatccaaataacatcatgtgcaacataaaacagattcgttgcaacataaagacttaaaatgtgcaatacagttgaattcaaattgaaacattcacttgtacatgaaacatcaaattacaatggttgaaacatacatatatttttttcatcataatacaatcatgtacggtcttgttgtcgtgatttaattgcgatgaatacaacggtctaattggattgtagattagattattagtaatttaggagaaaaaaatatttgaaggttgcaaagggagcttcatgcatgtacagagagaggtcggtgcaggctgtgcacactgcacagggagagagagagtccatcagggtgaccaagcacaagcatttttgacatcaaagttatggtcggtggcctcatctaactttatttcaacagtacacaatttcataaatgagtagaagtagagcagaaatcacaaattattgtcacttacatcagaggtttgaggagatgattgccccttagggatgatagttgatagaatatatgaagtgttcatagattatatggtcctacaatacatgggccttgatataacatattagtccaacaacacaaggtcacggttcacaaccagttgggacatagatgtaggcatgctgcatcgaacattatgttcgctacctcttattagtgaccaagaataattgatggcgtatccgcatccgatgtaatattcatatctgatgctaattagagtacactgtattcatatccgatgtagtatctgacagtggtatggcactgtttgaaagcatccatgcaatgtgggccctcatacagtagaacgtgcatcatcaccagtaagggtaatatggaaagtatgggaatatagtgaggcacctatgggaggtagaaaagtaaaaataaaaaataaatggtttataatatagcagaaattgtgttggtctttttttcatgaacatcatttaccctctacataagcagagtaaatatctttaactgttctttgccaacctgctaatgtcattatgcttcttccatattttccaacaagctataagaaatatgttcacgaaacatcttccttgtaattggagtttggcttgttcaaataacgccattgttttaactgttgggcttcaattgatgatgccatacctgatatatgctttccatgccatgtatggatttttccagaaaataaatattatagcagtgccacgataaccatctaatagtaacctacaatgttgtttttgaatactgagcatggtagactcctgtaattctatatcatacgtcacttttggaacaaactgtctaattctacatcagaccttacagtggatctgatgccataaaacaaactttgttatttactgatttttttagataataaacattgttatttactgattacattcatgaatgatgcagttgccagagcctttcagtttcatcttcacatggtttgccgcactgcctctaatattttgggtagcacaggcaattacgagtgccatagtgaaggactttttaattttgaaggtattttcattgtcttatcatacatcgtgggcatgttaagtatggtacaaaatgacaaattttttgataactagggaccgtgcccgaactgtggcaatgaaaatctttccttctttgggactatactgtctgtgcctagcggtggtgcaagaaacagtgtgaaatgtgcaaagtatggatttgaaatctagtcctcggtttctgatgcattctatcttatattttaactaatgtggttactttgtatgtttatcagttgtagcagttcattggtatacgattctgcatcccgattgattacactcccagaaacagctgaggcttgattgaagatcacttcggtgagtcattaccctaatgacatgtctataaactgcatatttctggatacttttaagcatttgaactgttgataatgtgaaggctgaagatcatccaatagtttttacaaatgtaaaatttctggagaagagtaactgaatcaacaatttaaagaattaagtggggaagcatcatgtggaaatggtacactttttgcaaatttcatttcaactcggtctagaaattaccaagctaggacagacaaaatttctagtccaaattcaaacttaattggacagataaaaaaatacatacttactgaacaatgaacttgtcctctattttctgagtatttgttttattaaaatctagcaaatgaaattgattctcataataaaattttgcttgaatagaatatgtctaccctgtaattttttcaattttgttatgtatacctagggaaaattaaaattgcaacacttgtgctagtgtgtagttaggaaacatattgaatgtgaacgtggtaattaatgacagcttgcttggtggcatctaaaaaataagggagttggaaaatgccaacatatatgttattgacattccccacaggccattttcataggcgataatatcttgcagcttgtatcttttcgatggcattttccttattttctcttaataatatgaaaccccccaatttacattagcaggacaggagctgccccaaagcaattctttgtatctcccatggagagcaagatgaacttttcatcttgtgacaatcgtgttgtgaagcatccttttttatactccttagtctgcctctttaaatattgtatatatttgcatttattaaaagtttaagaaatagctatgactatatatactgtataaacactttggaaagtttatattgtacatgaactaaactgtcgtcatatcatgatgaatgtctgactggcccatgcttattgagtaaatgaagttagcagtacatgaagacgcaaggtatatgcaatagtgcacagactgatgcacgaacttgtgtactgcgtgcgaatcaaggccaaatgacataacagggctgattttaacgtctttgacaccacgtaatcggggtgggtctagttcgcggacgttcgtgggactcgaacagtcgataacctctttccttgttcgttctaatgatacggttaactatgaaatgcttcttttccgttataatgacatggttaaccatataatttgctcctatcgagcactagtatttcattgtttcagttagatgttgttccctcgcatgaaagctgtctgagatagatgttccctcgcatgaaagctgtctgagttggtctcactatatatacgatcagccactgaattgattctattagtggcaaccttgatgaagatttgaaagctagcatttaaaagactatatcggtctgtatatgtattcggttagcctcttttactttgggtatcaaggtgattaccctaaaattagggctaaaaattgggaactctctagcataaaattcattgaacataagcaataaatcatgcttgagaacatcccaaaattttcgctaaaattcagcgggaaagccatctggatctggcgccctatttgtttccatcccaaaaaccgcatctcttacttcctcctcggagagaggggcaataagatgatcattttctgcctccgacacttgggggatgtcatctaatttggaatcatctagggaaagggaacttacttccggtggtctaaaaaactttttatagaattttgtgatgtaatttttttgaagcatcgttcccctcaattttttcttcatcccggtctaggctaataatctgtttctttctatgtttgctattagcaatctagtgataatatttagtattattatcaccaagaagaacatcggtagatttagccctttgataccatttagtttcttctcccccaagtaggtgtgccaaccgatctctggattgaaagtgtctgtttccatattagctaggacatgactttctgcggtgatatcaagagtatcaatggtgtgttgcaattgtcctttctctatatgataaaagccactagtgttagttgcccagccttttagatggcgccataaggcattcatcttattgttccatctttggacagtgttttgccctttcaccggcttatcccatacctctatcactcgatcatgaaaatcttcccgcacttcaaaaatctcgcttgtgggtggtaatgacatgattgatgatgaagactctgtcccacagggcataccaagagcgtgttactgtgaaaacacggcggtctaggagatctacttaactccagtttaggtccaaggtttgcctcgattgctaaaggtgtacttgtattactgtactccagtaattttttaggctctctcgagtaaaaaagaaaatgttgatagtattactgtttatactatgttcggtgaaaacgatattattgggcattgtgatcgctgccaaagatatgaaaatgtgcacaaaacgtttttctggatcagctgctagtgatttgctgtggacccgatctccattctatttcttttcaactactcaatgtctccattcgttctaatgaatagtaagcttagcatgggactacgaatttagatatagttttgtccaaatttataattctacaatatgtcaaattcgattctaggttactatatattgagacggaggaagtactcacatgattattatcgagagaattatttgatccacatctctaaaaatgtttcttaaaaaaaatttcctaatgcattgtatgcatttcttgttctaatgcatttgttctaagtcgtttgttaagttatttatcaaaacatttagcttactaccccgtcccaaaatacaagcatttctagctatgaatttggacaattatgcgtctaaatttatagctaaaagttgctatattttctggatcagctgctagtgatgtgctgtggacccgatctccattctatttcttttcaactactcaatgtctccatttgttctactgtatagtaagcttagcatgggactatgaatttagatatagttttgtccaaatttataattctacaatatatcaaattcgattctaagttactatatattgagacggagggaatactcacatgattattattgagagaaaaatttgatccacgtctctaaaaatgtttcttaaaaaaaattcctaatgca

SEQ ID NO: 23061 - DNA, 2308 bp, Oryza sativa
  unsure (1)..(2308): unsure at all n locations
nnnnnnnnnnnnnnnnnnnnnnnnnnnnnnnnnnnnnnnnnnnnnnnnnnnnnagttcatcataaaacccacaattctttttgtttttatataaagactcaaacattgaatatcaggttgttttcagtccaggttggcatcgattagaggtagaatgaagatggtgaaagcgagcaacaagtttgtgccgatagattacagtagaatttagcatctcacatcacattgagtggctgtacagtagttaaatcatgaatcaattcacgatcgagtcagaacagcggtttgtaacacttgtaaaggaaggccattgttatagtgaacctcatgggtcatgccgtcatggaaaactagatattttccctttttcagaacccacaggagaaaaatgcacgccattacatacaaatcagatcagatgtagtcaatgagctaagaatcgtgttgtgcacttcttaccacattgttagcctacagggctaacaaacaaagactaaatgtctaactctaactactgctcaagttcttttgcacacaagatgaatgtgcaggagtggactagtgaggttcaggccagcagaaactaattaatcataatcagcaggagtagggaggtaaacacgatggaagctcttgatccctagactcttcctacaagtagggcatttcttctgagccttgagccatgcctggatgcatttctcgcagaagatatgaccgcaatttgtcgtggatggcttgtccagtttgttcagacacacaggacaggtaaaggttggttcctttggagcaaccttggcatgcgtcgtactggtttgggccacatttttcggctgcaaaggtgagagcatattatgagttgcatgtaggagtacaatactaagcattaagaaaacaatatacatacaccagccaatgcggaattgcaattatcatcacagtacaaagaagatcaacttaaaaagattaacaaccttgctggtcccttcttccctatctggagaaaggcatataacatgtacagcaccctgaaaatttctgccccgggaaaatatagctccagcaacgccataaccttggggaacagggaaaacagggaatcatgatgaacatttgtgaggtatgaatcataattattgtatatgttgtagtgtcttgtaataataatctataagacagtacaccgatgtactatcaagtttcagtttcacctacagtacagaactatgggttagaattaatggtgcacatttcttatgtcacttggaagtatccaaatgtttctgagtaacacaagacttccaaatagttcttttagactaagctatgtggagttcaaacataagtaatgtacttacctcccggaccagtatccttctccggatccactacagccacagagcgcctcataatttttctgctcctcctctatcaaaaagaaacatcagcttcagcttcttgtaaaggtttcagttattcattcgcttaattggagacagaagaaagcaaaagcttactttatcatctagagcttcaacatcgatgggtgaggtccgtgtacccctaaggatcagagcctcatgctggctcccagtgttcaccactggagcagttgtttccaagtttataacatcaactttttgtctggatccatcatgggctcgcttcctagagcgtgcagtacttgcagtactcatgattcttatgatatttggaataacctggaaatcagtgagccacaattacttattgctgaatcttcagcttaagtaccctaattcccttaacagtttctacaagaaatgcccattttttggcaacatgcacaagatttgcgtatcattgcattaaagatagataggcaccaaaaaaaacgcagattgcgatcctgggcacgccagaagagcaaaagagggggaaaaaaacaaaactgagaaccctggaaatttggaaggaagggaacaattcaacaatactttggcaaaacaagagtcgagatgagaaatgcctgcaagcactgggaaatttcaagtatgtggtatataaagaacctgtaaagatcatctaatcaggcaattctcatgctcctgccgacttaaaaaacttcttttttaggtgttgtcaaatatcaattacaatgatatcctctaatctcagctctctacgatctatacacacataactttatatcacatttcgcagaacttatcacaacacacagatgcgcaacaacaatcaagaaagaaagatttggggggaaacaaatgcttaccgagactgctaaacccctaaccctgatcaagagtgc

SEQ ID NO: 23062 - DNA, 37350 bp, Oryza sativa
  unsure (1)..(37350): unsure at all n locations
cggcgtggcggtggtacggcgaaccgccggcgtagggggtcgacgacgacgacggcggcgcgtcgctcagggcgcgctcgtgatggatcgccgtagaagaaggggctcggctcggcgatggcgcgccgatgaagcattaaaagacctccgggttgtcgacggggtcgttggggttgaacatcttgccggcggcggcgaccttgcccttgcgcgcgttctcgaagtagacggtgtacggcacgttgccgccattgtcccagttgccgaatttcggcacgtgcgcgttcttcttctgctgctgctgcataaatgcaaagctatatatgatcagccattgccgccatgcattttcttccccttctcacaattttggggattttttggcccgggcatgaaactatttcgcacgaaaaattcaaaaaaaaaatgcgtatgtggcaaaatgtatttaaattcgatcagaatttgtttaatgtttattttttttccgatccgaaatttaggtatactgagatagtggatcctgaatcccagtaactactatacagttttagtatactagatggtaaaacaaaaattagactataaaatatggtatatcacgatgtcttcttaagaattataaaaatcgctgacatgaccactgccacaattttaacctaaaaaagaacattttcttttgcatgtcagatcaacttctacaagaagccatatacaactacaaaaaaacagctgtgcgaattcatcaaacatatcgagattttgattttgttttcaaaagtcatactcataaggacattgctgaagtaaacattattgaacatgccaacttgacagagctgacttgctgaatcatgtactactgcctactacaagtggttgtaaatgagcagtctgaccagcaaaaaattagcaaaagaaaaatggagaccaggaactggtcaattgcacacacactgcatacatttgatgtatatggccggactaatcaaatggaacgtgctgattttctaatcggaattaatcaatcgttcacatgctgtggcttcaccacttggactgattaatcaggctggccagacaggaccgggctaatgcggcggttgggtgttcaggtctgacaattaatctcttttgtgtgccaatttgtcaaagcttctggagaaatgacagcgcaaggtaggtctaccttgctgacaccctacgtttgattaagattacaaaaagtgggagaaatttcaagtcaaagagacacagatgcatcatgcatgatgcatcccttatctcttcagttttggttatatacaaattcaatcttcaggttagaacagattttgaataatgtaatcgattaagggagaacaattgattatccaggacgtcgtattccagtgagttaagcagacaacatctatcttctatggcagtttgattaattgtggtatgaatactatggagacaatactacaacttaaatgtttattcacaaagaaaaaaaaacaacttaatgtgatggaaagatacatctcaaccatcaagaaagacttcttgcagatgaacacgtcaaggatattccttcgttcacacaagcaataagttattcataccattcaagttgagcaaactaggtggattcaagcagaacaagagcacaacaacagaggactttgttttccaagcgatgaaaccggtgttccaactaattaactagctaacactggatgacaagaaacaaaatcgtggtgatcctgttacggttctttcagaaaatccaggctcagatttcgcatccaaaaaccatggacagataaaaacgagttactctgaagttattaagaaagtgagaactgttccttcagaaatttcaggttcagatattgaaccagaaaaccatggacagatcaaacttagcctacgcctaacggtaaactgtggcagaaagagcgatggaagaacatggtcgcatgcaattgcaaggtatgcccatgcccaagaacagaagagcaagaagaaagagcaaagaaagcttaccgccatggccgacgaggagatcgatcgatcgatcagacgaggtagcagctagccgtcgaggaggaggggatgggtatgtatgcctcgtttcttcctccttggaaggcaggggctaagctagctagctatagctatagctaagcttagcttgtcgccaatggagtccttctcctctcctctctctcaggccggctggcttgcagctgcagcctgggattataaactccacgaaagggacccagaaggcccagccaagtcgcttctttgctatgtaccctctcatttctctgattttgcttaatagtcctcgtaattaatgtcacttcaagtcttccctagtctctcttgatgatgattaatatttaatcgttgcaatttttcagtggttatggaagatggcaacacctactccctctggttatataattgacaagttttaaataatgatacggtctctgatatatatctttaaccatgtccttctattataatatatgtatcacaagtttttgttttattataatactttgtaaattaaatctatatatgttattctagtgtatttaaaataaataaacttaaaactattgatacttaaagttataaatatttaaccttaattttgtttaacacatcgaaaccggaagaaaaactactacttcctccatttcatattttaagtcgtttttttctaatcaaacttctttacgttttaaaaaaatagtaacatatgtaatatcaaattagtttagtttagttaaatataacattggatatatttttataatatgattgtttgtgttgaaaatactattatattgtttttataaacttgtatatgtaacggagggagtacttcaatagttcactgcttatcgccagtaggtagcaattataaggccgcgtctgcatatagatccttatcatagagccaagttcatttcacgaaaatagtcaaaatataaggggtcttagtgaaaaaatattggtcagatggagcagttgactagcacactatagctcgaacgatttaacaataacaccttaaaccaaagttggccatctttgaccattcgccggctcgccaactccatcgctgtcttcttcctctagcttcccaatcgacggatggattgttcgatgcttccaagctaaacacctccatctcattctcattttttttctttgtttactcgaactaaccacacgattaattctgtcctgttctatatgcatacgtacactgctgcaacctattcgtaattaattaacaagttaatttaaccatcatctggtcccatccggcgactctttcctccctgattcaacggtgagattaccggcgatcaatcgatcgattgatcaaccggtcgttgcaccggccgtcctcttgctgcgacgacgacgacgacgaggagacgcatggatggatggcaagtcaatgctcccgcgtaagtgtagatacaagtggactgcacggttggttggtacaacaagtgccttgagttgaatggtctcctcctctcctctccattgaccacctctaccttgcatagtcaaactgtgcattgacccccatttcatttatgtagtttggtttcttgctcactgtcaaattcaagggatttaactttatgcattgtttgaatttggttcctagggcttgtttggatttaggctaatttatgtcttaccaaatttttggtagtttcaaccgtactttatggatgtttggtttgatatcaaatgttcgccatactagtataaattgtattgtactctctccgtttcaggttataaaatattttgactttagtcaaagtcaaactgttttaagtttgactaagtttatagataaatatattaatatttataatactaaattagtttcatcaaattaataattgaatatattttcataataaatttgtcttgggctgaaaatgttaccacttttttctacaaacttgattaaacttaaaacagtttgactttgacaaagtcaaaatgtcttgtaacctgaaatgaagggagtagcagtttgactcccaatattttggtatggcaaaatttgggttcaaaccaaacaagcgcttagatttgtggagccaattgagctgggctaattttgggccagaatataagtttcagctattttacttgatgggctttaattttcaaagtccagcccagttaggcccaagcccattatattatttcccctctaaaaaaaatggaaaattaatgttttttttccctttgaaggaaaatttccgaggaacacctccacgtcgcccccttttcccattccgcctcctccggcctctccaccgctgcccccctcgccgccgacgaaaaccctagcggcatcgcctccgccgccgccgcgatgtactccgatagtgtctccgggcggaagcgctccgtcatggaccgcctcggatcgggcggcggtggcggtggcggtggcggtggcggtggcggtggaggcggcggaggctctcgcccgcggcctgactccgtgaagaggtgcgacttcgagctcgctataggctcaaatcgtcgcttgctttttgtctctgtacatgcgctgctagatgttacgggcttgcgactcgtggttggatcgtatggggatcgaggtgggtttgggaaatgccgcttagggcgtggaaattagggagttcgtggcttcgtgcgtggtgattgtagctttagggcgcacttaaatgagcattttgcatgttgattccaggttgacccacttagaggggagacatgtggttgcgaccagcggattgattagtcagactgagaggaaaatgtgtttatttttgtcttactgcaaatgtgatagccagtgacctggttagaatactgcatttgctttaaattcgttttgaaactgtggagagtgtagcattttggacagccgtgtcgtctgttgttgctgcagctaacctttatcactatctgccagtctatatgcatgcacgccttggtatagttactatagtattgtcacttttcttgtgttgtctttagttatcgcatcattaagtcatgtttaaattggctgcatcactgcagtttttccacctgatgtgtaagatttcacaaatggtgggtatgatcggtgggtttatatgttcccagattaattggtgagcacagaaagcaaacacattcctattgcttatatcttgtactttgggggtttggacgggtttcgtcaggcagatgggactgggaagacgtgaactttttctgggacctttgggggagttccaaagttccatgtaagggacatttcatagtatattttctaacaatacaattcattttggcttcctggcatgatgatttaccattactgtattactttcgtttgcacggtgaagctggagttccctccagaaatatccaaggaaaccagaaaccacatttgcagcaaaacactcaggttatgaggaaatcatcagttccagatctttcgtgaaaaattgttctggagttcaagcggcctcagttgaatagtactgtacagatcccaaagtctgtaccgggagatatcaacgagcgctaaacctgtttcaaaagagggaaccctgtccaaaagagggaaccccctgttaatgcggcccttcctgctactaagaaagtgaacgaaccatctgcaccaaagcaatgccaggaaaaggtggtgacactgtcatattatcttctcacaaactctcgtcctgatcaactaatatgctttcatatttgttctagactaatgggacaataatgtatcattatgctacatcccttttatgtatttcgcgtgtgtaatgatgtgatggtggtgttcttgagcatttaatgtttctccaacctttattctgaattattgtctttttgtatataatcttatctatgtttaatctgcttgactgcttgttaaaaaatacaaacttcatctgcatagtattgtaccaatgtaattatctgtccagatgcttttatgattactttgggtttcatcattaaatattatcagttgaacattttaataatgtgtttgtttaaaatgtgcagactgattcctctcttgatagattactgaagtctcttgatgtagagaagtactcaataaattttcaggctgaagaggcatgtttgacttatttgggtattcaagtttttcatgtgttactagcctactacattttgttaatgcttaatcatttttcaggttgatatgaaggctctgcttcacatgaatgaggaagacatgaagtctttaggaattccaatggtactgtacgaatttggattggaactttgttttacatgcaggagctagtccattctttattattatttttttttcaaatgagtgtctagatgcctctgtattgccacctttcctactgtcataattttaaatatgcaagttggtagagcaggtttaagttatataacttccctgaagagtgaggattaacttgatttaatcccctattctcctgtgtgtttgggtgagctggggtggggctaggggttgtcttgcagaattattactaagatgtttcaaattatttagaattatgatgcattctttataagctacctgtctctcttttgacatcttgttagatagtataatctagatcggttactaatccaaatttctagtagcttttaatagagttaaatgatgattctctaaaatgaatgaagtggtataagtactgtcatatgtgcctttgtgtaccttttgcatctttcagattttatcctagggtttagtgttccactaatgatatttcatagatgacatgcgtctggttgcagacaaagcaagtacaagtggttatctcctgtgtgttatttccccctgttttcttttgtatatatagctaagtattccttcactttggttttttattatttcgtaaaaacttcataaatgttggctttgctaactgcctataagctctaaaatttagcaattccggtgtgcccttggtagatgcatgtcggtgatctttcttgtctatggtatgcgtgcatgccgtaacgaaactgaacaattgctagagtgtccattgtgtactagtgtacaactatccttccgattgcaatctacttacatatatttatttttcaagtttgtcagcctttatgagtagcgatatcattgagttttgcagcattatatgccttgattttgtgtccatatttattagatatcttgatttgttttcaggggcctcggaaaaagatattgtcagcattggcttccaagaagaagaaattatcaaaatcattacctaccagttgaatagttgatgcatctttaaacgtagtagctagatgacatgttgatttggatgtgtgcactgccaggatcaacccaagtaaccccatttcttgtataagatttccatcgagatgatgtacaaatagagaactgtgatctagcagtgctgttgtgaggcaattaacagcttgtcaataggagttatgttctgatattatgcggatatttagatgccaacatatgatgcatcggaattattttcccgtatcatgtaaacccagcccattattagcgtgcacagctagggagataaggagattttatttgtatcggcttttgggggtttccgtgggtttgtgcatcttttccttaacttgtcatttatcttttcgctttattcatagtcagctaatgtgctcaggtggagccgtggagctgtgaggttgaatgagatgtctcactcatttcttttggttagcaaactggtgcatgcttgtcgtctgctttctgtattttggatgcctgcttccaaattggaagatggaaaagctttactccgaccgatgcgtgaatgtttggagtaatctgaatatagcgatgattccgaacacttgtagcaatgcagatttcatgatctctggagattcaaaactgctgttctgccatgaccttccaacgttttggctcgaatttacaatgaagattcaaacaggttaaggtttcactagaaaatttagtcgaagttgaaatacatgtacacgatatatttctccgtagcttcaagccttcaagacactgggggagagaaggtacttgccaagttgcattctccatgacctcaaatataggtcatgctattgctgttgatgacgatgagggcaagtaacatgatgcttaatgtgttgcccctaaaaatggcatgtaggattggatgatgaggtggcagtaataattgagaaaagagaaggtgcgccacctctcatgcaaggggcaacctccatataaacccgaagaaaaaggaaatgaacgaaaaaggggattggacaaacaaataaaataaaattatttgggttataatgatagaggtggtgtagatgtggtgtattattttcccttatatatatcacctcttatcttacatggataaaattagatgtgacaactacctgtactataaaacttgccctgacgcggtttctgtaggtggggcccactgtcggtgagacaaagggtgggatttggtgggctccgtttgtctcggcacaggaggagaaaacaaaaaaaggataagtacatgttggctccctcaaaaagtataggttgaatataatttatatcgcttaacgagaatatttgatattctggttaagagatattgaatcatattcgacctatatttgagggtgtcgacgccaaatcagttaaagccacctacaaaaccaccgatgaagtcaaatcgtactggtattgtcaagatatctggtatactactccctccgtttctaaatatttgacatcgttaacttttttaaaacatgtttgaccgttcgtcttattaaaaaaattaagtaattattaattcttttcctatcattcgatttattgttaaatatacttttatgtatacatatagttttatatatttcacaaaagtttttgaataaggcgaacagtcaagcatatgctaaaaagtcaacggtgttaaatatttagaaacggagagagtacaattctggttgagggatatgaattaaattctacctataactctagggagcctaagtggacttattccaaaggaaaaaaggagtgggtttcggcccatctcaattctcaaaccgagacggggattaggatcagagtctggattccgatacggcctctccgtccccttccccctacaactaccagatcgatcaatcaatcaatcaattaatctcttgttcttcttctttggacgctcggttgaatctcagcgagaagcgatgggatccgtggtgtcctccgcctacgccgcgctgcgctcgttcgtggacgcccgcattgagaaggtggggtggtgggcgtggcccatgggcgagcggcggcgagagcgtcccaagactgacgccgagttcgccgcccggattgcttggattattgaacagtcgaatcgctgcaatcaccggggtcgccgccaccgcgaggaggaagaggaggaggaggaggagcggccggtggggtggtgggcgtggctcatgggcgagcggcggcaagatcgtccccagaccgacgccgagttggccgcccggattgctcagtcgcatcgctgcaattaccggcatcctcgctaccggatcgataaacaacaatcgccacgggatcgatgaatatcccccatcgcttatggatgttatgttagtctaagtttttttttttcattttctgaaagcctagacgagatttcattaaggggttatttggttgatgcctaagcttaccataactaagcttaggcaagttgtatcatgtggcaaaagtatggctaagaaatagttagccacaagtgtggcaatgttagctctagttatctgagtatgacatgtgggacctaagggtaggaaagtgtggcatgacacaactgtggcattgaaaaaacacagacaatgaaaagactcataaaatttctgaaagaggtgattctcagagtcctgcttcagaattggaagatgtgttcttggtgaaaacatcaaagcctttaaaagttggtaagcttatatgctcatgtgcttaattaaaggaagggaaaacaatgctcaacagtcctacaatgtgcatgctgtctcagaagtcagaacatagaacttttcatgaatgagcacagcaacctttgatagtaccagtattgtttgttagtttttgctcaagataagaaaaagggcattttctggaacggcgctgtcgtgctagcttcatgaagaaaaatgtttaaagacttgattcatacatggactgcacaacaggatgtttacattagcaggatgtttcggcagttttaacatggcatagctttttgttacaagtgtggcaataattatcactaagggaaaatagctcagggttttgagtccttgttttcgtataataatttttttctccaaattgttggttaacttaagtacatgtggagatctttgaagaaaagaagcttcgaataatcaaatgtagaggataaaggttctcaaaccttgtagagaatgaagattgctggtttcatgaagtagctgttgaggacaaaactaaaaatttatatgcttgattctgcagattctaccaaagtggaacagatatctcatagcaaggatgctataggtggtcctttgcagactagaaaggataaggtccaaggaaaggttgttgatgctcttcctcagaaagtgttgtgtgatgccaaagttgatggaatggatgcagcaacagcagattcccgcattccagaagatcgtgcttcaccatcatttgtttctccactaagcgaagagaatgcactgatagcatcaggcagtgatgtaaagataaatgacagtgctgttcaaccagaagttagtacagaagccaagatgaccgcctcctcagcaaaagttactacaaaagacaaggggaaaactcagattagcgatgttgtttatgacaaggcacatgatatcaactctcttgcatcgattgagaaatgcttggaattgtatcttgaaacagaggagagagaatgggcctgtgagaactgctccaaagttgttgagaagccaggcatcatgtcaagtaccaaggaggacacaacagctggagaccagagtgaacagtcagagaagagtgcataccaagtggaagaaaaccaaaatgagcagaaagataagaatgaatgtcccattcaaacacgtcttattcgcaagttgccacctgtattaaccattcatctgatgagatatttggaggattttaagaaggtgataggacatgtgagctttaaggaaatccttgatgtggggcagttcatacaggactcagagtttgaaggctattctatgcaagacagccaacaaattgctgaaagaggtgattctcatagtcttgcttcagaattggaagatgtggtcacggtgaaaacatcagagcctttgaaagttggtaagttatgcactcatgtgctgaactaaaggaagagaaaacaatgcttaacaggcctacagacgtgcatcgtgtgtcagaagtcagaaaatagaacttttcatgaatgagcacagcgaattgtgatagtaccactattgttgtgttaatttttgctcaagataagaaacaagggcatttttcggaacgacactcttttactagctacatgaagaaaaatgtttaaggacttgattcttacttggattgcagttcatcatgtttacattagaaggacgtttcagcagttttgacatggtatagccttttgttacaagtgtagctgtcattattgccacaggggagataactcagggttttgagtcgtccttgttttcgtataatactttttctacaaattgtggagattattgaagaaaagaagcttcaaataatcaaatgtagtggataaaggttcagaccatgtagagaatgaaggttactggttgcatgaaatagctgatgtgcgcaaaactaaaaacgtatatgcttgattctgcagattctactaaaatggaacagatcacacaaaacaaggatgctgttcatggtcctttgaagactcagaaggataaggtccaaggaaaggctgttgatgtccttccccaaaaagtgttgtatgatgtcaaagttgacagaataaatgtggcaacagcagattccctcattccagaagatcctgcttcacaatcatttgtttctccactaagggaagagaatgcactagcatcaggcagtgatgatgagaaaaatgacagtgctgttcagccagaagttagtacagaagctaagagaaccacttcctcagtaaaagttactacagaagacaaggggaaaactcagattagcgatgttgtttatgacaaggcacaggatatcgaatctcttgcatcgattgagtgcttggaactgcattttgaagcaaagatgatagaatgggccaatgagaactgctccatcattctagttgaatacagggagcccatcatgtcaagtaccaagggggacactacagatggaaaccagagtgaacattcagagaagataatatgccaaagtgagcaatcttatgagaagaaactattcccagaggttggcacatgtaacacagatattgttcaagcaatagttgaaggccgtgattctcatatcactggtttagaactggaagatgtgacccatgtggccatagaggaaacagatgatctgaagagatctttggggtctcgtaaggttataggacatgtgagctttgagaaaatccttgatatgggactgttcatggaccccaggtaatgacaactgcatctgttttttttttcttttcgaaaacatataacaattggcatttatatacagcaaattaatcaagtttcttatttgcagtaagctaataaatattatttttcctaatttgttccttttgctttagaagacatctctctgcaacaggctactttcagatgacacaagcattgatgcttgatggtcaatctttgtatgtccatttttcacatcttcttgctatgggtatatgaattattgtactgtgtgtgtcaaggtgtcatctagatgcctcatctaatgctaaccactaaatgtgcgaaggtgtcatctagatgcctcatctaatgctagtaattttgaatggtggttctgttattttgtgaaatggaaacaattaaacaaggcgacaatctgaatgttttaactgtatttggggaattggttgtgatttggattttagaataatttgaatttgtgtgatgttaagaacctgatttgattctactctactcttgctctttcctaccttttagagtcagattatacatccttagaacaattattggtttgttgataatatccatcgttctggccaaagtcaattcactgtagcatagtatcattcactattctttggctacctctctttttggtgaagaatcacaatctccttaaaaaaaaccttcactctgatatttagccaagaaagatgtgctattgtttacatcgagctatatgagctgaagtcttatgtctgctttgatcatttttctctctaatcttcagctctggcgacaaagataattcgcatagtccagttggtgttgttgagcaccagggcctaaggggacctctgaattttctaggagctacaaagtaagttcacaccttcaccttttattttctgtccatgttcctctttaacaaattttgatgcctttcaactgaatattacaatgatggatgtttctatttattagactgaataactgatttgtttgttaattacactcagtttcagagaggtcatcgagtaaaagcagcaagttctattgaaccacctgatgtccgaatcaaatctttcttatctgcactacttgccacaataaggattgggcagctggtttttctatccttatatgattcagttctcagctggctcccgtgcggcttcttttggagaagaggagggccacaagcccctgagcctgaatttagctggatctctgttatgggtgatcccgttattaacactgatggtaagtgttgctatcaatgctttcattttcagttattcctatctttatatggatcattaattgaatgaattgtttttattttaggaagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggattttttggctagagagaaatgtagcttttggaaaacttgagtttatgcgcctgctgtatgcctatggtcctcttctcagcaccctttggacagatgatggttatgcacaaacgtttggagaccgtgtctacagagggctacaaaaggatccagattcgggggaccatcattgcgttgtctgttttgcataccgggttgacagcaggacaaatgagctctacgttagaattatggacaattgtgcagatgatggacctatcagatgggtattatttgatgtgttcgatagcttctacgttccactgataaaaaaatcctatagagcctcatgaactacggagaaagaagaagaagaaagagcatagtatctttgcttacgcttccagttatttctccacattgaagagaaacattgttggatgggctgttggtagagagattaggagatattattatcctccgaagcagaggaatgtagttctgtgttgatagaagttgacttctggagatatcctttagagagaagtaacgatgttgttcttgataatgcgtttaattttctttcttcccctgtttgttggatagacatgcaattagtatagtaggacatgtgcaagtatagaaactgagaaagatgattgtatagccgctggtacagcttggtcggatggtactgttattttgcaattgctttttacagcactgtggaaatatctggaacatattgtttgaaacattgagctttgcctcttttttctttctggtggcaaatgtacaatgtatgcaagatgattaagaaccacattttttcattcctctcgttttctggatggatacactgtgaaacgatttttctctaatgtaatgtgtaaagagaacttacaacttttggtctgactttgaatgatctccattgatgaggacaagtactttcaaagcaacattacaaattactactacctccgtcctaaaatacttgtcattctaaattgtttagcatgtgctaagattagaagaaaaagactataatacccttaataaaatattatatagttaaatgtggaatgttggttgggggtatgatggggagatatttgaatttgaagtagttgatgtgacaaatactacttgcaagtgataactattttaggacaaattttaaatgccaaagagccaagtattatgggacggaggaattacaactgtagaacaacacagcttccccaggtacatgacgtttctctgagttcagtacaaacgttctgcgctggtagtatgtacagagtactgacatgcaacgtactgtaaatgaacgagaacagttgactagctgttccaacaaatcatctagctaccgaagaaattagtaaaacataagctaaaaggcaaagagggtatggccactactctgattgtttttctacatctccgttagcactcaaaagattccaagcatggttagtaggccttcactccatttttacggcttgagttggtggaaccttagctgcaagtattggatttaattttgaactgtcatattcatcccgtaattcctcaaaaagtcagcgcttggatgagcaaggaatgtaaaactccttaggctgtgttcggtttcaggggatgagaataatccctctctcacggaaaacggagcaatcgattagcgcgtgattaattaattaattattagcttttttttcaaagaatggattaatttgattttttaagcaactttcgtatataaactttttacagaaaacgaaccatttagcagtttgaaaaatgtgcgcgcagaaaacgagagagaggggttgagaaaagggatgccgaacacacccttagcagaggtataaacatagacacagatgaaaaccaactgtgaagcatattgtaaagaaaatgattcaaaacaactatcagcagttgagcttacaactctgcttcagcagtgagtaaaattttaaaaacatccaaaaagaagaactatcaccaggcccatagtatatcttatataatgaaagcaacaaactttcttgtataaggatgtgccacatcataaaaaatatattggccattggataaagagtttagataaacaatgaccatcggatcaaaatgatacatgcaataataaaaaaaacacaaatgaattgatatatatatatatatatatatatatatatatatatatatatatgtatgtatgtatgtgggaatttctagagttctctagtgctcctattaaacacatgatacaaatagagagaacgcaaagacaatgaaggaagaaaaatacctagagggttccaatgattcattttataaatatgtagtataacttagctaaatctgtagtaggttgggccatcaatattttataaataaaaaacttattaaaaccaccttcttaaaagataagtttatacataagtttttaaacgggattgaaagtcgtgcaaagtgcgactacgtggctagtacaggtgagacatgtaaaggtgggtgcttcaaataacgaagacatgttgaaccctatgaatggaaaaactttgtaaccgaggaaattagaacattcaacagactagcaaataatacataaatacagaaactctcattcaattatccagcaatgtttagtagtaacgacctcaagaccttgaccgcatttaccacattattgttgagaagagccaatatctatggattattgattggactcttcatctgagcccaaatcatagtaagaaaccgcctacataaacaacaattgtgtcaagaaaagagtctctcacaattagctctatcgatttgttgtcataaatgacctaaaacttcaacacaggtaaaatacaaatgaagaaattccgaaaggaagctttggctctgcaaacatgttatgatatagccaagaaagcgtttttcacaaaaacaaacattcaaaaaaagagtggagctatttctatcatgcatatttgatatttcaacctatgcctctacccaaaatgtggttacaaaagctaggacactaaaggcttagggctttagggggagcttaagattctgagatatgagaagcggctggttgttagctagcttctaagaatctggaaaagctgggtttcctaacttctagcttttagttcattttctggattttataactacagcttctcaaaatctggaccaaaagatggactgtttgggggagcttctgattatgggagaagttgcaacagctaaaagctcccccaaatagagccttaaattcattaagggtatagatgtgaagggcattttggtcttttcctctagtcttgtaatctactatatatgtgcctattaggctaactccaattaaaactgttcattcattccccaaattgtgacatggtatcgtaacaaaagatccgccgccgacccgcgagccattttctcgtcatccagtcatcagtcgtcgtcagttgtagcagtttttgccattatttgtattcattctcttgtgtcaaagcagcagcagcagcagcatcaatcacctcctctagttgcaaccatcggctgcctcgtccatctgtcgtccaacgcgcctcttcacttcgtcctctgccacgtcttgtcgatttgtcttccgtcagcaacggagtgaatggatctctgccaataggctgctcctccccgagcccaaacagtgaaaatactggaaggaggatagggattaggaaaaagcaaataaaaatgaaacaaatggaacagtcaataacaaatactcccttcatttcatattataagttgtttgatttttttcttagtcaaaattatttaagcttgtaggaaaatgtagaaacattttcaatacaaaacaaacatattattaaaatatattcaatgttaaatttaattaaactaatatagtattgcagatgttatcaaacgtaaagaattttaattaaaaaagtcaaaatacttataatatgaaacagagagagtaacagtaacactaactactgacgcaggcatctatttgttaaattgcattcaaactaatcagacaaacatctctcatctgtctatcagtttcgtccaggcacaacataagtagaaatgaataagcttcagcgaaaaacaacagaaatatgagaaatatctgccttctataaggtgcgaaagagggcctttttgaaaacaaaatgcaggggtatttgtaaaaaaaatatggaccgttagcaatggtagcggtaataagggttcctttttgaaaaatgcaagagggaaggaatcctggccattggatctatcaccaacggttagatctccagtacaagccattcccccgcagcggccgcctcccccaccggagccggcgagccgccgcctccccatcgtcaccgccaccaccaccacgtcctcctcaaggtctacggctcggcgccgctaccgacttcccccaactagtgaagccccccccccccttccgcctctctgctcgccatccatgccccctcttcctcgccgccatgctagcagagtcgggggtggggcaacgatcggcatctctgcttggcggcggagattgcaagcgttcagccggcgacgaggttgtccgccgctcatgctcgccgtatagttcttgttgcctttgtttatgggtcgaagtagtggtcacataggaatggggattttaattccaaatgtttgtgcctgcaagttaaagggttttcgctgctaattataatatactcctataagacaatgcaatgcagcttccttgacgaaagcactagttcttgagatggtgaattggtgatggcacgataggctttggcgatatgtgcaatataagattggtcattctaaagggaattatggttttgctcttggaagtcttacatacactttaaattgctttcttatgtgtttttggacagttttgggatccatgaacagcataatgtggctgcactggtgcaacagttagtatggacaacagtcggtgattcatcaagcatggggcagcagctgcaatggcatggccgtgctcaaggaaacaaagctaacctatgtcccatcttttgaagcactgctacaaaattgcaaattgaaatttactcctcattagtcccatttcctgctgagttgttgccttattggtcttcctagtgatttattatgagcttttcaccccagaagaggttactgatccagctgtaagcatggtgttgattcaagaggaaacttaagtaggaagaaaggtataagtaaccgcaggaaggaagatgtcactagagtctcctgaggtccaaagaaccatctgggaagaaaagataagaatgaagtgcagaagaagcaaaagctctgatcctcctcaaataattttcttacttccttctgcatttggagtaatgcattgctttctgcactacttatagaggattcgtacagccacctgggtccaaagtttgaaagtgaaaagaaattttgaaaaggtaagaaattctgttcaccattcatcttgttcatgcagtcgaaaactttcaacattttcctttgatgttctgtcaagataacctggaaaatgctttgattatttcgcccaactacttgaatcctatgttttgctgtttctaccatattaccatcctgtaagtatgcacaggtgtgatgccaaattatgcaaatgtctcagccttcttcagttccctaactgtgccataatagcctgtaattctagactatgcttaccaggcagttttccgttctcctattcaaccaagaatgataattacacaaataggctatggaatgagatcagtgcgtggacagattgtagacattaaacttcagaatgttgtaactttactaaacatgagttagaagtatttgcatatagatcactccaaagatatctcaacttcactttactggtaacatttgctaattctttgtccttaaaaaggctagttcgcaatttagatctttaatttttatgggagatctagcttcaagtgtaccaacttttctcatgaggataacatttcattcctattttgttctaattttgcatttatggtcagtagaatgctcttattcttattcatatatgtatcttctaggatggctaccccacaattggacaagagaattcttagcgaacttgaacttatgggattccctactgctcgttcaattagggcactccatttttctggtatgtctatttcaaaaggaatacaaggtagacatattgtaataaactattttatggtaggctgaatggcatagtattcaattagaacagtaaaggatatttaatttcgtctatggttgcatggctgtaatcctgtttgtgaatttcttcaacacatatccgaatcggtttggttaaaacaatcggtctttatcaggtaattccagtcttgaatctgcaataaactggcttctggaacatgaaaatgatccagacattgatcagctaccactggtatgttatttataaaaaaataactgttcaacatgagttcattgaaatatgcattgttctgtaattggtggaataattatcaatcgggaaacctatcagaagtttttcacttcaagcattttaaaagagagcttccctctatatcagttacatacttacatagtattgcacattgtcatgtaaaatagtgcttttgttaattttcaccttttgttctgagtacttgctttcattttctagattccaagagaaatcaacattgaatgtggtgatacaccaaatgaagcgagaaatgacattcaaggaatgaggtcagctcttatttcttaaatggtttcagatgagagctgataaaatatcagagtattatttcagggaaaaggcatttttttccttccctgttacatagctacgtaatcaatcaagaaatctgcactctacatatccactgtatttttcatatggcaacagccagatatgtcctagtaatgctgtaggttcagaatctgatatacctcaagaaacaagtgtcttattggggatgccttacaagagcaattgcacatttgacctttggtactgctattataattgtaaaatgattgctatatggacctgtcctttagcctgtgcatttgataaatccgaacagttctgatgttatccattagttctcctaactggtacaagtacactgtatgtgttgatttcaccatgcatttttatcatgccatatgccattgtcaaatactttatgttacaaaatacaaacaagtggagacaaaaggcaccatctgttaatccatatagatttgtgaaacttgtatactcaagtaactcaaagaatgtatgatcgcattcttttcttcgatatgtgctgcactgtaaaatgtgtaataggcatggttgttttgtagggctgatgcccaggagagtaaaccagaagagtcaacagcagctggaagacagaaggtttactcagagaacttcctaattttgacaccttaaccattttccattacatcagtgtgttatggacaaaccctttattgttatacttgaaggagtaaaacctgcaaagtgcatcatgttgaggcaactcttataggaaaggttaaacaaggtggcaatttgcatcagtttcttttccaattttgtcagaacacatcctcagattctaatagtacactggactagaagttgtgcataagaacatacaaggggcaatagcaaatatattcccttatccttgtctcaaaattgtacttgatttgcatatcctgtttagtagtctagtgttattacattagacaatttgggtcattgttagatctgcttacagcatagttagacagaaaattaaggaatatttcagtataatttgcaaatttatatgattgaccaaagatattggtcaattagtgggctactttactttcgttgttactgcctaatgtgaaggatgccaatatggaacccatttcactttctagcagtttgtttttctacctgattaattgatctggattctgcagccagtgctttatactttcataaactgttgtcacacctcacacctgaacttcctgtatcaggaaacatcacaggtagaaagagaacttaatgcagatcaaaacgaggacgaagtcagaaggaggtatgtaatttgctttggacagatatcatgtctttgatgatattgtttatcgttctggtaagtctagcgtgcgtgccgtttcaggatcatagaattgttcaagtcaaaacaggatggtcaagaaagagaaagaggtagaatccggaatcaattacaagaggataaggtctgataaaacaaaatacacttttttgggtcttatttttcatctcacttcattttggtaaccacgcaataaatccatgctggcctgcactgtccccctttgggatgccatatgcatgtgatatgctgccttaagcccttgaagcagaaagctaccaaaaagtgttaggcaaattaaatgggaactattcatatgttccctatcatgtttttttacagcatattcctcatccctaattgttactggatggttgttgaagcatcataattgaaggctatagtacgacatgactggaatactatttgttaagaaacaacaagatgtttttttacagcatattcctcatccctatttgttactggatggttgttgaagcaccataattgaaggctatagtacgacatgactggaatactatttgttaagaaacaacaagacattgtctctttgaaattttttatttgattgcaagaatggaaatctattgtgataaacgtatatattatgctaactaacaactgaatcatatagtatgctaactaacaagtgaaccatatagtctacatgatacaaccgataataacatatactgtggtctacaatgtgtagtggggacccctgtgctgacatcattttttttctgagagagattgttggactgcatcacatccttcagcatttcttgtcatgcaaaacttacttttgtcatacattgtgaagagggagaggattcgagctgctaaagatcttatggaagcaaagaggactcttgaggaaaatcaaagaaaacggtttgtttcatatgcaacttgtatgtgatattccaacttaagggtgcttacttaagacacggtttttttagtgcagtgtgatggagagtcgaaaagcagatcaagaggaggagaaaagaacaagagagagaatccggaagcgtattgaagatgataaggtccccctgatccaatggttttaacttttttttttaacttcaaaatttcccttcatcagtttttttttcagttcaatccaattgttttctaggatagttcaatctcctggtgccctcacaattgttcatttaaagtatggctatctgaaaccgtaaattcattgatcattgtaattgtctttttattgttattggatttccacattgactatgttattgccatgtatatcacctcagaccacagtcatatgcattagtacagcctacattttacaattgcagttcattgcatgacctccaaacaaccagctagttcaatgatgacattgcttattgccatagtgtgattacactattactccatgaccagagtgacatgattttagtacgcttcaatcagtgacatgctatgttacttgttgaagtaccaaagagccttaaatccttatctcctatgcaggcagaaagaaggcgaaggcttggtttgccaatggaaaacccagtagcttcagtcccaaccttaactccaacgaaggtctaaaatttccagagcacctctatttttcatgcgaccttgaaacaacatttctcacctttttagctcctcagataaaacctgttgaacctgctgtgtcaccagaacaactgagagactgcctacgaaatctgaaaaagaattacaaggtaaaacagtattctgattgcagatacgaattatgcctgcgatcattttgacaccgaagcattgagctattgactgttactggacactgttgatatgatgcttcgtaaacacaattgtagtttatcgtatatatgttcttccacatcatcgttcagagaaaatgttgatatgttctcaaaagctcaccctcgtagaatccaacaatttgtgcctcataaatgcaaaatagcattgcgttaggcagcaaaactcttgtgtcatgtttcagataccgtttcatgagttacatacatatcaactttatttgtaggatgacactactaaagtcacaagagcattccaaatactgctgaagataattgccaacatagtgaagaacccagaagaggagaagttcaggaggattcgactaaacaatcctgttttcaaggtaactatgaaaagcgatgtgcaaggaggcatagaattccttaattatttcataaaaactttttcattcatttctcttatcctgaatccaccattctcctcttaaacaggaaagagtgggcaatttgcaaggaggcgtagaattcctggagctgtgcggattcatgaagctcgcgatcagcggctacctggtaatgccgagggataatatcaacttggcacttctcaatgctgctggagttgaggtagcatctgcaatggaaaacccctactttggcctactctccaagtgaatggaagatcctttcggctacttcatcatgaggaggcagctggtgctgctgcttctctacatcgtacaatcctcctactagtgatcagtgaatggccgccactacaatgggtccatcacagctgctagaatctgtttcctgtcgccaacattcgtgtacgatatctctcggttaatttggaactaacgacagatctaacacctgggtaaaaaacactggtgcttctcaagttgtaacgcatacgatgtgtcatgtgtatgttcatccaggaggaataaaaaatgaaaaatatatacatcacctgcaatgctgttatggtaactacagtaagttgcattggtttctctcgttactgactgaatgacaagcagatcagggccatccatccatataaatggacaggtagctttgtctcaaaatttatagccatctcaaagaaatcaatagagagggaaaaagatcaaatacccattgttaatagaaaactagtattgtcagtggtagataaatggtatcgaatggataaaatttctcgatttgtggacaggtggtagataaaagaatagaaacaactcattttaaggataaattttgaactctaaaaatcgaacatttatttttttttgcaactgagggagtatgtcactgttgcttgtggagagaaacattaattggcatctgtcctcaagggagataggaatgaaagatgaaagaaagaaagggagaggtgtgctaggtcagctgcattgctgcttgccggcacatgacatgcttggctcaactgtactgtctctactgtacttggtgggcttcaattctggcagatgagaattgagatgtgagaggagccgtcatctcatctcacttccttccttgctggtccctcctctctactagtctcctggaagagaagagtgaagagaaggatagtgtggaggcaggggaccagcttactctgaagtctgaagagaattgggagattgcttcttgtcttgttgacaagctgcttctgctgctgctgatactgataatgatgagttggttctaatcatctggccattagtaggatcttgaaatgagaagtgtatacatgtgagttgggttgtgcaagttttttgtctttgagcaaggctagctaggaatgttcacggttggaacttgggagtagtgtggcaagaatccaaaaaactttgcaaggcagagtcaaaaaacattgcaggtaggcaggcaggcatgctgatgaatggaacgtacgtacacatggccagatcaatcatcaatcttcaagtcatcaagaagccctattacatgtctgagaaccgtgacaaaatcactgtaccagcctgctatcacctaccagttttaaaatataagcatttttaggatttaaaatttatgtaacgatataagcgattccaggacactgattcctatgtataaaaatccaaacattttcaactcgtcagaagcttaaaaaggaaatctaagcaattcaaaattcaaccaataatacgattgaaagagaaatttcccatcaatcttaatcattgctaaataatctagaaatggtttattttaaaacggagggagtattaatttgggaggttctgttcttggatctatggtccatggaggcatggagcagtactgcaagcaccagcagtgtatagtactgtgacttgttaaaagcccttgatctgtctgcagcctgcacaacccatccgatcttctcgacttgaatactatgggtgtgtttagttggggaacaggaaatttttgggtgtcacatcgaacgtttgaccggatgtcggaaggagttttcggacacgaatgaaaaaactaatttcagaactcgtctggaagccgcgagacgaatcttttgagactaattaagtcgtcattagcacatgtgggttactgtagcacttatggctaatcacggactaattaggcttaaaagattcgtctcgcgatttcctccataactgtgcaattagtttttctttttatctatatttaatgcttcatgcatgtctccaaaaattcgatgtgatgtttttgggaaaaaattttgagaaactaaacggaccctatatcatcataatgtatgatcatatcatatcatcgagataaatttcagtaccatactacacctgctgatactgtactccacgaactaattacaaatgctgcttgaatcgatagatccatccatcatcgaaggcacggacctggatcacaggcaaaaatcacagaattaatccctttaggagagtagcgcctttcggtttttattttacggaccatgtaaatactttgttagtgtttttttccttctctatcaatataaaagtggtaaagctttcgcccttccttaaaaaaaaaaaaaagcctgcaggcagcaataatacacggaaatcagattaggctccgacaaaggcaagcaggcagcgatttgacacatatagctagctaagctagctagccatggcgatcgatggatgattgatactataaactggggatgggcgcacgcgtgcagatgcatagaatccaatgtcgtcgtcggctgcattgcttgctgttcctcgccagcgatcgagatcgaagaagaattagggccgggcagtagtgaatgcgagcgtacgtgaagcaggaggggacatggccatggctatcctgcagcttcttgaatgcctccgttgatgcatgattgatccgttccagaacccctggactggacttggctggatccgttccttctccttccattgatccacttattagggtttaccagaccgatgaaaaccagttagatttcacaaaaccagatttcccgccgcggggattggggtgctagaacggaatggcgggaggtacaactcgcttgctttactctactctatttatatcgagttcacactgatgcgagtgtctgaatttgaactgaaaggatgcatatatggtaaaaatagacaaactatagaaaagaaattaagtcaggttatatattgggcactgtcctaacctaatgtagctcctcctctatttcccggactagttggagattacaaccgctcagtttgtttatcaagtaaaaaatttcaaacttaattttaatattttttgacaaaatccgacctgatttttttcaatgcttttcaaacggttttcatgaacccctttttggtgaaaaccgttgaccccctttttttacgatttggtgaaccctgccacggatcgatccctaatgtgctaggatgatactagtaggagtatagtacagtatgtaatatgcatgctagtttttttaactcatcaattttatttccattttagaaatatagtagtacatgatttgaaatgcaattcattgcactgaaatgacttctcaaagatctagctctaattagttggccatgagttaattttcagccaaaatagcttatcaacgataaaaaaagtaatttatgactaaaattttttatacgtttcctttgagacttaaaatccaatattgagaacgaaaactatgttgaaaactaaaataaactccaaagttacgttttaaattttaaattttgctagctgttgattttatataggggaaacgatgaggttgctagtagcataaaaagggttgctaggattgacaagatgcgagatgttttgacattcataataggattgacaaagctgcaagatgttttgacgatcataagctaaaggattcaactcctgcatttttataaggactcaaatcgacgcatgggctcttgtgtagctcccacagagcgacccaggagtgtcttggctatggtgatagggcgaggccgtgatggatgtgtcagtattcaacaatggtggcggtggccgatcgactaacgtcaacagcaatgatattgtaggtggtacaatgattccaatggcattcggggtagatggaaggcggcacattggtgtccgaatctatcgtaacctcggtaaagctagcattggagtggcttcttcttctctgcattcattggatagcatcgccaagcaaaggcactagaaggtagagacatgatggcaaaggaaaaggagccagccaaaggtggatgaaatgtggagaggtgcacgagcttaaacatatatgtggagatcttttcttctgtaaatgaaactgaagaaggaaaacaattgttttacgtaaaacaaggtggtattaacatatggttggttaagttttagttattacaaacttgaaaaatagattaatctgatattttagagtaaatttcatattaaaagttttcgcacaaaacacacatcgtttagtagtttaaaaaacatgtcacggaaatttttatctttatctaactctcgttggagaaatgaatgagactgtaatgatcgattccttgcgatttttgatgtagtaggtctcatcatgcagcataagattgaagcctagtatttccgttttctcttaaaactagaatataattattaatgtaacttttgattgtgtgtattcatttgtggttataaataatgaccgaactttcatccattatcttaaacaatactgccgcattctcacatcctttatccgctagacgattcatttctctagctaagctgttgatcaagtgactgattagcgcacctcaacaaccaccggtagctagttactccctccgttcaaaaaaagataaaccgcaggtttacgtaccaatgtttgattgtccgtcttatataatttttttttataattagtatttttattgttgttagatgataaaacatgatgaatactttatacgtgacttatctttttaattttttttataatttttttaaataagacggagagtcaaacattggacacggaaataaaggtttgtcttttttttttttaagtacgtctgtcactcactcgacctgtccgatccaaccggccgaacggacagacagccatccagccacccagccagctagctagccctctttctttcgatctttcttgtgcagcaacacggcaaaaatgcagccacgaataagatggcccggccagtcggtgcacacgccgactcatcggtcaagccaaccgctcaacttcatactccttcctaatccaaaataaaatcaattctagctattcatctgaatgtactaatgcatagctaaatatattcatatttaaaatgttactatattcgtcctaaaatataaacatttctagctataaagttaaacaattgtttatctagatttatagctagaaatgcttatatttgagatagagggagtttttttaaaggaaaaatatttatatttaaaaagttatcgagttgtacagttataaactttttcttcaaactttcaacttttccatcacatcaaaactttcctacacacaaacttctaacttttccatcacatcgtttcaatttcaaccgaacttccaattttaacgtgaactaaacacacccgatgtgtgnnnnnnnnnnnnnnnnnnnnnnnnnnnnnnnnnnnnnnnnnnnnacatggttgtggttgctcttcaatgggaatggggttgcattgaacgttcaaaggcattattattagcacatgctgcacattcatatataggagatacatgcatcaagcaaacatgcataagtatgtggacaacaagggtaaagcaaatgtgtgtcgagatgttggtgcgatgcatctcgatccatgtgaaacgtcaccaccgtctagacggagtaacataggtagagagatccattacaatttcaggactcattcgggatgtaggattgaaaaaatataggaataagaaaaacatagaaatatgatagaaatgtaagtgtaaaacagagaatttgaaaacataggaatttcatgtgagtaggtgtttggatggagtaaaggaaaaacataggaatctttaagaaaataggtgcactattacaaaattatcacatgctactagtgaattaaacaacattaatcaacctaataatatgctttagttggttgatggcatgatttgcctcgttcccacgcagagggagagaaaaaagaggtcagcgtggatgtttttttcatgtgatcttccagtgatatggctagcgcaggaattttccctatgtatttcctacggatgttttcctgtgatccgaatgacgccacagtaaagtaatccataggaaccaaaaaccttcatttttcttgtgtttctcctccattccaaataagccctcaatggttaacagtatagttttggccggaggtataaacgagatatagtattttttttatgaataaagtccaatttacaccgttaactttgcgggaaaaaaataatttacctctcaactctttaataccatacgaattatcctctcctcccatccaaattcgaagcgattctaatcctatgtgatgcacaggacacatttgacatgtgtcgtcataatcagcttggtagaaatagacattatatcatctctctgcttaaatccacaccattgcccatcctttttctcctattgtacaggctagctcaagctctagttgtctttgtaggttgccatctacagcttgcacatagtcctgtttcttaagccatcactatttgttcagccttacttcttccgtttcacaatgtaagtccactataaaacggagagagtacttaagttgttgattggatggaggtcctcgtatcaaatggatatggaggctaagattgagtcatcatttttttatgtgaaaatgtgtcatcgggcttgttcactttgctaccatttttaaccttactttttttttggtaaagttaaaaaaaagtggctatatttagtttgttgccaaattttagtatgtacatataaaatgttgtcaaaatttgataaccttgtcaaaattttagtaaccttactaaaatttggcaatgccaaaacttggtaaggctaaaaatgatagcaaagtgaacaagcccatcatcggagggagtatgtggtggaggtggcaacttgatcttgatctagctattatgagcttgttgtcaatttgtcatcagatttgcgctagccgctgcctagtcatggctctaagcgtaagatctgaggccgccaccatcacagggatccaaaccaagattcattttattgtcgacttccttcaagctctaaagctatcttcagctatgggtctcatttaagctctagagccacttctagtggtacacttgtaagttactatagtcattttccaagccatccgagagcatctatatacaacatatacttcttccgtcccataaaaaaccaatctaatactgaatgtgacacatcctattactacgaatctggacagaggcatgtctatattcgttgtactagaatgcgtcacatccagtcctgagaaagaagagggagttgataataagaagatggataagagattgacacgtggggtaaaccacagttgctagctggattgcgaatagatgggaccaaaaccatactgcacagtactttgggggtaatttgtccagtgtaaaagaaattaagggtgaaggttatggaagtacagggtaaattaggcttttgtaaaagttgcgtactgtaaattggactttaaccaaatctttaagctgtgtttagttggatctaaagtttggattttggttgaaattggagatgatgtgactaaaaagttgtgtgtgtatgacaggttgatatgatggaaaaggactagtttagatccaaagaccttgtttagataggactaaaacttttaagtacctatcacatcggatgtttggacactaattataaatattaaacgtagactattaataaaacccatccataatcttagactaattcgcgagacgaatctattgagtctaattaatccatgattagcctatgtgatgctacagtaaacattctctaattataaattaattaggcttaaaaaatttatctcgcaaattagcttttatttatgtaattagttttataattagtctatatttaatattctaaattagtgtctaaatatagagattaaagttaagtccctggatccaaacaccacctagccacaaccttattcgcccgaaaaggaaacagtactacaacacttggcctgcaaattctgcactcgatgggtccgattgctctgatgaagcatgcatggggagaagaataatgcagctagtagtacttgtcgctgccagggttgtttttaccattgtgtttgtgtcatctgttgtttggttgttcgcagaattccaagggaaagcgtcaaacagccggattttgggcagctttcttcctgcgagattgatgattttttatctacttgtacagttctactcctactaggttgatagggttggtagcagggtgtcagctgaagtagtagtatgcttttggttttggaccatctaattaaacatttttatactccttctttgtttgatccttaaacaggatgcaataatgctaacaaggttggaccatgttatacagattttggccttagatggggtttctgtgatgttgatgttatgtcattattgtcagtatatacttaagcttacctaccaccttgattacttaagcagaaaaagatcaatattaccctgaacatgaactctccaattgtcaaaattcgcctaattatacacataccaaggttaaacaaactgagggctcacaaataaagtgtaatccggttcgaatttttggaccggatcaaaaaacacaaaccacttaatttttcgtcatttttttaaaaaaatcaaactgaaattttaatttttaacaaaatttattcagaatttattggtttttgtcgatttattaatggattatgcgaaatccaatgatacagcttgcaagcaaattttgattcagtatcgggactgtgaaccctaaacatagaatactaaagagaaacgtagcatcgcgtatcaatatcaagaaacaagttgaacacatcgggaacgatccaacacggaccgtctagcagcacgacggctactctcgccatctgcactatacacagcctcatactctcatccataaaataaaaaccttggttacgtcagattgcactcgagaaagatcacacaccttgcaaagtaaaaaatggaccagagggaaaaaaggaaaacttccagcacagtggctttgtgcctttgttcttcttaaagagctaggagctcatcttcctagggattgcaattttgcccatgggtccgggtatccgcgatacccgacccaatgggcacgggcgtaggtgtgatattttacccgtgggcacgcccgcccgagacccgtagatatcgtgggcaacaactgggtttcattttttacctgtgggtaacccatgcccgacccgatacatatgtattagctaattttgacttatctcttaattcttatactcctttctcatggttcatttgtgatactaattagtaataagttgtgatgtaattcaaattattgtcgataactgataatttagtaaattgttgattttatttctctttgttaaattatatatctttcgagttattattcatgtgtgatccattgggtacccaccgggtatacccgtgcccgtcgggcatgggtacgggtatagagttttgcccgctaaccctagtgggtagggtttgggtgagcgacgacgagcatggggtcaggcatggttttgctctacccgtgcccgacccgacccgttgccattcctgcatcttccacatacgtaaaacggaacgacttattagtacataattaattaacttttttagaaataaattaatgtaattttaaaatcaacttttctatagaaatttttgcaaagaacataagctctgttcggcaacaatactctgcagctgtaaccaggtgcgttgtatagccggtgtatatattttctttaccatgcactgtagcggttgctgctgtacagctgcagtttagctatattgaacagacccatacttcctccatcccaaaatataagaatctagtattggatgagacgttttcaagtacatagtatttggacagggagtccgtctagatacgttatactaagaaacgttttaacttgtcctagattcttatatttggggatagaggtagtaccgtttaacagtatgaaaaaacgtgtgaaaaatgagtgagataaagttgagaacacgtaggaaagaacacatcctgagtcagtcagcaagtgcggtgttcttttattttcgttaaagaaagaaaaaaaagaaaaattgcgcggatcaaacccatctcctctccacaatccacatgcgcgcagccgcgcgtggcgtggcgtccggcttgcgaccgcacgccaggaatcccgcggtctcgatccaccaccaattcaccgtcttccaccggcacacgcaccccgcgacgcgatccatcccaattttttttttttggcaccgggatctcaccctcgcaaaaccccgcgcggcggccacgcgcgcgcgcgcggggaggcgtggcgtgccggccgcggccaccgttttttgctgtcgcgctccacggtttcctccgctcggcgtgcgcgacgcggtgttggggttgtgttgccgcccgcccgcgccgcgacgacagaatcattggcggatgcacacacacatgcataaaaatgccggagcgtatgattgcatcttgaccagtaaacgggcaagcgtccaaatccacggaatattacgtactttgttcctgatgctggaactttacttaactaaccagatcagaacaaccctacttcttccgtcccaaaaatacccaaccttgcactagaacataataatacattagacataatcttgtatttagattcgttgtgctatagtatatcacatctagtattggattaccttctctaggacgtagggagtacttctcagccaaaaaaaggaagatcctcatgagcaatatatagcatacacttcgttgcataataaatcaatttttatagaagaaatctgaacataaattatactcccttcgttctataatataagaatttttgactttttacttgcactgtttgaccacccgtcttattcaaaaaatttatgcaaatataaaaaataaaaagttgtgcttaaagtattttggataataaagtaaatcacaaataaaataaataataatttcaaaaatttttaataagacgaatgatcaaacagtgcaattaaaaagtcaaaatttcttatattatgaggggaggggggaggggtattcagattcgtatatgaaaaataatttattttcgagagagcaaattcttgtaccaaatcagcctttagaaaattgtgggattgtaggactggttgctcttgttgttggccaaaaaccgatcacgattggttgacatttgcgagcaaaatttggtcatttggtgcatctaaataaacatttcttacgcaacctcgtaccaaaatggatggaggtggcaatctgctcacaccctttttcaaaagataatacccccaaaatcgaacctaattatccaattatgctacattgagatggatggatataggcacatcgcgacagtgctctatcaggcttaactctgtcacatacatatgaccacctgtcaggctgtcacggccccagcattgacatttggatgctctcgaccaaaccttttggcgtctgctttgccacattagtccattattatgaagaaaaagaaagggaggattagtgcaaaggaattctttttatcaggtcaacatcattaggccgatgagtaggacccctagaatgagattatactagtatgctattagagtattagtgctatactgctactaattgtactcctgcgtcggtgtcgcgcaaatttatgagatttcgacttctggtcataaatttcgccaaatcatgtgacatcagagggtaatcagcatttgaaatggcgctccctccgtggaagtaaatgagttcataccataggaatgcacaatgaagtgaggttgataattggaagctttggagcaataaatttggagttatttaacgcactagcactgcagccagtatattgatttatttctactattactcaaggatttaccaaaccgttttggatatggttcccgtcacctcagtttgactggttatcggataccaaacacgatgttatcgcgaggcatatcatggtttcaaaaactgtattatttaccaaaccgttttgcatgtggttctcgtcacctcacag

SEQ ID NO: 23063 - DNA, 2990 bp, Oryza sativa
tccgccgcagcaccctccctcaatggatggatcgagctcactctctcgttcttgctgcggccaagcctgcctcgccgcgtgtgtccggacaaggcgagggggagagagagaagcagctgctgctgctgctgctttgggttaataaaagcaaaggaggaaagggagggaggagtggtcgcttggatctcggcgaggtgggggatttttcttcattttgcgggggtttttgtttgtcaatgtgtgcgccggtgcacggcacggttgcgtttggcgtaaccggttttggtttggtttggcacgtggtgggggtggtggtaatggagggaccgatggggttcgtccgtgcgtgcgtgcgtacggtcgtaggcgtcgaccgaagacggtttctgcgtgccaatttggcccaaatggcacgaaaccagcgtgccaatttggcggtgtactgggctgtatgcccgtagcccactttgttggtcgtggaacatgacggcgatgatgatactgctgcattgtctgcccagtgttcaaaaaaaaaatcgctaggtcccggtttataaaaaccgatcaatattaaccttttttaatacattaaacaaaatttataagtttttattggtttttggttggtttacggtaaactgatgaggggcagttttcatttaaaagttttttttaaaaaaaatatcgccaagtcccggtttataaaaactaatcgaaattaactgtattctactacgttaaacaaaagtcaccactttttattggtttctggttggttttcggtaatacaatgaggagtggttttcatttaaaaacggaaaggtaaacccttctcctgactctcatcagtgagagtttcaatgcgagctgcagtatccagtagacatcagaattgattgaaaaaatgaaagaaaacgattagaatctgccgccgaatccgcgaggacagaatcgaagttgctatcctgtattgattgatgcatcagaacaccgaaattctaggagagttccaaagcagcaaacgagcaagtactactcaaagcatgctgcacattctccatcaaggaaacaagaggcctgaaacaatgttgcttagcttgcacatccaaaaatacttgggggaccaaagctcaagacatatcaagtagtaatatcgttgtattttctacctagtgtaaagcattaccaagcattagtacagtcctgtgttcttcttcattcttttccagggaagaagaacacgttcctcatgagaaaaaaaaaggagattacgaatgtgatcagactagctgattaagaacaccggccaccatctattcagctgggcaggaacgtattacagtcaatttgcaggtcctacaatgactcagccaaagcaaacaaaattggacttgatcacgacgtctactgaatggatccttgtccatccaaagaatgcttgctaatctaacaaatttacttccttcgacgttagcctccaattctctcatagaagaaaagagaggcctcgcacttgagaacttcttctagagatacttgtctgatgtcggtatcacttgcacgataccaaggggaagtgccaccgtcaggctgctcttgatttggtctcacgtaagcaaccatgtgccctgaactggtgctggggccaatgtgttcaatgacaccgactaggtgatagctggaattgtctttgtcctcagaactgaaggttacagaaaaacaaaagcaatcaaactagatgttaggcatggttattttgatctcatatcctcaatgctgcatattgctaacaagaatctcatatcctcaaacatttaacgaataaaggccctttaatgaatttcaacatgccattaaaacatgttggtgcgaaggctgggatatttatttcagtacctaaaaaatctatataattatacccttatccccccaaatactaaaaccagaataaggccaaactaatatttttgaaaaaatgcatttggaggcacctaatcacctacaaacaaaaaggcagtcatctctaaaacataataattctgattttctaatgagatgtatcagtaaagctagtcaaaatatacaaacaagaaaaattgcttactgtgaatcataaatttattggaactgccacatgcttatatagatattgccatgcagaaatgctaatatgcaatacctggggtccatgaactgtcctacatcaaggatctcctcaaagttcacgtgtcctctaactttaccagtctccttggatctcttcagatgaatggccaatacaggtggcagcttgttaataacacgagtttgaatcccaccttgattcctattttcccgctctttttgttttgcatccacttggtctgcactatgatccacctttacttgtttccacttaccctgatctagactgctggtattttcctggccactcaacaggtcgtccggttcctcagctggaaggcaactagatacagcttcttgaacacgttcatggcaatcagtttttttgttggctatgttatcagaggccaagtcttgttcaccatggatcatcccagaagtgattttgttatggcttggtggtcgacctcggctgcgcaatgagtatgtgtgcttgacaggaggtagtgtgttgattccttcagtaatgctgtccattgcgagcatagctttacgttctgaatcagaaccatgtggttgcttacttgaagtgcattctagtgccaaactttccaaatttttagattgctcgctctggcgtgctaccttgtccaactgcacagtctgatctctgtcaattattgtgttttcgttggtgcttgccattatctgttcaccatctttactaccagtggtgctcagatggtgagaaactccagaacagttatcacatctccattccagcagctcttctttaaaaaatagtgctaggcactcttcaatcgatgcaagagagtcgttatcctttgccttgccataagccatat

SEQ ID NO: 23064 - DNA, 1972 bp, Oryza sativa
  unsure (1)..(1972): unsure at all n locations
ttcaacataccactgaaagatgtaaggattatctatacgattatatgcatttgccagtgcaaaggctgggatatttattcagtatctaaaagctttatatgattataacccttataataacaaaagtactaaaatcagaaaaagccaaaccaatatatttcaacaaattcatttggaggcacttaaccacctacaaacataatggcagtgatatctaaagcataataaaattctgattttctaacaaaatgtattagtaaagctagtcaaaatatacaaacaagaaaaaaactacttgcttactgtgaatcataaatttattggaactggcacatgcttatatagatattgtcatgcataaatgccaatagtcaatacctggggtccatgaactgtcctacatcaaggatctcctcaaagctcacgtgtcctctaactttaccagtcagctgggatcttttcagatgaatggcaaacacaggtggcagcttgttaataaaacgagtttgaatcccaccttgatacctatcctcccgctccttttggtttggacccacttggtctgcactatgatctagctttacttgatctagagagctggcattttgaccctggccactcaactggttggccagttcctcagctgcaaggcagctaggtacaacttcttgaacaccttcatggcattcattttttttgttggctgtgttatcagaggccaagtcttgttcaccactgtccaaattgctagattgctcgctttggcatgctatcttgtccgactgttcagtttgatctccatcaactattttattctcactggtgcttgccatcatctgttcactatctttaccactagtggtgctcctacggcgagcaatttcagaacagttctcacatttccattccaccatctcagcttcaaaatgcagttctaggcactcctcaatcgatgcaagagagttgttatccttcgccttgccataagccatattgctaaactgagctttccccttgtcttctgcagaaccttctacagagcaaacgtttttcttggcttctatactaacttctggctcactgggcgtatactcaagaccagcattgtaatttttccctaaatcatcagccttagttggcgcctgaataatctcccctgggacctcatccttctgaatttgggaaggaacatgtacaccatccttgctttgcgagtgctgttccacttcaacagaatctgcagaatcaagcatatataaggctataatttatctgcatcagcaacaacatacaaccatcaaccttcattctctacgatctgaagctgcatttcttcgagaatctccgtacttgattaagtaaaccaaccttctagagcaaaattttgtgtatgaagacaaggactcaacaaataaacaatcttccactccaagctcttaattgctacactacgacaaacaactcttccatgctaacactgctcaaacgtcatgcttcttttatgtagccatcctgaaggttttccatatatttcttcactccatgtgtttagcaagccctcacaactttttctgtctaactagaattggggatccattccaaaaaaaatgtatgttttctctttatgatgagaaaaataatggtggtgtgattacaatattccttagtttcttgcattcaatcctcaaaagatgtatatggtcctgcacaatcctctatacctgcatatctgtttaaaaatgttctctcttcttttatttagaaacaggatgcatgaacttaccaacttccaaaggctcagatggtttttctttgtccacatctcccagatctaaaccagtgatatgagaatcacgtccttcagcaattgcatgaacaatttcggtgttactcatgtcaacctttgggaatagtttgataccaatcttctctcgnnnnnnnnnnnnnnnnnnnnnnnnnnnnnnnnnnnnnn

SEQ ID NO: 23065 - DNA, 312 bp, Oryza sativa
gaatcttttaagcctaattagtccgtgattagccataagtgctacagtaacccacatgtgctaatgacgacttaattagtctcaaaagattcgtctcgcggcttccagacgagttctgaaattagctttttcattcgtgtccgaaaactccttccgacatccggtcaaacgttcgatgtgacacccaaaaatttcctgttccccaactaaacacacccatagtattcaagtcgagaagatcggatgggttggcatgctgcagacagatcaagggcttttaacaagtcacagtactatacactgctggtgctt

SEQ ID NO: 23066 - DNA, 1250 bp, Oryza sativa
  unsure (1)..(1250): unsure at all n locations
nnnnnnnnnnnnnnnnnnnnnnnnnnnnnnnnnnnnnnncaaatgctgtgcgcggggattacggaacaagcgaagaaccaccagaaaataaaaaaaaattgcaagaatccggtaataaaccctagcccaccgcgcggattagggatgagagacaagaacgagaaatcgggcatttccggcgaggagcgaccaaaccaaaaccgaagcgatcagcgggtgggggattgctgggagaaaacgcgcgaggggggactcaccggaatacgcggggatggctccgaatcggcgagggcgcgatcggcgacgagtcatcgacgctgcggcgcccgcgacgacaacgccgacgagatcacgagaggtttttggaggaagaagaagaagcggcttcgctggccggagcgagttgaggtgaaggagagaggaggcggttgctactttgcctgggcttatacggatgggccaaacgtgggtgggctggtatgggctcataagcatggatgatgggccaagagttgggccgtgcatgaactggaggcctagcggccgtgcttttccaatacttttcgtttggaataaggcccacttatgtccctcgtctttacatcgagtttaattgatgtcgctaaaccacaataccggaaatcgattgatcatttcaaaacagtgagtcaggtcctaaaatagtatcgatgtctattttagctaacatagcatcctagtcaataaaataaaaagattcacaagtaagtgggcttccacggttctacctctccccatctctcccctttctttcccatctctccgtactctatatgtgtctggtcgaagaacgagacatgtggggacacggcgagagcttcgcgacgtgcgtcggtacggcgagctcgagggagaggtcggcagccggaacccaccgccgccatcaccgtcaattaaatacgaataataagaaaaataaaacaaatgcataatcagtctttctcctagcttttcatacgaaattaaataataaacaatactcaaaagatttctctacgactagattatattatttgttcattaaagttaatcgacactatatgatcatactattactagtcgttaaatttagaaaaccattaaatagtctttactcttttttttgttagaactagtagtaataatagtcttcattcattcactatttaggaagcactaaatagcaaatactccatcctttccaaattgatcatcatatatatttatgcacc

SEQ ID NO: 23067 - DNA, 10004 bp, Oryza sativa
ttcattcattcactatttaggaagcactaaatagcaaatactccatcctttccaaattgatcatcatatatatttatgcaccaagaccaaggataatttaaatcacatcaatcaagacatcatgcacacattctctcacaatgcatgcatcgattaaaacaacatgccaattacatcttagcatgcacacattctcccatgctgtattaattatattatgataaaatacgtgtccatgcggttatatgatgatcaatttgagaaattttgaattttattatatgatgatcaatttgggaagtagggagtaaaacccacgcgttggcacgtccattagttttgaataaatacggccattaaataggcccaatcttaatccggcaccgtagaaaagccagggccggccctgagattttggtggcccagggcgaaactataaacggggcccttaatatcacatacaaaaaataaataatatagatatacatatatgaatatattgcttgtaaatatttaaagttcatccaaaagcaatatttatatgaagaacctcacaaatatttcattgcaaatttcttgagatatttttagacgcgaattcattggtgatagtaatctcatctagcaattcgcttttcataaaaacatctaacgattccttctcatttaatcatttattttcgaggcgacataatgtgaagaatggactaagaattgtaaaaataatgtattagtgttcgaactcatatagattatacaacttaaattattagcaccgattaatccaaacaaatattttcttttctcaagcaccaagaggattgcacgttaatgttaatatattactagaagaaagcaatcaacaacactaaaattgccaatcagctagctagaagcccttgcagagaagagataagaaatcgggatcagctggaatcaggaataatatagttatctacacgtgctgttgcctttggcttttgcgtacagcgtagcgctaatctctagtctaattgcatgatcgcatccctaatcacagaggggtaggtggagggccccaccattttggggggccagtgcgcggctgccccgctgaaaagcgatacgtatatatatctcacactcgccgccactgatcaaaaccctaattaaacccgtcgttaattagcattctttcgctaagccggcaaactcaaactcttaaaccctaaaccccccgccgcgagcagctcagcatcttgccgcgtcggagatttgagcggcggccggtcatcatccaagctccgcccccgtctccaaatcctggtatgtatatatccatctttctcgccccctttagatcggcctttgttatgatggtctccaattctttctaaaccctagctgatgccgattcttctctttctttcctctctttccctctcttttctctcgatgtggatttcgaatcctagatcctatatatatatatatatatagagagagagagagagagaaagaggttaattaactggtgctacatgaatatgcatgctccaagattcaaattgagtatatacccaattttaatgggtatgaaattttttaaaatatttagatataaacattaacttctttactaacaagttcaagtttgaactttctttttgttagattttggttctaagtatataatatccaaacatataattagttaggtatgtaataatgaattgtgaaataaagttgagtttgagttgttttgttgttaggtatttgtatgaatcaaattcatatacctaggtatatactcacaatttgaacatttttaaaaatttgagagaatttgtgtgttttataccttggagcctaggcaccatggagtcccatatgggtatcctatatatatatatgtgtgtgtgtgtttatatatatgtttatatgtagatttggatccgagaaaactaatgccccatttatttcggtttaagattataataatatagattattgagacatattactgtaagctggattataataagtcgacattgaataagatgttcgctgcttgtttctctgatagatagctcttagccacctaataatctaaaaaatatttttagagtggattaattaccagattatagtaatttggcttatagattgtaatgatctattataataaactatctgtttgtttcagcttacttctaataatctacattataataattctaagctttcagtgcctaaatggaaaggtatagatttgtgcgatccgagaatgagggcaagcctgttggccttgcttgccacgaggcgtattcttgttcgattgctctgtataacttcgctctactgacgtggattcccttaccactgataacaccccgatttgtgactgaagcaagaggtgaaatattccatcatcgcattcgtagaacataagatcaaagatcttgaaaaaggttggagctcaaatttcgattatctgtatgaggccgagaaagaatgcaaatgtcttgtgcatgctcttccaggtggacttcagatctgtccagctcttgacaggtgcagatatatatgcagtttctgtagattttgtcgtctttgtatttccttttaattgtcttgattcaagttgtgctatttttttctttctttttttagcatcacatcgttcaagacaaatggtggacacaacttatttagtttgctggagatccgaatggtgcacggttggttagctaatcccgaggataacatctatgagacggtcaggtccttctcttgcgatgatctggagtcacacatttctgatgctctgaatgataattctgaagctgcacagaggaatagggatgcaagcaaaagtaagattgtatcatcaaacatgttactcaataaatcccacgatttgatttttttttgttctactaatttttgtgtttattcttattgcaagatttattgggtgcaaagaatcagattacaagttatgggtatatatgttggtctcactagggactactatacacttttatttgatgaacactgcaattcactcatttaatacattatcatctggactacacagatatcagtctttgtgccaaggattactgaaggatgaatatgctatcctttatcgggggagtgacaccttcaatcttattcgcgaggtattaaccctatagatagctataacgtcggtcatcttattatttgaaaatatgatgacgttttgttttaataagctgtccctctaaattgttgatgatattaccgcagaaagatggatccattttgatcctggaaacagacaaatatattagatgcttacccccaagcaaggtggaggattctggaagagataaggatatcctacaacttccttaactctaatgatacaaaactctccaatctactaattttcctatgtaacaggcggatgaggaaccaatttacttgaattgcaaatacattccacttaagaatcaaccccacatcgctaaagtaagttgtagacttgagaatgtactcccaactcaccaatttcatgctaactctcttgcacttaaaaaaattataaataacaagtcatttgatacttattgtctgacaggcaaaactatggtactatgagaagttgaattcaagaaatgaatatgctccaagaaatgtaacaaaggatgaagcttctattcagaagccaacaggaagtgagggaaaactctcaaatcaggaagcaatattgcaaacgaaacaggcttctgatgagacactgcactatagagttgttcagttcaagcatgagaacttgcttactagcattatttgccacaagggatattcactttggactgctctctataaccatttagttttgaatagagctctcgcagtgaaaccatcggaagtaaaactccaatttctgcctgagagagaggtgaaagacgcgatcattgcacatctcaaacttgtacttggtgagatagaaaaaagcgagaaatcaaaacatgaaaagctgtataactgtgagtttatctggaaatgtttcatacgttctacagcagatactcatcagatctatcctgttcttgacaggtgcaaatagttactgtagattgcttgtcattacttctgtatctttgtatttctttttaattgttttgattcatgccgtgctatatttcattgcagcttcacatcattcaaggattcttttggacgtagcttaatttgtgtgctggggatcgaattggtgcatggttgggtagctaatcccgaggataacatctatgagacggtcaagtccttctcttctgatgacctggaatcacacatttcatcccttgatgctcggagtgataattctgaagctgcacagagggatagggatgcaagcaaaagtaagattgtaatatcatcaaacattttactcaataaatcccatgatttgattttttttttattttactatttgttatgtttgatttcttattgcaagatttgttggctgcaaggaatcagtttacaagttatgggtatgttggacactagggactatacttttattttatttgatgaacactgcaattcactcatttaatacattatcatctcaactacacagatatcagtctttatgccaaggattagggaaggatgaatatgctattctttaccggggcgatgacatattcaatcttattcgcgaggtattaaccctatagctataatgccggccatctttttatttgaaaatattttgtttcaatattttatttaatacgctgccccctttaaattgttgatgacactaccgcagaaagatggatccattttgatcctggaaacagacacagatatattagatgcttaccccaaagcaaggtggaggattctggaagaggttaggataccctacgatttccttaactctaatgatataaaactctccaatcaacttattttcctatgtaacaggtggacgaggaaccaatttacttgaattgcaattacattccacttaagaatcaaccccacatcgctaaagtaagttgtagacttgagaatgtactcttaactcaccaatttcatgccaggctctcttacacttgcaaaatttataaagaacaagtcatttgatacttgtctgacaggtaaaacgatggtacttggagatgaagtcaaagaagaaaattaatgaggcttcaagcaacgaaggtgctggtcagaagcagtgttatcgagacacgcgtgtcagtgtgtcgactcgtgtcaggcgtggcaagacacagctgtagtgacaatgctgaacttggagagactagagagaagagagggatgagatagaaaatgcatgcagctaacatggtagcacccctcgagatgaaagagagtggcaatgcacttttttttttttttgatagatccactctcttgtctcctccagttttctttattgtcctttttatcttgtactactattctttactatggtagataaaaggacacatgcaaccgtcatcgtgtacagctgcaaacaaaaatatatgatcttttatgcaaattaatgccccattcacttattaagagaccccaaatttctcttgagatggagggctaacacaggtggcaacttgctaaaaagacatgttttaattgcaccttgacacaagaaaaatagaggcaaagtgaagcggataatatactattcgaactttccacagcactgtaaagcaattgcagataacagatcatccgacaaaactatatcgatggctaaacaatcaccagctcaagtctctagtttgtttttttcaacgaatgcaaaattctcaaggtgtatctcaatcatcttgcatacaatgtctctttgccataaaaaaatattgaggcaaaactcaacatggcgaatgatattttccacagtactttagtgtaaactaattacaggtaacagtaacaatcgacaaaactgtaccggtgcttctacttcaaaaagaagaaaaaaaacctgtgcatgtgcctacataatgattttgcttacttcaaaaagaagaagaaaacctgtccatgtgcctacataatgattttgctcaaattctctaatgcaaaatgtccaactatgccgtttgttttcaaataaattattaatacactcatggacaaaaaagggatatcagctggtcaagaacaaccgaattctctcaactggtatgtacatgttgcggtcaaattggagtcctgcaatgactaagccaacgcaacaagattcaacttgatcacgaacctacgtcagtatatgtacactgattaaaattgaatcattggtcgtccaaagaatgcttgttaatctgataacatatgcttcctttgtgattgctactctgtaggatccagacatcttagccttcaatcctctcatagaaaagaaggtaagcttcgcacttgagaacttcttctaaagagacttctctgatgtcggcatcacttgcacaaaaccataaggaagagccattggtctgctgcgggcaacttggtctcacataagcaacaaaatgccctgcatccatgcaaaggcccaggtgctcaacaacaccaactagacggtagctggaattatctttgtcttcagaactgaagattagagaaaacaaaaacgatcaaaacagatataagactgtacttcattatggctcaatgtaaacaacagcatgtcttattttatcttatatagttactccctccatctcaaaatagaagggcttttgcccggatgtgacacatcctactaatgtgtaacatccaaacaaaaacccttatatttggggacggagggagtatatcttatgaacagaatattattaacaagaaatcagtatctcatctcatgaaaaaaaatctgtcagatctaagtaaaagactggtataaatcatcctaagagaataaacatgtaaagtataaacaagtaaatcccctacaaactatttcaacatatcactttatatatatccatcatatattaaaatattaaaaaatacataagtatatcaaacaaatcaaattctaagaaataaaaaaggttcaacaggttaggcatttcatggtacacatcacctacaaataaaaaatcaaaaagcaattatatataccatttcagattttctttaatgggatgtcattttccaaaaaatatccagtggtcaatgatgaactactacagtgattgagtttgtccttcaagatgggtgatatcatattaacgaccatagagttactctactgggtgtaacctgactctatagggttagaaaaagcaataatatacacaagtcccatgttggaggggacgcagttccatagccttagaatgcctattcactttacagtccacttgcctcaacgcaaactacggagctcttccaaacgaatgttgcaatgataactacaagatcggttttgtttgcgtctatttctttgtcttaaatcatgttagcctgccagaaataggacagagcagtgctatcctaagtcgtaacctatttctgtgccaaagaaaactagctgaccatgcaagcgaaattcatttttagtttttaccacagctacggaaacatgcatattttgctttttctggttttcaattggacaaacagaaacaaatgtgtgcaaggtatacggttatcaacatgctcataacaacagcacacaaaaaaatggacagactaaattactcagtacctggggtgcatgaacaatttcacatcaagggtctccttaaagctcacatgtccactcactttaagtttaagaggccataaatttctcttgagatggagggctaacacaggtggcaacttgctaaaaagacatgttttaattgcacctttgttcctatctggccgatcatattggttttcttccacttgatgtgcactatgacccatatttacttgcttcccccttccctgatcttgttcatcctggtctccatcaactgtcccattcacattggtacatgccactggctgttcaccatgtttaccacttatagggcttgccttctgatcagcattggaacagttttcacacctcttttctatcatctctgcttttaaatgcaattccaatatttcctcgattgaagcaagagagttgatatcatctgccttatcataaactgcatcacgatttcgatctttccccttgtcttctgtagcaacttctgctgacaaagtgtccatcttggcttctatactatcttctggcttgatgctatcaagaacagcactgacagttctctctacaccatggcctgatgctatcaacgtgttctcttcccttgttggagcctgcaaaggaccatgtacatcacccttgctttgcgaaatctgttccaagtgattagaatctgcagaatcaagcatataagttttaggttttgtcgtcataagtaacttcatgaaaccaggaaccgttgtacattgtttgagaatcttgaacctctacatttgattgtttgaagcttattttcttcatggaccatgtacttaagttaaccaacaaagctgagtaacatttattatacgagcacaaggactcagcaaaaactgctggaacatcccgtttgtataatgctgtcatcctgaaggttctgacatttgtgcagtccatgtatgaaccataccaaagaaatattctctatttagctactagaagggctcttctctgaaaaatgtccttgtcatgtcaagcaacaaaataacaaacaatagttgtactatcatggtctgctccattcaatcattcattaatgaaaaattcatcttctgtttcaccttgcgtgcttgaaggcccgttcaacgttgttttccattatttagttaggcacaggaacacataaacttaccaacttccaaaggctctgatgttttcaccataaccatatgttccgattctgaagcgggaacctgagcatcaccgccttcagaaattgcatgaatcttttcggtgttagtcttgttgattgctggaaacagttccatatgagtcttctgttgagatatgcatcttccattccgtggtggtgatgcaacacttctggctggagtcccctttggtggtaatggcattgagagatcatggaatacctcctctgaatctgacttaaacgagcaacatttgcaagacaaggtaacagacagctgaccagcaaatatggaatcaataaccgtaggagccacagcactaggagcaccttgttgcatcttaccagccctccatttcctttcatcctcatccaaaccatcgcgcaaacagcaaagcaattcatgacagtcctgcatagcaatgcctcggaactgcgggtaacgaaagcgcacacaacgcaagagcatcgccgggtccagcaggcgtcgagcgtagctcggaccatttgtaccaacaaagagatcatgcagcaagtcaccaaggacacccgacggagcgcccggccccaagatcctcgcccgcagcttcccgagcacaaggaggcactgcagcagcgcgttcaggtagcaggtgttcccaagattcggcatccctgtgacaacacatccatacccttcctcgccgcctccggcgccatcatcggccaccatctggctctcaattgccaatgaatcctcacactcgaagcagtaaccctcacacggatcctcgcagcgcagcgcgacccaatgcgccctccggtaggcatgctccctgatgtgccccagcggcttggccctgtgggctagccctccgacgcagaagcaccagccgcattcggggcacaccatcatgaggttgctcccggtggccaggcacgtctcgtgctcgcacatcgggtcgccgcgggcggccatgcccatctcgatgtcagcgatctcgtccatgtcgcagctgaagtggccgcagtcctcgccgtcggtgtccctgatggccacccgctcgcaatcccccggatccttcaagggattccgtgacggaacgc

SEQ ID NO: 23068 - DNA, 12471 bp, Oryza sativa
ctgagagttgaggttggtaattaataagcatccaatttcaaaaatattagtattgagttgcatgcaagtgtggaatagaaatgggcagcaacttttatttaattgcgcgacagccagatttgaactcgagacatctggctctaataccatattgagttgtatgcaccgaccagttcaacccaaaaatttaagctgatgagaaaaggcgggcaattcactttatattccaacaaatatcatggataaatacaagtttgatgtaatatcaatatacaagagattttgtctctaaaatatcatcgttgttagggttccgttagcatccttccattaagtgctatagaataaacaatgcatttaacggcgtaggatggacgaaaccttaacggcaatggcatttctgatactaaatcatttgtacgaatattttgtggaaactcggactcgtcaatagcatgttttagatttgggtgtttgtcaatggtatttcttggattttctcttgagataataggtgggtccatggttcatcgggttcacaatgacaaacacacgtttctttgaaggtagaggtgcctaatcccgaaagaaagagggagtggattttaaactctcgagaaggcatatctctattgtttgcatgctatctaaataattataaaaaattaagaagtatatgtgatatatcactgttaaaatttaacttctacaaattaaaaaaaacaaattaaattataaattgttaatgtatattaacagtaaaaatagtttttttggcaatatgtaaaagttaaattaagaatgttcgtattaatttatcttgttaaaaaaattaaaaaaaatttaaatagtttcctgttagagaggtggtcatgtgcgtggatcgcatggttgctacctaaccctgctttgttttggatgaacgccaatataatggaaggagtacatggaggggtggaattgaggaatagcggcagttcttttgtgttttgttttgtttttttgtttgttttttttttgaaaagttcactcaactgcaaaatcgaatatagagtacaactaaggtataaaactagtgcaaattaagttccccttggtcgctggttttggttaaactacttacgtggtgcattgatctggtctatcgtcctacgtggcgtagaaagaaactagtactatttatgttttaaaataattataattttatattgttttagcatatatcttgaagaagcaattgcttcttgatacaactggagtactagcaagtttttacccaaatgactgctttgcttttgagcatgccagtatggaatggaattactatgaattagagggtgaattatttacatgatgcataatcaattaatcagtctgcaatctggattgtctgtccgtacatgcatcgatccgtcgtactagtatcatgcatgatgagtattaatactactggtgtttgatggtacaagcagcgtcttgttcctgtaggcgtacgagcgggcgaagcagaggaacatcgcgagtgcgacggcgctgacgccggcgagcagccagtagaagtagtcgagggtggccgcggtcgaggtcgtcggcgaaccacccctcgccgccgtccctcctggtgacgccatccagcgccgcgatgagcgcggcgctgacgaagccgccgatgcccacggcgccgcagtagagcgccagcccgacgctgcgccgcccctccggcatctcgccgtggaagaactcctgcatccccaccggcgccagcacgtcggacacccccatcgacgcgtactgcggcaccagccacgcccagctcatcgccggccgccgccccgcccgcgccgcccccagccggcgcccctccaccgccgccagcgacgtcgccagccccgcccccgtccgcttagcgtcgtcagcccgctcgggttgcccgtcgcgcgccgcagcgccggcaccaccgcgcggtcgtagatgggcacgaacagcacgatggtcgccggcccgatcgtctggagcgcggcgggcggcagctccacgccgccgatgcggcggtccagcatccgcccctgcttgttgaacagcgtcatgatctgcgcgtccgccacgccgtacgccacgcacgccgcccatatcggaagcaggcgccgcagcgcgccacgcgcatcctcctccgacgacgacgatcgcttgccatccatgacggtgtcgggacggggcggcgcgtagaggcggtaggtgggggtgccgaggagaaagacggcggaggcgcaggacacgacggcgaaggggacgccccagccgacgttctcctggacgtagctgacggcggcgatggcgacggcgacgccgacggccatggagaagaaccaccagttgaagagggagctgcgggcggcgctctccctggggtggcccgggtcgaattgctcggcgccgaacgccaacccgcatggcttgtcgaatccctgagcgaaggcgacgaggtagagcgaaacgtagacgaagatcacctgtgccatggaaggacggcaggcggcggcggcggcgacggtggcggcgcacgccggcagcgaggacgccacagtcagcatgccaagcccctgcaatcatgcgcccatgcgcgtgaaatccaatcaattttgtatttatccgttctaaaatatttgtagtaataagtttttacctttaaaatttatcataaaatataactcctttgtacgtagtttatatatatatatatatatatatatatatcattttttcaaccaataataatcttccgccgttcaagtttccctacctaataactcctcttctcaaaacctttgtccatttaattctacttaagatatagatttttcttagcattttttaaattgttaaaatggtgtattctttgtaaaaaaaatttatataaagttgcttgaaatatcaaattaatttatttttaaaatttgtatttgaatttttcggagaagggtactgatcactctcgaacggacgtacgcacgttcatttcaattaaatcacatttgttgtttattttaagaatgcacgcatattagtgagtaagattaatactctaccagtgggagtaacatttttaagataggattaagataaggtggagcagggagatggtgacagtgtttgatttgatcgctcagttgcgaaagggtcagatatataagtacttagtccatgtttgtttcagcttaaaattattataatctagattatagaactagattattataagctggattataataagccgatatagaataagctgctagttgtttgtttctctggattattatctgtttgttagttgttagtcatccaataatctaaaataagcatctttagagtggcttaccaaattatagtaatctggcttatatattataataatctattataataagctatctgtttgttttagcttactcataataatctagattataataattataagctgaatcaaacagggcttaattaattggatggaccaaatgtgtgagcagagagttttcttcttttgacagtgcttgtactaattaatacgcgtcatccacgtctttgttgcttgcagatgcagatcgatatgcacatttctatcttttccattatatttttgtcctgatgatgattactagtactgtactatcaattactaattgtgttcgtacgttaatgggcaatataacaagtggtcagaggagtattagtagaagtaacacgaatttcatggcagacatgctggcatatacggggtgctactccattattattcatcgaggagtggtaagtactaaattaacattgacaaaattgaataaaccaccaaattatcacttctgttttgaatttaccctcaaaagctgatttgttacaaaggccaatcacccaaacccttttttgataaatacttatcattatggagccaatcagccaacgtgtacccatagtactacctttatcctaaattacttctctttagaatagtactacctttatcctaaattacttctttttagaatttaaattttgttccaaaatacttatcattacggagtgttagttgtcttattcaaaaccttttcaattttatccttaataataatttcacttcttataatgcattattcaataagaaggaaagagcatgaccgtagttgattgtcactactcatcggctcatcgccgttgccttcaaccctcaagttattcaagttcatctttctgctttaaactacaccctccgtctaaaaaaattaaatattcagaatcatagctagaatttatattttttttaagacagagagtacaacaggtatcgagctggctgatctagcctttgtttatttgcgtgcacggatggatttggtgggtcagcctttgcagcaaattgactttgggtgggagttggaaaaaacaagagtgaccagttttatttacaatcttaacaataaataataacaaatggatggaggaatatatagtaaataataaataaaatattaccatgacgtagagggtgcaggcgaggaggatgaatgggtagcggccgagaaggagtcggcgaggacggcgccgaggagagggagcatgcgcgccgtccccgaccacgcgttcgccgccgacgcgttcgattgccccagcggccccgtcaggtagctgatcaggttcgccgacacgccgtagtaggagaagctgcagcccatctccaacactgcaacaattcattaatcaattaatctctcatgaaatctaatcaaactttgcaaattaaggaacaaaattaaccaaaccgaacaaacatcggtatacgcagtacacgctcactggcgacgaacagtgcggagcgccagccgcctgaggtggcgcggtagaccggccgccctcggaagtcggacacgccggcgagcggcggctccggcggctgcggcggcggctcgtcaccctcattcggaataagcaagggacggcgactgtccatcggatcggatcactcgttggtcgctttgggtgtgctagtgctagtaggatttataggagagcactgagcactctctccaattgagaagaatcagaaaatgctgctgctgttattgccctcgtctcctcctgctgctgctgttcttgttcatgtcgagtgaggcagagaggccactaactatggcacaattatccccgaaaaaaaaacaaaaaacaaaaaacaaaaacaaactattgcatgatttgcaaaagatagcgaaatccaaaccgtccatctccttaacccgtgatatatatgggcatgttcactttgctgccaaaaaaaaaccttatcaaattttggcattttggcatggtaacttgccaaaattttggcaagatttcttatatagttaccaaaatttagcagcaaactaaatgtagccacttttttggcaactttactaaaatttagtaaggttgaaaatgacaccaaagtgaacaggccctatatttcgaagatatttaagagcaccacgaacgaatcgacgacaaaggagtgaaggactgagtagtgagtacctaggatgtcctactggactatagcaaattaaaggagacgacaagtagcattaactgggccttctccccaccgataattcaaccacagcaaattaaagctgatgcaggggtgttaggttcatggccacattttgccacactacattttttattgccacagtttgttagatatgtgtttagttcactgtcacagttgtgactcgccacactttttcaacagcatgtcatatatgtcatagacttaattttcttaccaattttaccatactctgtggctagcaatttattcaccacacttttgtgactaccataacttgcctacaaccaaacacacccttaaaatccatagatagtttcggatggtgctttttgatgattaacgtgacacccacatggtgtattgaaccggttgtcatctcctacgtgacgtctattggatgaatacaattagaaagaaaatagtgggaccaatatgtcattaacatctcttcctcctcctctacccttggtggacgcagatgaatagcgattggcttaagcagccacgttagctcgagctccttgtctccccttcccctagcatcatgatccgtttcctctactctatctctagcatcccaggcagaattaaatcgggccacatcgtgattttgcaacttgacttacactggtttagacttatactagttttaacagtttaacgacaattgatatctgattttcgattgagaaatatgaatggaacatataaaatggacccccttttttttttgttctttcctctacccatatggggcctgttagggagaaaatattttttgctaacacagcacatgtctctcatcatcaatggagaattggagatcattaggtgttacataatgtccatctagaaaacaagggaagaaagaaaaaaaaagtgcacttgttattgctatttcaaggttcaagtttgtatcatcttgcatatgatgtatcttgccatcacaaaaatattgaggcaaatttcaaagtaaatgttccatttctctatagtactgtaaagtaattgcaaataacagcaacatccacaaaaactgtaccaggggtgtaactgttacctgtgcctatatagtaaccttgttcaattctctaacgctatatgtccaactatactaatttctgttttcaaatggaatcctaacgcattcataacataaaaaggatggatatgcatgcatgtaagcagatcagatggtcaagaacaactgaaatcccttagcatgcccatgtcgcgatcaaattgaagccctgaaatgactcagccaaattaacctgattagaattggattcttggtcgtccaaagaacgcttgacaatctggcacacctgcttcctttgtgattgctattctgattagttgaattctggacatctcagttttccatcctctcatagaaaagaagataagcctcgcacttgagaacttcttctaaagagacttctctgatgctgtcatcacttgcacgaaaccatgaggaggagccactggtctcctgccgaggacttgctctcacataagcaaggaagtgccctgcatcgttgccaaggccgcggtgctcaacaacaccaactagacgatagctgagattatctttgtcttctgaactgaaagattagaaaaaataaaaaacgatgaaaagcagattttaactcattatagctacatgtaaacagcaaacatctttcttgtgttaatatccttgtattgaatattgttaataattattctattatacaaaatactactagtatagatcatcttaagtgaataaccatgtaatgttacaaaaataatcaacaaataagacacactgtgataatttaaacaggtattaggtttacgagtccaccatacactaaaaatactgaaacaaaaagtatgtcaaacaattcagttttttaacaaataaaagtgctgcctggttagttatttgagggcacacaccgacaaaagaaaaggaaagaatagaagttcctagatattataaattggattttaattagattgtgattgaaaaaatccagtgtagtcaatgatactctgttacagtgggttgatttaggtaggaaaatgagtgtgatatcatataaacacacctagagttagagagggtgtacaatagatgactctaaactctaaaggtaggatgagcaagaaagcagagtacagtcaaaccatgctgttaaaatcaaatcgcacttgactccccactacagttgaatcattcacattatcaccttgttttcttttttcacatttcacataataagagcataaccattgaaattttactagcaagggtgccagacagccattcaaaattttactagcaagggtgccagacagccattcacaggtgcacctagggaaaaatcctaaatgggttaataatgttcagtaaatcccatgtgggagggggttcattgatctgctgcagcttaagaatgtctattcactttactgccaatttgtcatagtccaaattgtctcattgcctacttaatgagctattccataccaaatgctcccatgacaattaaaacattggttttatcattaatccatgttggtctgtcagcaagaaacaagagcagtgctatcccatgtcctaaacaacctttatgctacacaaaacgaactggttataccaggaaaatacagcagtctggtactctggtgtcaattcattttttgcgtggaacaggagattgctcaatttagagctttacaggttgaattggacaaataaaaagcattgcacacacagtacaacaatccacatgctcataacagcagaacaaggaaacataaattactcattgatatgaaatgctggtgtcatctaaaagcatcattttgtgctagaggtgtattcttaaagtaggaacaaattaataaaaaaaatattaattggcttactgccaataagatagatatttaaattggcttaacacaattagaagtcgttgaacgccaatgccaatatattttcaaaaaaaaaaaaacagagatgaggtatcggtacgacggtacctggggtccataaacagacccatatcaaggatctccttaaatctcacatgtcctatcaccttatgaggtcccaacaaagatctcatcagatgaatgactaatacaggtggcagcttgctaataaaatgttttttaattccacctttattccaatctttctgctcattttgtttttcttccacttggtgtgcaccatgatgaagctttacttgctcccccctttcctcacttagtatgctggcattttgatcctggccgctcaacaggttggcctgtttctcagctggaatgcaactaggttcagcttcttgaacaccttcatggcattcaggtcttccgttggattgctcgcttcggcatgttatcttctctgacagttcactctggtctccatcaactgttatgtcctcattggtacttgacatcataggattactgtatttacctagattgatgcctggcttctgagcaaccttggagcaactctcacaagtccattctaccatctctgcttcaaaatgcaattccaaatacttgtctattgatgcaagagagttgataccctgcgcgttatcgcaagaaatgtcactactccgacttttcctaacttctactgagaaagtgtcagtcttggcttctgaactaacttctggctcactgaacacatcatcaagaacagcactgacatttttccctacatcacttcctgattctatccatgcattctctttccttagtgaaggccctatatcttctggaacatgggcatctgtttttgtcaaatccatttcctcaactttgacatcaggtaacatgttttgaggaaggaaatcaacagtctccccttggaccttatccttctgagtctgcaaagggcgacatacagcatccttgctatgaaagatctgttcaactttagtagaatctgcagaatcaagcatataattttttttgtcctcatcagtatcttcatgaaatcagcaaccatcattctctacatggtctgaaatacagcctttatcctctatatttgattatttgaaacttcttttcttcaaggatttctgtgtactttaagttaaccaacaatttggagcaaaatttattatatgaagacaaggagaactcaaaaacctagagctatcttccagtggcaagaataactactgcactgtaacatacagctatgacatgctataattgcagaaacatcctgcaggttctaatatttctgtagtatatttaacagtcaagccattaactctttccgaaaaatgccctttttcttatattgagcaaaaactaacaaataattgtggtaatatcagagttttctgcattcactcaagaaaaattccatgttctgagacacccaacatgttgcaggcactgttaaaaaaaatgttgcaggaatgttgaacattgttttcctttcctttcattaggcacaggagcacataaacttaccaactttcaaaggctcagaagttttcaccaataccacatcttccaattctgaaggactttgagaatcactgtcttcagcaatagtatgaatcttttctgggttacgcttgtcaacttctagttcagcatggatcttctgttgagatttatatcctttagtcctcggtggagatgcaatacttttggattgagttggtggaaggggcaccgagagatcatggaatgcaacatgtgaaactgaactaaatgagcaacatttacacgatatgtgagaagacagctgaccaccaaaaatggaatcagtaactgtaggagtcactgcatcatcttgcatgttaggaggatttgtccccctgtcctcctcatccaatttttttcgcaaacagcaaagcaattcatggttatcttgcataaaagctcctatgaaccgtgagtccgacttgcgtacataagccaagagccaagtcatgtccagcaggcctcctgtattgttcacaccgtatgtctgatcaaaaagatcgtacagtattgtaccaagggtccccagtggagtgtccggtcctaacatccttgcccgcagctttccaagcacaaggaggcactgcaccaatgaattcaagtagcaggtgtttccaagattcagtatccctttgatagcatgggcatgcccatcagctaacccagacacatgtgacctctgtcgtaggctttcccccatcatcatccttaacgctgatttcgctgggctctcttcgcgcggcaccccattgttgtcagtcatccccccatcatcatccttaacaccgatgtcataggcttcttcacacttgaagcagtacacccgattcaatctctcatagtacaaagcaatcgaatgctcttcttcgtgcatggcgtggatacaggcgtggttggcgcagaggcgcaactcgcattccaagcacaccatgatatcgttcgccgcggtgacgtcgcaggtgtaatcaccgcacaccgggacgtcctcggagaacctgagccccgacacgatgtaatcgacgtgatcctggtcagacatgaagtgctcgcaccgctcaacgccggtgccgctggcctccagcaacatcgcctggaaccactcagaatcgtccgccgccgccgacgccgacgcagccggcggctccaggcgcggggatttccacgggctcccggcagtatccgccgcccttgccctcttcccctcttccatcgcgtcttaaaccccaattcaaaccctacagattagcgagatcaatcaacatagccaaaaaaaaagtgagaatccaccaacaggatcggaaatcgaacatgaacagcgccgcggcgaatccgcacaccaaaaaaaatagaaaaaaaaacaccaacacccaccgatcaaaccgcccatcggcgacgaacagcggggtttagggggtgtgtggaaatgtgggaggaaacttaccggaagaagcgaggaggacccggagtcgactagcgccgcggggtgaggcgtccgcgacggcgacggcgacgacgacggcgagaagttggaggaggagaggagggggggagagcggcgaaggcggcgtcgctggtcggggacggcggcgctcgggtgggtgtatattgggctaaatgggcctaggtggccgtcgtgagttcaacggagcccatggaaagtatatatttcctcctgtaaaaaatgaaagtaaatttcgaaatgtcacgtatactaccttcgtcctaaaatggtttgaccacggatattaaaaaagtaggtgaaaataatgaaggaaagttgtgattagttaagtagagaaagtagatgagaaaattagtggataatgtgtgtgattggtaaagatgatgacaggtgggtagataaatagcttcatttttggaaaaactactatgctagaaatagcatttagtatctttttaatagaaagcatgtatatactcatggcatataaccgcagagtttatgatatgtgaaataatatttcaaagtaatagagagttaacccaatcatctgaattttaaaaaacaaataatttaaaattctgtagacaccttatggcatgaaaatttaattaaatatattatctggattatatgggtgtggattttctggaatcctgggactataatatcagaaattcagggttgcatgccacaagttatactaaggttggattatgcaactttaagttatcttaaatttacttaaaagaaccctctttccagaattccatgttctcctttttatgcttttcttttccaaatgaggttcagttttttcattcgtgatgtcaggccaactcgattgcacaacacttgggcaacaccaacgctataaattgac

SEQ ID NO: 23069 - DNA, 2157 bp, Oryza sativa
cagtcataatttcaacaatccaatggaaaatgttaggtttgtttatatccatcataccctaaaatactgaaacaagaacagaactatatcgaacagcccggacttctaacaaaataaaaaggtttccaggttagccatttgaaggcacacccctaaagaaaaagagctaaaagcttctagcctagagttaatctaaggatgtatgatctgatctgactgtaaagggtaggcaagagcaagagagtacaatcagatcgggatgttaaaatcacccaaaattcaaattatttgattacccaaatcacaattaaattccccaaatgtagcagaatcattcacgttgtcaccttgtttcgttgtaatcatttcataatatcagcgtaacaattgaaatttacttgcaaagggagctagacagccatcaagaagcacaccatttcttatttaactatggttaattttacaggagacatctagaatctagattacaacttgacacaccatacaataatccacatactcatagcaagaaaacatgagaaatggactaaattactttgacctgcaatgctagtgtcatctgaaagcattcttttaggggagaagtgtaaaacaaatgggaacaaattgagaaaaataacatttatcagcttactacaaataagaaacttaattacacgggcatagaacaaacagaaatctaataaacatcatcagtcatatgttttcggaaaaaaacagatgcagttgtcacttgtcactacctgggatccatgaactgccccacatcaaggatttccttaaagctcacatgtcctatcaccttcgttaaatcctccaaatatctcatcagatgaatggtcaatacaggtggcaacttgcgaataagacgtgtttgaatgggacattcattcttatctttctgctcattttggttttcttccacttggtgtgcactcttctctaactgttcactctggtctccagctgttgtgtcctccttagtacttgacatgatgcctggcttcttaagaactttggagcagttctcacaggtccattctatctctgtttcaagatacaattccaagcatttctcaatcgatgcaagagagttgatatcatgtgccttgtcataaacaacatcgctaatctgagttttccccttgtcttttgtagtaacttttgctgaggaagcggtcatcttggcttctgtactaacctctggttgaacagcactgtcatttttctcttcgcttagtggagaaacaaatgatggtgaagcaggatcttctggaatgcggggaaggacatcaacaacctttccttggaccttatcctttctagtctgcaaaggaccacctgcatccatgctatgagatatctgttccactttggtagaatctgcagaatcaagcatataagtttttagttttgtcctcaacagctacttcctgaaaccagcaatcttcattctctacatggtttgagaacctttatcctctacatttgattatttgaagcttcttttcttcaaagatctccacatgtacttaagttaaccaacaatttggagaaaaaaaattattatacgaaaacaaggactcaaaaccccgagctatctccccttggtgataattattgccacacttgtaacaaaaatctatgccatgttaaaactgccgaaacatcctgctaatgtaaacatcctgttgtgcagtccatgtatgaatcaagtctttaaacatttttcttcatgtagctagtacgatagcgccgttccagaaaatgcccttttttcttatcttgagcaaaaactaacaaacaatactggtactatcaaaggttgctgtgctcattcatgaaaagttctatgttctgacttctgagacagcatgcacatttgtaggattgttcagcattgttttcccttcctttaattaagcacacaagcatataagcttaccaacttttaaaggctttgatcttttcaccaagaacacatcttccaattctgaagcaggactctgagtcttttcattgtcacttttgtgtttgtctattgctgaaagcaggttgatacgaatcttccgtggagatctgcgacctttagtccatggtgataattcatcacttttggctggagactcctgtggt

SEQ ID NO: 23070 - DNA, 311 bp, Oryza sativa
tttgagctccaaccttttcaagatctttgatcttatgttctacgaatgcgatgatggaatatttcacctcttgctcagtcacaaatcggggtgttatcagtggtaagggaatccacgtcagtagagcgaagttatacagagcaatcgaacaagaatacgcctcgtggcaagcaaggccaacaggcttgccctcattctcggatcgcacaaatctatacctttccatttaggcactgaaagcttagaattattataatgtagattattagaagtaagctgaaacaaacagatagtttattataatagatcat

SEQ ID NO: 23071 - DNA, 1687 bp, Oryza sativa
gatcagctgcaagtgatgtgctgtgaacccgatctcaattctatttcttttcaactactcaatgtctccatttgttctactgtatagtaagcttagcatggaactatgattttagatatagttttgtccaaatttatatttctacaatatatcaaattcgattctaagttactatatattgagacggagggaatactcacatgattattattgagagaaaaatttgatccacgtctctaaaaatgtttcttaaaaaaaattcctaatgcattgtatgcatttcttgttctaatgcatttgttctaagtcgtttgttaagttatttatcaaaacatttaacttactaccccgtctcaaaatacaagcatttctagctatgaatttagacaattatgcgtctaaattcatagctaaaagttgctatattttaacaggtgtggtatatcatataatctactataataaattagtcaataatctattttaaactaggccataatctagtatttggaattctgtatgcagatggaacattaatcatctgaactgcactctttctctacgagcgattctgtcagtctgtcggtggccgctcctgtctcactccatgaatggagctgaactctagtgttagaactgcatttgacaaagctcatctgccagattaacgtggatgaaagttctgaatatattggccgatgtacaagactcgtggatgatcctggcaacatgtccacttttgctaatgttgatgccatatgcaaagattaaaagtagaattttttttcacttttttcacttgttgtagtgtgtagtgacgcctgatgagaggagcaataggtcaccagtcaggggggtggcccactggctaggctcacacatggccggggcccacagctttgggggttcatgggttgatgatggaaggttctgttctttagaccatgatggaatgttgatcttaaggtgccattgatcccacctctattattctcatggcatgttgtggaagaagcttcaggttcaggcccatgcattttgcattggtgaacatgagccaggatgcatgaatcatgatgagtgaaagatccatccaaggagtgtatactcaatgattaatttcattttgctcttgatcttgtttggtttctccggccaacacatggctgtccaaatccagacaagcccaatcaaatccaatgcagtatctggtccggacagggttgtccttgtacttagctctgttgctgattgaaatggactagtatttcctgacactttttgcagaggaagggcatattgtcatgtgaaattatgctgcatccggctagtcttttgctcttctttcttgatgccaatactcaaaggaaaataagaagatacagtaaaaaaaaagatgaagaaaattacaaaatggaaaagaaaaggtatggatcatgcaacttctcctgaacctgttaatctgctcgaaaagaagaagataatacaaagaggagatattgatttgtgttcaccgacatgcatggtgcatggacagaaatgacaccaatgaatgatccttcaccaatgtcattttcttggattaagtactgagcacgtcctactctcacatcatttcagggaagctggagcttggagcctagaagcagataaaagagagccgacggtttggatccacaatgagctt

SEQ ID NO: 23072 - DNA, 1839 bp, Oryza sativa
ctcgcgctgttattggttgctcctcgcggtctccttttttggtgaactcatgcggcgtgctttgaggtttatggatttttccctaattcgttctggttttcttcggggtttattgattcacgcgagattttttggcttgtggttgttgcaattgcagacgtgatggacgacgagaagaggccgagggtgggggatactgccgagagcccgcggaaatccccgcgcctggtgcaccgaattccgacgacgacagatcaggccgaatctggagtcggtctcaagtccttgcttgggttgatcaaaaacaatccgagcaaggagctcgatgacccaaatgctgcctctctcggtgaacttctatgatcttgttctcctcctcctcctattttcgctttcttcagttcttggttcatgttctcatccctagtccttaccgataatttggggtttctggattcacgcgagtttttttggcttttgattcttgcaatttcaggcgtgatagacgtggagaagaaggcagcaaggccaggggatactgcggcaacggcgctggatgtgaacgattggtgggagaaagtcgtggcgttacaatggatggcatcggtcggcggcgactgccgtgctcggcggtgccggcacgtcttgtatggggaggatgacattaatttggccatagcactgatcaagacctgcgatgacaccccaatgtgtaatgctgacaattgtggcaatactgaggggagggaaatctcggcgtgcttggattgcgaatcgcgtttctgcactacacacgggaaatggcacgcctcggtcaacaagcattgggttgctttggtgtacaaaaagccacatgtggcgtattgcttcgcgtgtgaagagtgctatttcatcagaactgagcattttggggtggtaatggacaacgaggatgactatttcatcagtttacgtgaggaggatgagaagggaatgagagttgacaatgtggcaggtgatcatgcatctgggtcagttattgggcatgcctgtcctattaaagggataccgaatcttggaaatacatgctacttgaattcattgctgcagtgcctccttgtgcttggaagactgcgggcagggatattaggactagatgctccattggggctccttggtagctcactgcgatctctctttgatgatgcagacagtgtaaataatgcaggaggcctgctggacccagagaagctcttggcttgtgtacgcatgctgaacccagagtttaaaggcaatggtatgcatgatagccaggaagcactttgcattttgcgcactggtttggacaaggaggagagggcaatgaagctgtctaacatgcaagccggtgctcccagtgcagtggctcctacagttattgattccatttttggcggtcagctgtctgttaccagttcatgcaaacattgctcagttagatcactttcccatgatgtattccatgatctctcagtgccactaccacaggagtctccagccaaaagtgatgaattatcaccatggactaaaggtcgcagatctccacggaagattcgtatcaacctgctttcagcaatagacaaacacaaaagtgacaatgaaaagactcagagtcctgcttcagaattggaagatgtgttcttggtgaaaagatcaaagcctttaaaagttggtaagcttatatgcttgtgtgcttaattaaaggaagggaaaacaatgctgaacaatcctacaaatgtgcatgctgtctcagaagtcagaacatagaacttttcatgaatgagcacagcaacctttgatagtaccagtattgtttgttag

SEQ ID NO: 23073 - DNA, 2008 bp, Oryza sativa
ttatcactagattgctaatagcaatcatagaaagaaacagattattagcctagaccgggatgaagaaaaaattgaggggaacgatgcttcaaaaaaattacatcacaaaattctataaaaagttttttagaccaccggaagtaagttccctttccctagatgattccaaattagatgacatcccccaagtgtcggaggcagaaaatgatcatcttattgcccctctctccgaggaggaagtaagagatgcggtttttgggatggaaacaaatagggcgccagatccagatggctttcccgctgaattttagcgaaaattttgggatgttctcaagcatgatttattgcttatgttcaatgaattttatgctagagagttcccaatttttagccttaattttagggtaatcaccttgatacccaaagtaaaagaggctaaccgaatacatatacagaccgatatagtcttttaaatgctagctttcaaatcttcatcaaggttgccactaatagaatcaattcagtggctgatcgtatatatagtgagaccaactcagacagctttcatgcgagggaacatctatctcagacagctttcatgcgagggaacaacatctaactgaaacaatgaaatactagtgctcgataggagcaaattatatggttaaccatgtcattataacggaaaagaagcatttcatagttaaccgtatcattagaacgaacaaggaaagaggttatcgactgttcgagtcccacgaacgtccgcgaactagacccaccccgattacgtggtgtcaaagacgttaaaatcagccctgttatgtcatttggccttgattcgcacgcagtacacaagttcgtgcatcagtctgtgcactattgcatataccttgcgtcttcatgtactgctaacttcatttactcaataagcatgggccagtcagacattcatcatgatatgacgacagtttagttcatgtacaatataaactttccaaagtgtttatacagtatatatagtcatagctatttcttaaacttttaataaatgcaaatatatacaatatttaaagaggcagactaaggagtataaaaaaggatgcttcacaacacgattgtcacaagatgaaaagttcatcttgctctccatggtagatacaaggaattgctttggtgcagctcctgtcctgctaatgtaaattggtgtttttcatattattaagagaaaataaggaaaatgccatcgaaaagatacaagctgcaagatatcatcgcctatgagaatggcatgtggggaatgtcaataacatatatgttggcattttccaactccgttattttttagatgccaccaagcaagctgtcattaattaccacgttcacattcaatatgtttcctaactacacactagcacaagtgttgcaaattttattttccctaggtatacataacaaaattgaaaaaattacagggtagacatattctattcaagcaaaattttattatgagaatcaatttcatttgctagattttaataaaacaaatactcagaaaatagaggacaagttcattgttcagtaagtatgtatttttttatctgtccaattaagtttgaatttggactagaaattttgtctgtcctagcttggtaatttctagaccgagttgaaatgaaatttgcaaaaagtgtaccatttccacatgatgcttccccacttaattctttaaattgttgattcagttactcttctccagaaattttacatttgtaaaaactattggatgatcttcagccttcacattatcaacagttcaaatgcttaaaagtatccagaaatatgcagtttatagacatgtcattagggtaatgactcaccgaagtgatcttcaatcaagcctcagctgtttctgggagtgtaatcaatcgggatgcagaatcgtataccaatgaactgctacaactgataaacatacaaagtaaccacattagttaaaatataagat

SEQ ID NO: 23074 - DNA, 2672 bp, Oryza sativa
agcattgtcattttgccctaaatcatcagccttacttggcgagcgctgttccacttcaacagaatctgcagaatcaagcatatataaggctataatttatctgcatcagcaacaacacacaaccatcaacctccattctctacgatctgaagctgcctttcttcgagaatcaccatacttgattaagtaaaccaaccttctagagcaaaattttatgtatgaagacaaggacttaacaaataaacagtcttccactctaaggtcttaactgctagactacgacaaacaactctgccatgctaacagtgctcaaatatcatacttcttttatgtagccatcctgaaggtttactagatatttcttcagtccatgtgttagtaagtccttacaaatttttctctgtttgactagaattggagctccattccgaaaaaagtgcccgttttctcgttatgatgagaaaaacaatggtggtgtgactacaatactcctctgtttctttcatttattcctcaaaagatgtacatggtctgggaaaccctctatacctgcatatctgttcaaaaatgttctctctccttttatttagaaacacaatgcataaacttaccaccatccaaaggctcagatgttttctctttgtccacatctcccagttctaaactagcgatatgagaaacactgccttcagcaattgctttgacaatttcggtgttactcgtgtcaccctctgggaatagtttgataccagtcttctctcgagacatgcaacttatgtcccttggtggcgatgcaatactttttggcggaggcctctctgatggcagtggaactgagagctcatacattacttcatgggaaactgaattatatgagcaatggctgcaggaaatggtagcagacagttgaacacgaaaaatggaatcaacaactgtaggagatactggaggcaccattgacttctcctccttatccaattcattgagtacaaagcaaagcaattcatggctatcttgcatatcactgcctacaaattgtgcattcaaaacacgaacacgatccaagaacttcgtcgggttcagtgggcgttgtgcattattaacactgtttacctcctgaaagagctcttttagtgcgctacccacgaacccagaaggagcatctgatgctaacatccttgcccgcagtttttcaagcacaaagaggcactgcaataacgcattcacgtagcaagtgttcccaagattcggaatccctctgataacacagccatgcctctttgctaatccagattcttgatcaaatgcctccttgccaaacaccatccccctctcagcattcggtgcacctaggatcaattcgaattcacatttgaagcagtaccccatatatggattactgtaccacaaaccaacccaatggtgttcacacttctgggcatgcagacgggcatgtccatacggttttttcatggcctcagctctagtgcagaaatgcttgttgcatcctgtgcaaaccatgatatgggtattcccagtgatcgtacacccgggatgttggcacgccggaacgttcttggaggcgaagatctctgacacgatcagagtgatttcttcctcatccaatacaaagtgttcgcatcccacttggtcgctgctgctgtcactttctgcctccatgtcactcatctccaagttcagacaacgttcacaaatgaagcagtacagagtatccggtttactgaacaacgcagcaacacaatgcttctccagatgagcgtagaattgggcgtgttcctgggcgtgtccctgcggcttgttcatggtcccgtccccaatgcaaaaaggcaagctgcagtcgatgcacaccatgatactgctcttgtccaccttgctatcgcacatgagacgctgacaactcggggtgaacttggaggccatgagccttgatacgaacattgccatgtcttcctcgaaacgttctaagtgggggcataacccttcctcggtgttgctggtcggcgccgccgccttctccttaggcttgctcacctccggcggagccgtctcgccgcattcgggatcgggcgtggccgcagccagcgggtccaggtccttgcggggggatttgagcggcctccccttgctcgccttgtcgtcgtccatcacgcctggggacgcaagaacaacaagaaagaatcgagttaatccataaaatccccatcgaatcaaacaaagccatacgaaaaaaacagcacaaaccaagcatgaaacaacaaggctaaacggaacaagcaaatcatcaaacaggttggccgccgttaggcgagggacgaccaaaatccaactccaacaacaaaccacgccacgcacgaacccgtactcaggctagggcaaaccacgagagctccacaagcggggaaaccacggaaattccggcgaggaaccacgaacgcggcggattccagcaccaagcaaaaccccaacccgaacccttaccctcactaccaccaccaccaccaccaccaccctaaccacaaccaacaacaacaaaaaacagagcgatcaaccccgcgtcggcgacgaacagggggatttggggggagaaatggaggggaaatctcaccgggaagacgcgaggagggcgccgaatcgatcgggcgcgcgagccg

SEQ ID NO: 23075 - DNA, 1799 bp, Oryza sativa
aaaaatactcttctccacaaaaaaaaaaaaaagagaaatagccactatcctgctgctgatggtttgctctcacacaagcaacggagagctcaatatccactgtggtcagttatatataaacttcaatgaattgagtctggcaaccgtgaatcgtgatgggtgatatcatataaaaacgaaccaagagttgctctactgatgtagactgactctaagctataacgggttaagaagagcataacatacacaaggcccaagttggagggatgcagtttatctactgcagctttagaatgcctattcactttactgcccatgatattacagtcacacttgcctcaaggctaattatgcagctcctccaaacaaatgttttgatcatagatagaacatggggtttttttttgtttctatttcattaacctaaaccatgctattctgccagaaagaagcaaagggcagttcttcatggcaacagagaattgtccctacggcgagctgctatggcgctccagggccccctcgtgcgtccgcttcttcatgtggattgcgctgaaagatcggtgcctcactgctgacaactttgaccgacccggcaaaaaaagaaaaaagaagaaaagaaaaggagagcaaagggcaggacagcgctatcataagtcgaaaacatgtttctatgctaaagaaaacaagcaaaccatgccaggaaaattcatttgtgcaccactgtggaagcatggttactttgatttactggtttatttcgacaaacaaaaacaaatgtgcacacagtatgcaataattcacatgctcaatgcattcaggttttatattggctatgctgcaaggtactcctaccacaactcatccctaaagtgtatcctttggtatctgtgtccactgcgggtttctgttcaaaatcgctggatagctcacattgtgggatctggcccggtttctgcggaatctagcccaaatcggagaggccagaggctggaggtcccaaagtggagatgcaaataaacacattacaagtatccaccgtccagaacaccgtccagactggagaggatttgttcaccagagattccagtcatcctttcttgtttgatccatcagaacaccagaaactgtaggggacttccaaagcagcaagcaagcaagtactcaaagcatgctgcacatggtccatctaggaaattatatgcctgaaaccatgtcgcttagcttgcacatccaaaaaaattgggggactaaagctcaagatatatcaagtaatatcgttctgtattttagacctattgtaaagcattatcaatcattagtacagtcctgctcatttacaaatggcacatgtcctattccttcattcttattccaggaaaagaagtacgttcctcatgaacaaaaaggagattatgaatgcgatctatttgcagtcctacaatgactcagccaaagcaacaaaattggacttgatcatgacgtctactgaatggatctttgtccatccaaagaatgtttgctaatctaaccaatttacttccttggacgttagcctccaatcctctcgtagaagaaaagggaggcctcgcacttgagaacttcttctagagatacttgtctgatgtttgtatcacttgcacaataccatggagaagggccaccgtgaggttgctcttgattcggtctcacgtaagcaaccatgtgccctgatctggtgctggggccaatgtgttcaatgacacctacaaggtgatagctggaattgtctttgtcctcagaactgaaggttacagaaa

SEQ ID NO: 23076 - DNA, 614 bp, Oryza sativa
  unsure (1)..(614): unsure at all n locations
cgtacgtccgttcgagagtgatcagtacccttctccgaaaaattcaaatacaaattttaaaaataaattaatttgatatttcaagcaactttatataaattttttttacaaagaatacaccattttaacaatttaaaaaatgctaagaaaaatctatatcttaagtagaattaaatggacaaaggttttgagaagaggagttattaggtagggaaacttgaacggcggaagattattattggttgaaaaaatgatatatatatatatatatatatatatataaactacgtacaaaggagttatattttatgataaattttaaaggtaaaaacttattactacaaatattttagaacggataaatacaaaattgattggatttcacgcgcatgggcgcatgattgcaggggcttggcatgctgactgtggcgtcctcgctgccggcgtgcgccgacaccgacgtcgccgacgncgtcttgcgttctttcatggcacaagtgatcttcgtctacgtttcgctctacctcgtcggcttcgctaaggattcgacaagccatgcgggttggcgttcggcgccgagcaatttgacccgggccaccccaaggagagcgccg

SEQ ID NO: 23077 - DNA, 1485 bp, Oryza sativa
agcagggggagagggtgtccctgatggcgctgctggagcagacggagcggcagtggagcgccggctcgggcgcgaccgtgcagcagcatctcgcgtctccctccgccgccgcatcggcatcggtatcggcggcggcggaggacgaggcggaggcggaggcggggaagggggcggcgggcggcggctgctgctgcgtgtgcatggcgcgggccaagggcgccgccttcatcccgtgcggccacaccttctgccgcacctgcgcccgcgagctcctcgccggccgcggccgctgcccgctctgcaacgccgccatcctcgacgtcctcgacatcttctgacctcgccgccggcgaccaaggttaaccaccctcagctcgagccaagaaccccactgatccagacatagatagatctctcctctcctctcccctctgttcttgattcagttcttcgcaaatgcaaatgcaaaaaaaaaactgcaaagattagaacctgttcatcagcttgttgcaacttgcaagagatcaaacattctcttcatgtttcaattccccccaaaattcaaaaacctagtaccctggatcgatcaaaaggtttgttcttgcgtcctgtaggaacgcatttgattcaaccatcaagatcagcagatggtgggtgggtgcctgcttgcctgggtggtggtaggttaaaaattagtaaaacttttgactactggagtacagattagtagtaattgtaaatctggcagagttttttttttttcagttcttgtccaggctccagctacgcaatgtttgaagatctatagtaagagcaggtttacaaaacctcacggttatctcgggcggtaacttttcgcatggttaaaccacgatgtgactcgcggtaatacgtgtttttcgtgatatccgataaccgttaaactgtgaggtgacgagaaccacatccaaaacggtttggtaaataatacagtttttgaaaccatgatatgcctcgcgataacatcgtgtttggtatccgataaccagtcaaactgaggtgacgggaaccatatccaaaacggtttggtaaatccttgagtaatagtagaaataaatcaatatactggctgcagtgctagtgcgttaaaataactccaaatttattgctccaaagcttccaattatcaacctcacttcattgtgcatttccctatggtatgaaactcatttactttccacggagggagcgccatttcaaatgctgattaccctctgatgtcacatgatttggcgaaatttatgaccagaagtcgaaatctcataaatttgcgcgacaccgacgcaggagtacaattagtagcagtatagcactaatactctaatagcatactagtataatctcattctaggggtgctactcatcgggctaatgatgttgacctgataaaaagattcctttgcactaatcctcctttctttttctcataataatggactaatgtgg

SEQ ID NO: 23078 - DNA, 1769 bp, Oryza sativa
ctctattagctagtacaagaccctgctctgatagttaccattttccaatgctgagcaaaacaataacagataatagtgctgctatcacagtttgattcattcacgaaaagttccattttctgatacaccatgcaagtttggagccctgcttaaatcactttcatttcctttagttaggcacacaagcacataaacttaccaacttccaaaggatctgatgttttcaccatgactgtatcttccaattctgaagcaggaatctgagaatcaccgccttcagaaagtacacaaatcttacattgagatataggtctttcattctgtggtggtgatgcaacactattggatggagcaccctttggtggcaatggcactgagagatcatagaatacatcacaggaataagacttaaacgagcaacgtttgcaagaggtggtaacagacagctcactaccaaatatggaatcaatgacggtaggagccacagaactaggagcaccctgttgcttgtttggaggccttattatcttatcctcctcattcaatctattgcgcaaacagcaaagtaattcatggctgtcatgaattgaagtgcctatcaaccatgagtcgaaccttcgtacacaagccaagagcaacgcccggttcagcgggcctggtgcatgcctcacgctgtttgcatcaacaaagagaccacgcagtattgtaccaaggatccccaatggagcattcggtccaaacatctttgcccgcagctttccaagaacaaggaggcaccgcaacaatgcattcaagcaagtgtttccttgattcgatatccctctgataacacagccatgcccgtcagaagacccagatgcatgagaacctgcctctgcgttgactgccaatccctccttgccctcctcaccacctatgaccaaggaatcttcacattcaaagcagtaaccaacatacagatcattgtgccacactgcaacccaatgctcctgaagcaatgcatgctcccggatgtgcccttgcggcttagccttggtggctggctcaatgcagaaataccctttgcattctgagcacaccatcatgtggtgctccccggtggttaggcacgtttcattatcacacattgggtcacccttttcagattcaacgaaatccttgatgataacaatgttctccgtgtcaaacgaatgatgatggcacacgacagcattcttggaggagctgacatctgactcgatcctatcaatttcttccttgccacatgagaagtctccacgctgcatgttgctgacatccaagtccagaagacgttcacagatgaagaagtacagagtttccggctcaccgagcaaagcaccaacacaatgctcctccagatcggcatgccaccgggcatgtccctgcggcttgttcatggtcccgtccccaatgcagaaatgcaagtcgcagtcgatgcaaaccaggatactgctcttttccaccttgttctcgcacaggtaatggtcacacctcggggcgcaatcgtaggagtaggacctgagctccgagatgaacttgagcacgccgtcctggaaagggtcgaagtgggggcataccctcccctcggtgttgctggtcgacgccgccgccgccttctgttccgggctgctcacctcatccggcggcgcagtgtcgccgcatccagattcgggcgccaccgcatactgcgggctcatcccctttcctgtctccatcgcgctcttcttctcttccatcacgcctggggc

SEQ ID NO: 23079 - DNA, 2661 bp, Oryza sativa
caacggcgtcaaacatttagaggagggagtaccatccaacagatgtacagtaactgaactgtaccaatgcctatacaatcacctcggtcaattctctaatggcacatgtcctactatgctgttttttttttctaaatgaattcctaattatccattcctcatggaccaaaaaaaatggatacgatcagttggtcaagaataaccgaaatttctcaattggtatgtacatgttgcggtcgaattgaagtcctgcactgactcagccaaaggccaaagcaacaaaattcaactagatcacgagcctacgttggtatctacatactacactgattaaattggatcgttggccgtctaaagaatgcttgacaatctgacatatctgcttcctttgtgattgctattcggattagctgaattccaggcatcttagccttccatccgctcatagaaaagaatgtaagcctcgcactttagtacttcttctaaagagacttctctgatgtcggtgtcacttgcccaaaaccatgaggaagagccattagtctgctgcggaggacttggtctcacataagcaacataatgccctgaatacatgctatggcccaggtgctcaacaacaccaactagacgatagctggaattatctttgtcctcagaactgaagattagaggaaacaaaaaaggaccaaagcagatgtaaggctgtaactcattatagctctatgtaaacaacatcatgaatttcttgatattatttaatacatatcttatgaacaggatattgttaacaagaaatatctatctcatctcacaaaaaatatatcagtttaagtaaaatactactccctcaattccaaattgatctacatatttcataggtacaccaagaccaagaaaagctaataactctctcatactatatttattctagcaacaaactctatgcatgcaccattcccaatatttcctagccaatagcaaatcaagatattacatgtgggttataaatacttgtgtgcatggatgcatgcatcaatgtctatttactccaatgcacaaataacgaatagacttaataaataaacacaaatatgtaaatcatttaggaataacctcaaaaaaaactatatgtagatcaatttggaatggagggagtagtataaatcatcctaagcgaataacaatgtaaagttttaaaaaataaaaaaaatcatctgaaaactatttatacatacccaacatgtactaaaaatattaaaaaaacacaaatatatcaaacaagtcatattttaagaaataaaaaaggttggcaggttaggcatttcaaggtacacatcacctacaaatagaaaagcaaaaagcaatcatacatactaactcggatatttttaacgggatgtcattttcataaaaaaaaagaaaataaaataaaaaggaggataaccacaagggttactctagagttactctatggatgtagcctgattctaaagggttagaaagagcataatatacacaaggcccatgttggaggggatgcagtttcatctgcggcagctttagaatgtctgttcacacactattacagttaacttgcctcaacagccaacacacattacggagctcctccaaaaaaatgtttcaatgataaggtttcttttgtttttgttcctttagcctgccagaaagaaactaaagcaatgctatcctaagtcgtaacctgtttctatactaaacaaaactagctcaccaagtcaccatgccaggtaaattcatttttacatatcgatggctgcatgcttgttttgcttttctggttcaattcgataaacaaaaacaaatgcgcacacagtatacggtagcccacatgctcataacaagagtgcaacaaaaaaggacagactaaattactcagtacctggggtgcaggaacagtcccacatcaaggatctccttgaagctcacgtgtcgcctcactttaataggccccgtatttctcttgagctggatgactaacacaggtggcagcttgctaataagagatgtcttaatcgcaccttcgttcctatcttgctgatcatattggttttcttccacttggtgtagatttacttgcttcctccttccctgatcttcagtgttggcattttggcactggccactcgacaggttgactggcttctcacctagatggcagtcaggtacatcttcttgggcacactcaagacattcaggtttttgattgactatgctgaaagaggatgagtctttttcaccgtgactcatccctgaaatgtctcctttggtcatagtgtcctctgttggcataacttgatgctgtgcatcagcaacatgtggctgcctacttgaagaactgcattccccatccaatctgaccaaatcgctagattgctcactttggcatgttttcctctctgactgttcagcctggtctccatcaactgtcctattcacattggtacatgccaccgtctgttcaccatctttaccacttatagggcttgccttctgagcgacattggaacagttctcacacctcttttctaccatctctttgaaatgcaatcccaataactcctcaattgacgcaagagagttgatatcatctgcctcatcataaactacatcacaatttcgatc

SEQ ID NO: 23080 - DNA, 1302 bp, Oryza sativa
ctcctaaaatatcctttttctcatgttgagcaacaaaataacaaacaatagtggtagtatcacagtttgccgcaaccatcaacaaaatgttccgtcttccaattcacacgcacgttttcaggcctgttcaacatcattttcctttatttagttaggtacaggaacacataaacttaccaactaccaaaggctctgatgttttcaccatgaccatatctcccaattctgaagcgggaacctgaggatcactgcctccagaaattgcatgaatcttttcggtgttagtcttgtcaattgttggaaattgttcgatggcaatcttctgttgagatatgcatctttcattctgtagtggtaatgccacacagagatcatagaatgcatcctgtgaaccctgtgaaactgactcaaatgagcaatatttgcacagagtggtaacaaacagctgaccacgaaatatggaatcaataactgtaggaaccacagcactaggagcatcctgttgcatgttatcaggcctcgttttactttcctcctcaatcaaactatcacgcaaacagcaaagcaattcatggctgtcttgcatagtattgccttggaactctgatttatagtggcgcacacaacccaagagcatcactgggtccagcaggtctcgtgtatagctcacactttctgtagcaacaaagagatcatgcagtattataccaagcatccccgatggaggcggagcgtccggtccagacatccttgcccgcagctttccaagcacaaggaggcactgcaacaccgcattcaagtagcaagtgtttccaaaattgggtatccctctggatggcacagccatgcccactaccagacccagatgcgccgatgacacagccatgcccactatcagacccagatgcgcgacagccttcctcgcctttgaccttcattcccttatcaccctcctcaccaccaatggtcaagggatcctcacactcaaagcagtaaccagtatacggatcttcgtaccacagcgcaaccggatgcccatcgtcgaacgcatgctcctcgatgtgtcctcgcggcttagacttcttggcaaaccttccaatgcagaaatgcatatcgcattccacgcacaccatcatgaggtgcctctcggtgcacatacaggtttcatcctggcacaccgggtcgccccaggacgcaatcttggacacgatttccgcaacgtcatgctcgctgcaggtcatgtgctcgcaccgctcgccgccgccgccggcgccgcctctggttgccaccgccgcggcctcc

SEQ ID NO: 23081 - DNA, 825 bp, Oryza sativa
attgacgagtccgagtttccacaaaatattcgtacaaatgatttagtatcagaaatgccattgccgttaaggtttcgtccatcctacgccgttaaatgcattgtttattctatagcacttaatggaaggatgctaacggaaccctaacaacgatgatattttagagacaaaatctcttgtatattgatattacatcaaacttgtatttatccatgatatttgttggaatataaagtgaattgcccgccttttctcatcagcttaaatttttgggttgaactggtcggtgcatacaactcaatatggtattagagccagatgtctcgagttcaaatctggctgtcgcgcaattaaataaaagttgctgcccatttctattccacacttgcatgcaactcaatactaatatttttgaaattggatgcttattaattaccaacctcaactctcagtctctctttctgggattttctcaaatctcaatctctctttccaaccccaactctgcccgactccagtgtcctccaaacccaacacgagccggaacgccaccggctccctccctcctccaaaacctctcggcatcgttctcgtcgattccgagccctcgtcgcgcatttctcccccaaaccaaatcccgctgcacgttgcggcgttgcccgatgcgcgcttgatccattggttggtcctcacccggattgtctcgatttcctctcttgttctcatctttctttcgcctttcttggttcatgttcatccggaatgtttattatcggattcttgcgattttttcttcctgttccagagtccagacggcgatgtatt

SEQ ID NO: 23082 - DNA, 450 bp, Oryza sativa
aaagggttcataaaccctcttagaaataactaaagattctaactacattaaagatatgtgattttgcttcagattatttaaaaatctttttaattgctctgaatttatcttcagtataaggacgatatcttaaattattatcaaacccagctttggttaagatcgttttggcataactaaacgttttaaacccaaaataaccatggtaattacccatcccactatttccaacaccaccaaacggagtgtggctgttagcaatatgaatgatcgtatcattaattgccccaccaccaaactctagggtgctaaacactttatcagtaatgactctgtcattactaaacatatatagggctaaaggacgttctttgttctttagttcttttaataaatgttctaggttctcatatttcataacagggataaccggaccaaagatctcttctt

SEQ ID NO: 23083 - DNA, 480 bp, Oryza sativa
  unsure (1)..(480): unsure at all n locations
nnnnnnnnnnnnnnnnnnnnnnnnnnnnnnnnnnnnnnnnncactctctttcatctcgaggggtgctaccatgttagctgcatgcattttctatctcatccctctcttctctctagtctctccaagttcagcattgtcactacagctgtgtcttgccacgcctgacacgagtcgacacactgacacgcgtgtctcgataaccactgcttctgaccaagcaccttcgttgcttgaagcctcattaattttcttctttgacttcatctccaagtaccatcgggttacctgtcagacaagtatcaaatgacttgttctttataaattttgcaagtgtaagagaacctggcatgaaattggtgagttaagagtacattctcaagtctacaacttactttagcgatgtggggttgattcttaagtggaaatgtaattgcaattcaagtaaaaatgggttcctcgtccacctgttacataggaaaa

SEQ ID NO: 23084 - DNA, 557 bp, Oryza sativa
  unsure (1)..(557): unsure at all n locations
actatagggcgaattcgagctcggtacccagcaccagatcagggcacatggttgcttacgtgagaccgaatcaagagcaacctcacggtggcccttctccatggtattgtgcaagtgatacaaacatcagacaagtatctctagaagaagttctcaagtgcgaggcctcccttttcttctacgagaggattggaggctaacgtccaaggaagtaaattggttagattagcaaacattctttggatggacaaagatccattcagtagacgtcatgatcaagtccaattttgttgctttggctgagtcattgtaggactgcaaatagatcgcattcataatctcctttttgttcatgaggaacgtacttcttttcctggaataagaatgaaggaataggacatgtgccatttgtaaatgagcaggactgtactaatgattgataatgctttacaataggtctaaaatacagaacgatattacttgatatatcttgagctttagnnnnnnnnnnnnnnnnnnnnnnnnnnnnnnnnnnnnnnnnnnnnnnnnnnnnnnnn

SEQ ID NO: 23085 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnaagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggatttttttggctagagagaaatgtagcttttggaaaacttgagtttatgcgcctgctgtatgcctatggtcctcttctcagcaccctttggacagatgatggttatgcacaaacgtttggagaccgtgtctacagagggctacaaaaggatccagattcgggggaccatcattgcgttgtctgttttgcataccgggttgacagcaggacaaatgagctctacgttagaattatggacaattgtgcagatgatggacctatcagatgggtattatttgatgtgttcgatagcttctacgttccactgataaaaaaatcctatagagcctcatgaactacggagaaagaa

SEQ ID NO: 23086 - DNA, 743 bp, Oryza sativa
  unsure (1)..(743): unsure at all n locations
actatagggcgaattcgagctcggtacccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23087 - DNA, 14761 bp, Oryza sativa
  unsure (1)..(14761): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataggaaccacatcacaatcaacagaatctgcatatgagccaatgaaaacaaaaccctgcaaacctgagttacctttgctcttccagaatcgtttaaccactgaatatggtaaggatgtggatgtgtacgtgtggtcaagccaagcttcttgaccaaatcaaaactcaccaagttgttgcagctacctccatcaatgatcacacgtgcacgacgattgtggatgatgaagaaaatctgaaacaaattatggcattgcaacctctcagactgctgcacctgcgtgctgagcacccgctgcacaatgatggtcctgtaggccattgtgtcatcacgaccaaagacttcgccatcctcatcctcaacttctttttcctcctcttcctcttccacatcggaggtggtgatgtagccatcttctgtaacaacatatgcccgttgactagggcaatctttctgcacatgcccaaacccttggcaacggtggcactgaatgcgtcccgtcgaggcaacagatgaggcactcttggcgggtacctgcgaagaacttttacctgactctgctggtcgtggtggagatggttttggtgttgcagaagctccgaatgcagctggtcgcttgctcactggctgggacagcgcccgaaaagagacggccttgggcagtcccacagatggcgtcgtgcacagagtgtacatgctcgccttgttcttgccctgctgctcacgcccctgcaattccttctctgcaagtatagcaaactgaaacaactggttgacagagttaaattccttacaatcaacaatgttctgaatttcctccctcaaaccagaataaaaacgacaaatagcatcctcgaccccctccactatgccacagcgtctgacacccttttgtagctcaccatagtaatcctgtacagatttatccccttgttccaaacgcatcaatttcttgcgtaagtctctatgataagatggaggaacaaacctatcgcgcatagctaccttaagttcttcccaagtagtaggtagtaccccctcatcagataacccagcccaccacatgatagtaaaatccttgaactcactactgacttgtctaactctatgttgctcaggtacaaggtgggcattaaacttttgttctactgtcatctcccaatcaagttatttctcagcatcataatatcctgaaaatgatggtattttaaacttaaccttagcataaggatcatcgggcacacgattattattaccttgttggtggcgagtgccacccatacctgtgcggtttgtgcctaggcgacgtcgtagccgtgcttgccttgtagctggtccgtcaatatagccactcgaatcatacaccgtgtcttcaggatgagcatcgtcgtcaccactcacttcctcattggaaggtgtctccaacgcggcaacccgatcagttagcgtggatatccgcttgtccaacctctccatgtggttcaggaaaccgattttagtgaaggcatcttggacagactttgcaacggcctccgtgatacccttttgagtattttcttggagagttcgtagttgctcttgactgacacagtcagcaaaatcctggggactcttctcaccttcgttacctgccatttaaacaccaaaacagcaacaaacggtgaaggttatccctaataatctactacgcaggtgtagtggtgcctctcaacgattctcagcaatatggagtacccaaccaagctcttataaggttcttaccagcaaagcaaaggatacctggaaggcgtagtcagcgattgcagggatcaagaacttgtgctgtccagaagtaatatgtggagcatggaaggccaaatatatgtatctgagtggtacacaatccaatgacagatagtaatgctgaataaaaatcccaagtcacttgcccttagttgctggtctactcgtgtcctagacagtagtggtaacaataatggctcaaggaaaatgacactagtaaacagcaaagaaggacttgcaggcaagcttcggcgagtttcagcaaaaacaacaaaaccgaactggcagataagctcaacggagcgcgtcgtgagctcaatgcactagtggaaatcaacttttcttttttatttattttattttattgattttttttctttttccagaacacgaaaataggcacacctccaagttacagctcaatcggagttgatatatagcctatggaattttctgaaaccactataaacaaagtgtaggaacttgtgagctcgaacagacaattttgcaagccaaattttggaattttggattcgccaaacccgccaaaggggggagaaacggatgtaaattttttttctcttatctgaaaagttaaaatttgcctgattccgagtctgtatgcaaaagttatggctgtttgaagtttcggcttccggctaggttttccagaggggatataacctaatctattttgcggtggaattgggatatggtggcagcggagtttgtagggtgttctggtgatgcgtggtgatctggatgggtgtttatgatggcggaaatggctctcaaaagatgaactctaacacacggtgaaaggtggcggctagggttacaaaggaaaaacacacgactagactaaaacaagcactagaccagcaacaggaacttaaactaggactcaaactcaacactacggactctgaaaaagaatcatgcaaaacccaaaaaacctaaagatggcggcggtactaatatataaagtttagggtcatgcaaccccctctcgacgcaaccttaatgggttccaacacaatacacggcccaaaggcccaaatacggtgacacagcaccgggacagattctgggcgtcaacttgttcggtcgattcctattgactcagaaagaatttggacgtgggaccaaaaattggaaaggttatcttcttagctttccatccatataaagaacgtcccaattcgagcacgtatgcgacctgggcggccgttttagtgcagactggtcctggactccgaattgcacccgaggtcgaattggtttgggcctccaccttgacttggacgtcctcgatgatcctccatggctctaagtccttctccaagtgtctccttgtcccctccattgttcctaatcacaatataatcattaggtagcaatctattctcgaattcatacaaagaagaacataggaacgagctcacctctaaattcaattgtcgcgcacgagctcttgttatcggtccttgaatgaccgttggaggattgttgtgtgtatctgaggtagtgatgtctgcatcacccaggcacgaccaaggcacgcccgaccaactcgccgtgcccgcccatggaccgcacctatggcccatgcatgatccaataaggctcgggccatgctgtgtcggctcgaaggcacgatcaatccaccgtgctcgtccttgagtaagtttattttgcttccctcgtctctttgggcagtgctttatatgcctagaataagtctatttgcctccctcatctctttaggcaatgcttcatatggctgttttaagtctattttgcctctttatatctttgggcctactgatcgttgggccgtgtcatgccggaccggcatgacgtgccgaggaagagacccaagcatgatctaacggtttggccggattagcatgggcccgacaacactcgggccataccgtgcctggaccgagccaaatctccatgccgtggaccagggcgtcgggttatgggtctttttggccaactataccttaagacttcatcatcgcaaaagccagcacgctcgcgtgttcgcacatggcacgaatacacaaacacgcatatcagtaggatttctaatactgggaggactttttttaagccacataaaaaaagggttaattggatccatgccactacaaatgtgtcaaatcagaaaaatgcgatatccacttggtgccactgaaattttgtaaaattgtaaccatgccatctccatccacttttctgtcatccccgttagatccacatcctatcctccgtttttggcgtgcgcctcgtcaacctcatcggcttcgactccggtgccgatgccgaccggtagctctgcgcccgcgccctcaagcggtggcgcacggctcggtctcctccctcgtttggcgtttaaggagcggtggcggttaccaccagcgggcgacagtggtgaccaccagctcattagcttgtggaagaaagaagcagaggttgccgccgccgcctgtagagaacgccgccgcatggaggccgggagcacgaagtagagcagtccagcaacacctcctcgtcgtatctcatcgctgccactgcgcccccatgatctagctcgggatgcacgtcccgctcgccaccgccctcgccaaggagctctcctcctatcctgccctttccctatccgtcgtcgtgccctcctcctcctccggcgcaggcttgctgcttggtgtgtccatgcacggtgtctatgccgtagatcattgggatgctgagccgtgtcgagagggaccccttttggaagtcgctcaccatgctcactcactccgccgtcgtcacctacttccttagcacgctcccaccaccgctaagcattgggagatgaagacgagaaggagatgaaggtagcgtgacagaaaatgtgacggagacaacggaaatcgtgatggagtggcatggttctaattttagaagattgcagtggcatctacgtagtggcatttttttaatatgacatatttacgatgacatggatccaattaacctaaaaaaaaagcttggacaaacattactactcttgtaggcattggatttgaactcggctatactacaagaagttgctttctccggaaaatacttttcattgaccagtttacctagaaacaaaaaagtgtagaatacagtatgaaagcattgttgatgacatgaaaggtacagatgagaaactagttgctggactagctgttggtacactttagtgttgtttacattatatatgacaagttagttgtcaacaatggtccattgcgcacttagtaacaactttacaagattgctccaagtttcttaatctacgtcacatacattaacaccggtgacccaaaaagcaggatgaggtccgttctgacctctttctttaatttgctatcaaatgtttgatacccaatcttggagaagtttggtgctgacttgtggcaaatgctaggtcacaaaaaaaatgacttgtacgtagtttttgttctttagcagttccgcggcgaacggcgtccacagataccgtagcaatgccaaagcgtgttgaagctagctatagcgagttatcttaattaatcagatcgatcgatgaggtcgtaattaataaacagagaaagtactaaatattaattagcagctgcgtcgtcatgggtagcaggagcatgcgttcccacctcgatctgacaaatgaggagaaattgcaacgaacaaacataggagtacatcctagtgattgatcaatcatgcaaatgcgtctgactgatgacgtatcaagtggaaggaaaacgcggcgaaatttccacgcggtacatcgtcctgtcctacggagtagaatcctagtataccaccgttgattgatctttctctgtttaattttatttgtcgttaaaggggtgtttaggttcagggacgtaaattttggcgtatcacatcggctattatatagggtgtcgcatagggtgtttgggcactaataaaaaaatataattacagaatccgtcagtaaaccgcgagatgaatttattaagcataattaattcgttattagcaaatgtttactgtaaaatcatattgtcaaatcatggagtaattaggcttaaaagatccgtctcgtaaattagtcgtaatctgtgcaattagttttttttagcctatatttaatatttcatgcatgtgttaaatattcgatgtgacatggtgtaaaattttggggtgggatcgaaacaccccctaagcagatgttacactgagatagaaggtgagacatacttcctctgttccaaagtaagcaaacgtcgtactgtgtaaacacaacgaatctactagtatatgtcatatcatgttggtttattctaggacggggattattaattactacggagaatatccgtccttggaatattatatttttttctacacgaatccaaacaaacaactatacaaattcacgtaaaaacttaatgttttttttgttgcaacttgtaaaatttaaatttgaccttgcatatttgtggaataatttatcacatattaatatatcttgttaatatttttttaaaaaatttcatatccatttgaatgatattcaaataacgagagaatattctcacacgagtttaaaatagttttgttttaagactaaggctgcgtttgtttgggatggttgggaaccaaactcctccacacggaaaacggagcaatccattagcacgtgattaattaagtattagctaattttttttcaaaaatagaacaatatgattttttaaggaaaaagtacgaattaccccccgaaagtattgggtgagtacgaattaccccctaaacctggaaaccagtcatttttcaccctcaactatcgataccggacgaaaccccccccccccccgagcagcttcgcaagctgttttggtctacgtggcagtccagtcagcaattattttctttttaaattagtgggccccacatgtcagtctctcaccctctcttttacaccacacctctctatctctctccaaaattctctctcttctccctccctcacctcgaggacgacggcgggtagagcacggggcgacgaaggggacggcggagctcgagggggcggaggggacggcgtaggacggagcttgggggtggcgagaggaggggacagtggaggggaggctagcgagacaggctgggatgccggcgagcgcccgcggaggggatgcggcgagcgcgccgagaggaggaggcgggcggtgcttctctcctctcccccgccgtcgcgccgcgccgcgcggcgctcctctccccgaacgagctcgaacgcgaggggcgtagggaggctgagagatgaggaggccggactcccccgcggccgctgcctccagccagatcccagcgagcaggtgtcggggaagagtagcagggcacagcggtcgtcgtcgggccagaggtggtcgtcgcagaaacgacgatggttgggctggtgctactccnccgggtagtaagacgccacaccangaggggggggcggggggggatgactccgacgactctcccggcctcaccgccccctcgccggcctcctcccttctcggctcgctccctggcctcctcacctcctctctctctggcctcccccgctccggccgccctgctattgccggcatgcttcggccgttgccgctccgcccgtcccgctctaccactgctgcttcgcccccccgttctgcctacggcttgccaccacagctgctccacctgtggcttgccaccaccaccgctctggccatcgctctgccgtctcagggaggccaaggaggtgcccgctgccgccggcgcgcgagccgcagccgcctgcatctaacgggagagagagagaagggggtgagagggaaagagatagagagagttgatatatctgacaggtgggccctacccttttttcattaaaaaaacttgctgatcggactgccacgtagaccaaaaccgcttacaaagctgctggggggttcattcggtatcgataattgagggtgaagaatgactggttttcaggtttaggggggtaatttgtactcacccaatacttcagggggtaattcgtactttttcttttttttaaacaactttcgaatagaaactttttgcaaaaaaagcgcaccaaaatagtagtttgaaaagcgtgcacgcaaaaaacgagaaaaggggagttgggaaaaggggaaactaactgagcctaaggtagtatagtatgactgcattgataaatgttaccaagtaaaaaaaaaatactttaatacgagaacgataataatttaaatgctaaaacgacaattgaattgaaactaaaaccgacattctccctctgtcgcaaaatgtaacaacttatagcaaggtttgtatcaaaatataataatttttttcaccaacattcttttctcaatcaataacaactctccaccatttaattttttttacctacctccacttctgaatcaattgtagtttttttttctatttaattttatctatttctcatacggatggagggagtatatacgaatctaccgaagcggaagtaggattgaaaaaaaagatggtctctcgcttgagggtgcgtggagcctagagagaagaccgtgggttgacctcggcaagcgaacatgccgcgttgccatgtgatgtgtgtgatgcgaagccgaagcctgtgctctgctctaccggctgctctccctccgtggacgtggacttggtccggtcttccttcccttcccgggcggcctcgccagaaaagactccactccagcagtccagctcctgcgcccggtgggcccactagacttggctgatcgggaccgggacccacccagacgtggacgcgctcactggagtcctcgactctagtctgactgtgagttgtgtgactcggactcgctctctcacccgacccaactcatcagtcgtcgctttcagaaatctttcattagaaaaaaataaaattcatcagtcgtctcctcagtcttcactatactattcctattactaataacaatctcaaggaatattttgtttttctctatactattaggagtactatatataagggagcacagttgcagttagcctcggcagctcagctcgatcgagtagtgctcatccatctgcagattgcatcgatcgatcgacgatggaggggaaggccgccgtcgtcgccagcgccgctctgctctccacgctaatcatcccgctcctcctcctctcgcagcaccagccgcgcgccatcgccgaccatctctccgccggcgccaccgccgcaacgctgttcgacgccttggcgcgactcctcggcctgctcagcccgaggaaccacatgatcctgctctgcaacgccatcctcctcctcgtcctcagggacgccggcctcctcgcctgccccgcaccacctgcgcctgcgcctccgcctcgccaccacgccgccgccgacgacgacgcctcaccacctgtcgccgcgagttctgctgcttcctctcgccgccggccccaacgaccgaggagcagcgccgccgtcgtcgtctggcgcccgagcaagctcgccgtggtagacgtgctgcacgttgacgacgaggacgacggcagcgatggcgataggcggcggcgacgtcgtccagcacagcgccacgagccggccatggcgacgacgatggcgccgccgccaatcgcgctaccgccggcgggggaggagaaacagagctacgacggcctcgtcgacgacgacgatcatgtttccgcgggagcgatcgtcgtggtggatgatgatgccaacaagatcagctcccctgtccccgactccgatcaccatcgctactccggcgaggacacaaacggacgagccgacgacgaagaggaagccttcgaccagtgcggcggcggcgacgacgacgacgatgtggacgacatgaacaggaggttcgaggagttcatcgccaacacaaagaggaagatgcagatggagagcctccagctacagctagtcatgatgaaggtttagaacaataaataaaaaaaactttttttcttttttccctctctttccagggagaaaaaaaaaagaattgtaggagaaactaatagtgcttgtacttgtacagtactaccggctgcatgatcactgtacaaactttttggattttgttcactgatgaaattaaaaccaaaccgcctagtttgggaatggccgaatgagaacttggtcccaattttgatctcctatgattagagacaaattaattggcaataacgaacagagcatcccaagcaaaatacacaaagcaagtaaattcactgtcatgagaaacaaaaaatactatgaataacaaagtggcatttaaaagtgagtgaactcacatcttatttcacattaattgcctttttctttttagtatcacttcatgtgggattgtccagcaagagtccatatatgattaattgcacacagtccatttgctgtttgataatacaggaatcaatcgattcgttgtagaccttaaaacggcactaaataacatgatatcacatcaacgtgagacacaatcatgacagtttttcaaactttgcggtatgctaaaccacaaatatagctatattttttatttatcttttatcagcagatgaaaaataaactagcacgcgagctcttatttacatccatggatgtacccaacattgacaatacaaacatatctatggtcctacatgtgtacgaccgatggtttatatgagcaagaattaccgttagcttaaaaaacgtgcacaatagaaaatgagaaagttgtattttggagttaaagaagaagaaatgagatcatatggtttaattggctagagggcgacataaatctttttttttagaactacacaaatctaacttcaataattattttctaaactaggaagtgaggtttttttttgttagattacctttttttcttctaagttcaactagcatggtgacccgcacagattacgcggctagcatcattatgttttctcttatataatagtatatgtattttcttaatttattattaaaatatacttttattctaatatttcttatttttttaatttggaatgtctattatttcttaattgtactccctccgtcccagtatagtggacttcctaggagtatttcattatggaaggtatactcttcttctaatattatttatttttaattccgatttcagttatttctaaattgtatttctataatgactctataatcttcttttaatatttttttaattccaatttttcgttatttccaaattgtatttatatatgaactctaacctaattttaattttcttattttttaattctgatttttcattaattctaaattttatatcggcatggactctagtctcatcttacaatattccttattttctaattctgaattccagctatttctaaattgtctatatggactatagtctccttttctaatattccttattttttaattctaaatttcagttatttctaaattgtatttctatatggactctatttttctttttctctgatcaatatgagaatttctagaccgtgaaagcgaacgtggatgcttattttttctatcactttaataagttaatagatggggatgcaaacaatccctgcctgaattttcaattacatgtaatgcaacgcgaggcctaactcgatggtacttgaagggacgatgtgaagcattccttggaacatttttcttttcctttctttcttttaggatttcaatcatatgcaaaaataaatcatttgaccctttaggaacaaaagagtgacactactaaactcccaggttatttctatagattgcctcaatttatatgaattttggagggtttttaacacaaggtccaactttatgaaaacttgtttcatatcttttctcactccgaattcctttactctttcccttaattattatccaaacaacatatttgaaatcaatcatatgttttatgaataataaggatccgataagctatggcacctcaatctttttttaatttattcctgttttttatacgttccaaaaggaaatagttatacattatgcccagcgaattagacaaaaaaaaaacaatcgaattgcaaaaaccactgttcgagattcgagaaagacatagccaaccctaaaagatatatactggagtagtcgtgtgtgttttagcacatttacacgtggtcgatttcctagttaatttttttctctgtcttttgttaggaggaggaaaaaaatcgatatagctaagtagcgtcgacttgggttgactttgatgaacctgaccatacagatgtttggtgcatttgcatcattgcatgtatccaaggagaccatggatacacatgcctggtgcagatcgatacaaagatttgggctgaattctaaggaataattaattatttgttactcttataaataatgataaaggatttaccattgaacccatatgtcatagacgcatcttaaagtgacaaaaagttaaatgtttcgaattctaaacataagttcgcctatttttttatttatcgtgagcacacgtgtttcgtgtttaaaaattttctttaaaaacaataaataaatctaattttaagtttataatattttatatttaaatatacacatttcgttctccgtgcctcaagtttcgaacaaagctactaggaatttgtcctcttgattcgattggcaatgtagttctaggaatttgctgctcgcctgctcggggccacagagggttacgggctgggctgggctatgtctgggagcatagcagacaaggctgcaggaaccaagcagcacagcatcaacagcaggttggcaggcagcccatacacagcctggcaaattaagtcgcaattccgtcctctcgacctgtttccgagagcacccaaaattccatccctaaaatttatttttttaatcctaaacataattttagatgtgaaaatattaatctctccaaaagatattttaaaattaacttaaaaaagacccacccattagtatcaacagaaacacaaaaagaaatcgctccaccataccttccctacgcacgatctcttctcacgtgtcatcctcttcctttgctgtgcaaaaattgtgaacgagtgcctcctcacttatgaagaacgagaaagaaggagaaggggattccaattttgagacacatataaggaaacgattggagcaaggttttttttttaagaaaaaaagcccaaatttttggattgggcttcaattagggtttgattgaggccgttcatattaaatttgagttgtttcatacaagatttgttcttaaaaaaaacatgctcactcaagacactaataagtgatgttttagacgtcattaacacataattgggaaaaaatatgtggtagaaactatatatatattgaaaacctgaaaactaccattagataaaaatagacatatgagatttgtccatgtcatcacgagtaaaaattttactcgtagatttactctcatgatgatatggacgaatcttagacatccatttttcttagtttttcactacatattttttccccatataatttgaaccattaactatatcttatagatctgaatagtttcataaacaaaccataatattacaaaagctttggttacaacatttttggtcatgttattttcatatgcctaaaacccatgttaaaaatataattacagtcaaagttatctcctattaacggtatggagtttaaatgatgtatttatttgtaactgaagggagtacttgaaatatataggggtagttcaaagtagtaacctgtttgttttaaaagtttttacagtcattgagaagttattggaaggtatcatattttctaatgtaaactccggtactagaaggttccatatttaggtacctcttgttatccctcgaagactgtaaaaatttttatttgttctaggaaagtggcatggcggcgtgtttgttattaatttgcgatttttacaaaatcttttcttattaactagataatgctttaaatccattttaactttttaatagtccatcgattggtttgtgcccttgaataattctcacaaatacttcatacaatcagcattccgtttcattagcacaaaagaacactcttttaaataaaacattgtacaaagtcaaaatctgatacagctttaaattaaaagaaaccctgattgcatacttgttttcatcatcataaatacaccaagttgaaaacattacattacacagtaactctacacacatggtactcagctagcattctcttgttcaaatttacacatgatgatataaacgaaccgatcatgcatacacataaatttttttccttttttttcctttttcacacaagaagactcgtggcctcatcggttttggttcgtcacgtcacatgacgctgcagccggccggctcctcgtcgtagtacggcggctggtacgggctccggccgccgtacccgtacgccggcggcg

SEQ ID NO: 23088 - DNA, 4301 bp, Oryza sativa
gccgccatggccatgctcggcgcctcggcgcggcgggccctccatccgcgcgagggcgccggcggcgtggttggtggtcgtcaccaccttcggcttcctgttgtcgtggtggtggtggtggcggccgtcgtccatgtcgtccgccatctcgaacttgacgtgcttcttgatcatctccggctttcttccgccgcagccgccgccgccgcctgcgctgccgtccttcccggccggcttgttggcgtgcgccttggcgccaccgccgccgccgcctggcatgggtttggcaccaccgacgacgcgaatgtcggtgatgaccttgccggcgctggagcagagcctgtccgagacctcgtcggcgtcgaacggccccgccaccgtcaccgtgttgttcttctcgtcgtacgagatggccttgatgctcgccttatctacatacacacagtgattaattaggccagttcatggatcaagaaattacagtgtgattaatttgggaactaaccttggagcttgcagaggacccttctgatcttcctgtagcatctgtcacattcaagatccaccatcatcacaattgtagacatctgaggtgagatcaacaaagcagagatacaacttgttagtatgacgacacaaacatatgtgggtgattaatcactgtaacaagaacactagaccatcatgtccaatgagaagtagagaacaacagtaggcaatgctaactaagatacaatttaattagcccttttaacctgtctgaaagtatagagttctatgatggtactactattctttaagataagtagaagaatttttttttggaaggttagaaaagcagaggagtttctttttccctttctttgaaggttatagaagcagaggagtagacatcactacatcagtgagcattaatcctagctatagctaactcaaaactgattgaggattacagctgatttgcattgcacgagccacacatatccattcccctgatgtgcagttaggttgttggtcaatttatctttaaagcgcagcacaaacagagggagaaagaaagaaaaaaaagtgtcggtttgcttgctctctacttcacttgccattatcctttaagctgtcccgacaaaaaagcactcacacggtcatacatacagtacttcaaactgaacctgatactctagttgtggaatcagaagttgataactgccggaattcccaaccaagatgagtcgatcgaatcgaaatacaaaacacacaagagatttaattaattatatattggacgagaggttgtacgtcttcactctgcctcagctgtaagtatgctactgtatatcatctatccatggaagaacaagaagatgaactgggcaagtactactggcacacagagccgccattgcagagctgaatttggaacgcacaaaccgatcgatcgatagacgacagtgcaaatttgcagcaaattaaatcaagaaatccacaagaggaaggcaaccaccaactcataataatatacatcagggagttaacttgcaggtacctaccttgcctgccatggattattctcccaagctagcttctctcagtcacctcgctgttggtgagacgagggaggaagaagagatgaggaggatgacaagaagagagagaggaaatggtagggctcgctttttaagctgaagagaaatggcagcacagcgcagcggatgcacgcggcggcgcagttgcaagcatcattgcgcatgattagtttacgctaaaccaccctataaagcgtaaatttcagaggccacgtgtacacggagacagatcaagataggccatcgccttcgtctcgcccgttacatacaaccagctgcgtgtacgtacgtagtacgagccggagctttatacatgtcggctacggctcttttgggtgttttttttttcttttgaacgatcagacacaattcgaactactgcctccgtttcaggttataaaactttctagcattgtccacatttatatactccttccgtttctaaatatttgacactgttaattttttagcacatgtttaaccgtctgtcttatttaaagacttttatatgtatacatataaatatatttaacaataaattaaatgataggaaaagaattaataattacataaattttttaaataagacgaacggttaaacatatttaaaaaagtcaacggcgtcaaatatttagaaacggatagagtatatggtaacgaatcatagacatatatgtgtgtctagattcattaacatctatataaatgtggataataattgaaagtcttgtaatatgaaacggaaaacggaggaagtatatatgttgtatatccaccgtacgatgccgaaattaatatgtccccatggctaggatgtaccgtaagttatccatgtaggcttcaatacaagagctcgttctaaacagaggcgggaaatggctaattagccaatagccacacatgaaatgagaaatatatgataaatttaatatgactccattataaagaattaaaaaatgtatttgtttaattttttaagcaacttctatagaaggttttcgcacgaaatataccgtttaacagtttaaaaaaacatgctaatgaaaatcttgaaaataaaatttaaattatagagcttgattttagagttaattttaaggtttctgtttatttttcaacttttaaacaactagaacatatataaattaaagttttactattaatggttgcataattcctttttcccacggctatatcaaccgttgatgaaatgatcagagcataattggttgaacccttaattagacataatcgaataagataagattggatcaaacgcgggttatggagacaaaaatgccgagatacaggaaaagcatgtacacgcaatcatctgttcatctgccaccctgaattaaagtaactgccattgagcaacccatcaagctgacaaattaaattatgataagcactactccaaaatctttgtagtgggcactgacgtcaatggaccaattctactactagtgttgacctgtggagtggatgctagtagctagtaggattaggaagataaccaccagaacatcaatagaagaataaaattacgaaaaagaatgggagaattatttaagagaaaattggttccatgatagtaagtactacctccgtcccaaaataagcgcagccgtagatatccgtgcccaacctttgaccgtccgtcttatttgaaaaatttatgaaaaatttaaaatatttagtcacacataaagtattattcatgttttatcatctaatagcaataaaaatactaattataaaaaaatttcaaataagacgaacggtcaaacgttgaatataaataatataaaactgcacttattttgagacggaggagtattaattaaagattggagtggtgcaggagccagtaggcatgcagctttcatggggagcggtctgggggtgtgtgttgttgggttgttgggcactaattattatctttaagcctaacataccaatctatctttgtcgttacgattaattaattaactttgctctatgcctagtgcatatttatgcaggagtacataattacagatcggtgcatttgttctactactagctagctattgttagtgtcaaagcctgacgtagcatcgatttgatgtgccggtgccgtttcgctctcggatgaagacatacatgaattctgcaaattttaccgttgatgcggcctctcctttgaaaaagctaggaactttttaaaatttgagagcaagtttaaatggttttcaaaaattgccacaaaattggagtgaaatttctgcgtgtgtgtaccacacaaaagcaccagaccatcaacagcctgcatgatgaaaagcttcaaccaaactgtacgaatctcgcacttgtagcagcagccaacaaacctatgcatgtagctggactgtgtatagtacccaaaaacctttgcttacaagcgagcgatccaacacgtcttgtgcgttgctcaacgaccgctgcttttgtatggtgtagtatgtacacccatctctgatgctatcacacctatgcaaagcagcaaaggttacagcttctaacatgattgtagcagctgtgcttggggcttaattaatcacctctaatgtgcttcaatagtggggtaacagcggattagctttcacatagcaaatatatttgtttacgagtacaataaaacgttttagcagacgatactacattcatgctgccgaatatgctgagttggtaaaaaaa

SEQ ID NO: 23089 - DNA, 24410 bp, Oryza sativa
  unsure (1)..(24410): unsure at all n locations
tatcaattatttttgcaaagccgcaaaatattatctaactctacttttcatgggaatatctaactattgttcctgtgagatctgatgtctaaaagggcatttaggtacaattgaaacggcgataataaatattgtaagagcaatttcaaatgtgtttatgttggtgactttaaaacgtgccattggctatagcctaggacaatgagatggattagttgtgtttgtccaacattatgtcagtccacatcaaggaatctttggatgagttgacatacagttccttgtattacttgttacttcttggctagaaacttggaatctgtgccactgtgccataccattcaagtaatgtatagtttagtcctttctaatgtgcctcattatggcttctattgtcacgggctagtataatagatgaggaaacgcaacataaactatatttgaagctggttacaagatgtggccctggacctcgatggcgtggcggagccatcataggcactgcgtggaagaggcaggacgcaagctcagcataacctaatctccaagctaagcaaaataggccgattttcagcttatacaatgctgttgccagccacattattctcaactgaaaactaacaagcccagaaagataaaactaactcaatctaatcctgaatttgtggtgcctcattgttgccacatttgatctggtgcagacgataaaggagtcctcacctgacatctgtatacacgccgtcatgaccatagcttaactattgagctcactaacataaatttcagttcccctatcctagatatgaaactgcaataatgaatatcatatattacaccatttattattcctgggcaattcatctagtcatcattgctcttgtcattctttcttaatcatgactgactagctggtgtggtttctactgcatcaaatatcaaaagcagcattaacatttttataatttataatgtaacccaaaaatttaggtttcagatgtgcagctcaaccattttcaaggtaaaacctgcaaaacttatcaaacgaaaccactcaagacacatgaaaccatttttagttctttacaagagatctttgacctgtgtccccagcaacatggattgatagagcatacgtcactctttggtctgagtaattatttgatgaacctggtttggagagaaactagaagatacaaagtctggcacaattggaagaccatgcttgattttttctgttcgtggagctatgattttgataaagaactacaactagcaatttcagtgataactatactccaaactttgtcacatagtaactagagatgccacaccaatattttcttttgactcagacatcactgaatgttttttttcttaccgaggttcagttaaatttatctccactacagtatataaaaaggacctagtggtggtggcggtgagtctgtcatccccctaccacctcatgagttgcctttttcctaagagaaatagtctttccaatgtagaactatttgtctactatgatatgaattagtttcttttttaaaattcatgccatcagtttgtttaggtctttggtttttccactacattagtgtagtttcctcacatgaatctgtaaggcacaatagtgacaggaaggagagagatggagcagattggcactgaataatgagcaggtaaatgagcaatgacatggagaagaaacagttcgatggatagacagaaagttggattctattgatattagatggggatgagatgagagatgaaaatgataaaaaaataatacatatgcagattaattgcagtttaagaataaaatgaaaaattcatagttttagatcaagttattgaaaaaactatcacgcaagaggtagtgagaaaaaaatgctcaatggaatcacaacaaaggcagctataaattaaaggtcaccaacattagtgtagtttttttctttgcgaaaatcaagcctatgtaagattccgtactgtctgcaatggctataaaaaacagagaacagaacatcaacaaagaattagctgaaacatcaattttattgttaccaataagtctaaattatcctaatggactgtatgggtgagagggtttttctttagagttagttcaaatttgaatccaaatccccctatccaaaacaggactaaagaatgagttgatgataaagcatcatagttctttactgctaactcttttttttgttgacctttctgacctatcatggtcttcaagattacttagagtgggtatatatcaaggtataatcatgaaaagtactttgacaacaaattaagtgatacaaatctcatacaacaaatctaaataactttaaacatgtctgtaactagaatggctgacagctcagattatagactgcgaagtaaaaaatagaggtatagcagatgactaaaaaaagctcccaaacctttttcacccgtttatcattgtagtcgcaatttagattctattaaacagctattcataatttaggttctattaaacagctattcgtaactcaacagagccactgcattacctacaattaagtttaaataggagtaattccttatcggcactatgaacaattagtaataattacctacaatcacctacgggtacttgcatatctagtcgttgaagctaaaactgttaaccaaatctcgccatctctaattggtaattactagttatggctgtctgatttgattgagccccatggcaccacaaacacagcacagactaaatcacacctctagttcttccacatccctaaaacacccgcgcatcaagattacaagcctagataaaggtttaaacaacagggagaaagaacgagagagagatggccgccgcgggtgacggggactcggggaggggagagtgtgttttgggggcgcgttaccccagtcgtcgtcggcggcggcagcgtcatcggcggtggggcggttcaggtgatgcggatccatgagatgcaaacggacatcgaactccggacgcctcagggcgtgagagcccgagctgcgaagcttcttcccctcaggtaccggcggccggggaggaggaggaggagggcggcctggtgtgtaggctctgcctgccgggtgccggccgccggcgtggaagaaggccggtgccggctgcagcggcggattggcggcggatgggatgggagtagatggtagtgaggaggggaggggaagcaagatgagatgggaagagagactgctggaatttggaaaccgtgggtcgtttccgatttctacccctggctttgttttttctgttctttgcggattcaatttttaaatgaattttagctataatttacagcccgttcacctgccttgaggacttatttcaagtacatatcatattatatcggatgtttggatattaaatttaaagtattaaacactaattacaaaacccattccataacattggactaattcgcgagacgaatattttgaatctaattacaccatgattttgacaatgtgatgctacagtaaacttttgataattatagattaattaggtttaaaaaattcgtctcgcggattagctctcatttataaaattagtttttttattagtctatgtttaatattccaaattagcgtctaaatatccgatgttacatgggctaaaaagttttagtcccatctaaacaccccctaaggttattattatctactctcctcgcaaaaaaaaacaaatctagaattgatggttgtattaaaatatattatatccagttatctaattttatgtttatttttctagatagagagagtgcgctggtaatgttacccttcatcgggaaaattgattttgcaatgacatacatccaattaatcacgtgaataatcctagtaaacgtgacatctctttttatccatgtctcttcacttgcttatgttgctcatgtgagataaaggatagagtggacaagcgtgtccaccagcaacgctcgggaaaatgctcacacccgaacgaccggcggggtggagaaaaatcggacgctgtgccactgcagctgcagcatgtaaagaatcttttcttttcttatttcttcaaaagattttttatcgtaaactatttatctaatctacgatctgattgcaccactaaattcgttacaattaaatctttacaacaagaccacacatgattatatttcaaaaatatattttaattttttattgatttttttaatgttgcatgcggtctcttttgatgtttcaaccagtagttttacaatgtttcagctagtgtactcatgatgtttcactgtgtatggatcaaatgttgcagtggaacacgccgttgcaataaatcacccacatattttggaaaccctctattaagggaatttggtttattttttgttccgcaaaaaatgtttcacctagtgcactcacaatattccactatgtatagatctaatgttgtagtgaactgaaatatttcattgcaacaaaaaacccacatattttggaaacctcctattaagagaattcgtttcatttttttgtttcaccaaaaaatgttccacctagtgtacttataatgtttcactatgtatagatctaatgttgcagtgaactgaaacattatttcgctatttgctgaaacattgtttttaaataaggtgaaacaacaccagattaaaacgagtgaaatatttttgatctacttagtgaaacaattctgatatacctggtggaacatcgtgcaacatttaaaaataattcaataataagctatttttttcaccggaatatatccatgtgtggtcttgttttgaagatttaattacaaagaatttaatggtgtaatcgaatcatgatttggataagaaatttaagagaaaaatcaatttaaaagtagttttgcacgtaaatcggacgctgacgtnntgctnacntnnncgtcnnatnnntncctnnnacatcggacgtccgacgcgtagttctctcccaacggtcgacgtctaacggtctaagagaagccagcactttcccttgctcctccttcgctcccactccatctccctatgtcttttatcttttctcgtggtcgtccctcctccctcccagcaccacttctcctccttatccgaggacggttagccatgagataaataagaagtggtgccgataaggagaagtagcgctagacggatctatttttagaggagtttgagacctgctaactatcaacgtgtaggaggatccgtggggtagccatcacaaaggaggagccatcactgccgctcaccatcgagaggagtcgcgggggatcttcagactagtggttgtcacttagtcatgtacgcttgaggagaccgatggagctcaggagataggggtgagcgtggtcaggtccggtaacggaagataaagatggtggcagtataggctagtgttaatgccaaaatttggtacgattctttagtggattcagttaaggaaaagaaatcgattggtagatggacatatatatagataaagctaattttaaggaggaatcgtgaagatcatggcaagatagtttcatatgtttgatatatctttttaaataggtaggattagttatttcccttttcttattaggaaatcttatatcgtatctgatttggtcttgtcctaacccgagggtataaatatatatgcctgtgatctttataatatatctatatatcaatacaattatattttggtacatcgccaatctttcaatgggttcttgttttcgagcagggttacgtcggttaagtttgatctccgttgagaaatcaaatttgctcatcaagtctcattgacatgaagattcaatgaaagattgcatacaagattccttccttcactagcctctagctattttcccagcttcaacccacagggttcagacctgacaactcgcaactcgtttggtttgggggaatcgtttccagggaatgagagttttgaggagcatggtttttaagtatgttgtttggatggtggacgtgcgagtttttatgagagactagaaaggggaatttaagaacaatccactttttcaatatctgagtaggataggtaattgagagaaaattcattcttaagcacatcgggataaatatgggatgtacatcatcacttaaattttatttctcacccaaactcccctactactccctccatttcactatattaagagcaagaataataatgggctaaacttattatgtggaagagagatacgaagaaaagtgaggtgtattggctttagggtttaccttttttgttttctaggtaaaaaccattccccgccgatttactgaaaataaaccaataattttctgtcaataccgtacaaaaaccaattaataccagccgggtttccacaagccgatggtcgattttctgccaacacctggatcagctccaataccgtccactgcctctgtttttttctttagctcagcacgcctctgtttgttctccagcttcagcacatgcatcggagatcggactaactggagttagtcagaggggttgattcggttggaaagtcaatcagactaggctgtattctttgccatatgtgttatgttccaacttcctttccttattattttttaggtgcacgtttttcaaactactaaatgatactccctccgtcccaaaaaaacaaaaagataaaccgtgggttcccgtgccaatgtttgactgtccgttttatatgaaatttttttataattagtattttcattgttgttagatgataaaacataattaatactttatgcgtgacttatctttttaatttttttcataattttttcaaataagacagacagtcaaacgttggacacggaaaccagagtttgtttttttaggacggagggagtacgtgttttgtaaaaaatttatatatgaaagctgctttaaaaaatcatattaatctatttttcaagttttttaaaactaatacttaattaattatgtgctaataagctttgtggggagaaaaaaatttccaaccatacataacaaacacagccttataaaacaaaaaaaaaaacgatccatccgctttgcaacctggcatggcatagatcacgcccgcaacgagcaaaaatgaataagttcactttgactccgacaactatagcttcaatatgattcatatctattagatatctcgactctccaactattaaaactagagcaatttaactccctaagtagttttgtagagtggtttcgctgatgcggcgctttgacttagtttgacagactaactccacgtgtggaacccacatggcagtgattcctcctttttttttttccttttctttcttctctctctcactcctttcttcgctaacaggaggcgccatcgctccgcctcatggcaggtcgctgcggctccgctcgaggccggttcgccaccatgcatcggggttgcccaaccgcggctcctcctaggcaatcttttcgtggcgcccggctcacacctctctctttcccatcttgctcccttccggccgcggccactgcccacctcaccgttgccgctgcggccatggcctgcagtgccacccatgacacggagcggggacgaggagcggtggctctccccatctcctccgacgcctcctgttgagccatctccatctctaccaccggaattgtcccacctgctagcgccccactgtgcaatgtgcaggaggtgggcaccatcgcagcgcccggctcgctcctcccctgccgccaccgcccacctccccaactgctgtactgtggagaaaacatggggtagagagaagggaaggatggtaagatatgtaggccccatatgtcagtaggtcccacaatattttttcgtgaatgacaaatgtgttccacatattttttttattctaataccacgtaagcaccacgttggacgaataccaggtcaacaccaccacgtatgagccacgtcagtgaaaccgccgaaagagttaaaattacaccgattttaatagttagggtcgagataaccggtattacagtttaaggatacgaatcagattcggccactggttaggggagtcaaaagtggacttactgcagtagaaaaggagaggcccagttaaccgggccgaaattgccacctaaagtttgggcctaactcagcccactcaatacggagtaacttaccgactacgaatcaaatttttttcatttttagattttttaaaaaatatttacagaaataatctatcagccaaaaaaaattataaaaatagaccctgccgcccaccacttgggcggcaagctgacgtggcaaatgggggagggacgggcgatgacggagggagggttttttttgcaggaaaacccttgccgccctctgttggagcggcaaggggccccaatgcaaaaaagctagccggggccggccattttgcaggcggccccttgccgccctctggccgggcggcaggcctcgctgcctataaaaggcatgccgcccagcccccagccctcattcctccccccacaaatccagtaaaaaaaagaagaaaggggaagagaagagaagaaggggcgaagccctgccggattcacacgctgatttcaggtaatattcatagatcgtatatgtgactattgagttaaatactgtatattttttaaaactttgtttgaataaatgcattatatttttagggttttagttgtactaatctagaagtgcgtattgtagatatcggtaactacgtagatctgctagtttggaatcagtactttaccgttgcattggcatatacaagaagatattacgttgtaggtgtttattgcatgaaagaataatatgatctaattattttgttgacagatatatcgaacaaacaaatattccaagtttaccatggcccaagaaacgtccgttacgggccaactggggtagatatgtcagaatttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatgtggaaaatgcattgcaacgcgggtggcctctaactatggttccatttgttcacccaaaggatccaggtgtgcagatgaacatggatgatggcgagggaccaagtgctgaagtaaatgagacttctgtggaagaggtcaacgcacgagaggacgggggcgtagtagctctagtgggcattcaaccaggtggagtggccgacgagggggagactgtcggtgccattgtggatgaaatggagagggaggattctgacaacgagcgtgtagaggaaggtgattcgtcagatgatgagacggatattaatctagcagaatgggctagtgaggatttttttggtttggtcgtctctgaagaggatagtgtgagatgggagtacaaagaaaatgaggttattcagggagcgatttatactagagcagaagatatgaaggaggcggtaaaacattttttagtgtcacttcgtagagatttttgggttgccaagtccaactggttgcaatatgaagttcggtgtgttaaggaaaaagatggttgtccctggagagtgcacgcttataagggaaaatggaaggattattggacagtgtcagttgttaccaagcatacatgttttctacctggtgttcagaaataccataggaacattacatgtgcatttgttgcatctgagatgtatgcgcatgtcatcgataatctcacatatgaaccaaggtcaataatgcgacacatcgaagagacatacaagtatactattagctatgccaaggcgtggagggccaaacaaaaaataatagagatgagatttggaacttacgaagcctcgtatgacaatttgccatgcctgcttggtgttatcgaagaaagaaaccctgggagctcttacgcggtgaagaaattcccctcaattgaacatcctggcaagagtgtgctgcaaagggtgttcttagctctacatgcatgcaagatggcattcgtgaactgtcgtcctgttctctgcattgatgggacattcttgactggaaagtatcggggccagatactaacagcaataggggtagatgggaacaatcaggtattgcccttggcatttgcttttgttgagagtgagaataccgacagctggtactggttcctgaaattggttaaaacaaaagttattggtatgaggccaaatgtgtacctgatacatgataggcacgctggcattctgcgagcgatagaagagttgcagtttgggagtatggaacgaggataccttggtgagtggaaagatgtacagagtaggtggtgcatgcatcatatgggagctgatttcttcaagcaattcaagaacaaggagctcatgaacatattcaagaggctatgcaatcagaaccaggagaaaaaattcaatgagctttggaagagattagatgagttgtgtcacaccctgaagttctttcccaagcctaaattgaagttgtaaatggtctcaagaaaatactggtgtaaaagcaagagtaaaccataataaatcaatgcaaataataatcggaattggcatgtggaattttttcttgagttctacatgtcgaaatacgctaacaagatttttagtggaattttcagagctctagaaataattttaatcaattaaaaattgagcacaagcaatatttaatcccaggaaaattcatttccttatttttcttttttcttttccctttttctctttcgaatgggccgtcggcccattctctcttctctccccctccccactaggctggccgaaggccacggcccagccagccgccggagccccctcctctctcctagggtggcggacaggtggggtccaccagtggggccggtctcccacctccagcgggcgccaccgcgccccgctcccgagtctcccgggccacgtggccctcacgccagggtcccccgggcccactccccctctctcccgcccgcgcccgcggctgagacggccggaattcaatttttgaatcgtgcctctctctcctccccacccctccccactccgcgggggaaatcgcggtctccccggccacgatggaccctcgtgggtctatataaagcacccccgttccctcctctctctttttcattttgcaatggcccgctcccgtgcactccaccgccctagcgttgttgtcctcctttttgccgccgccgccgtcgctccggttgccggtaaccgccgtgccgaaccgcgccgttgacgtcatcacgtttgccgtcgtgcgggccgtcccgtccacccctcctccgtagcaatccgccgccggaaccccgtttgtgccgcgcgccggtgagcttcgccgtggccggcgccttcggtcgctgccttagccatccatggtttccctctccctcactaactcatcccttttgatcccttaggtggtcccggagctcgtctcgccgtcgccatcgccctccgtcgctcgccgtcgtcgatcgtcgtcagtgaggcccctcctcccctttctccctctctcccgtgccgcttagccaccgcgccgccgcctagccgcttagacgccgctatcgccgcccgcgtcgccggaacgccgccgcctccgccgccgatcggtcgccactggtcgccgcctcacgtcgccgctgcgtgcgcgccgcgctgccacgcgccatggccgccgggccggcttgagccgtgcccgcgcgcaccggccgcgagccgcatccaccgtccgatctaccgggcggtagatcggggccgtccaacccggcctcccgcgtggctgccgcgtggccgccgcgtcggcgccacgtcagcgccacgtggtgcaccgcccctttcccagtccatggacccgatccaccatggaccagcgcccgcagccactgccatgtggggcccacatgtcggcaccgcccctctctctcccgggatttatttgttgcgcaataaatcaattaaggatttttctatttttagtaaaaacacagtgaatcttctaaaattcatatctaattcatccgagctccgtttaagcccattcaagtctcagtaaatcaagaaaaatgcatagaatctattaaaaatggttttgttctctgtttcagtagtcttatagcctgtttgtattgtttgctttgtatgtcgcttagattgcggctctcccgacgctccggtgtactttgaaatagttgccgaggttcctccagcagcagagcaaggcaagtcatgcttgtcacttgaacatgttgatcctatattgcaaatgctccattgttttccttcaaatactgcattgttttataatattaccatgggatgtttacctactattatagccatgctattttgtaccatgttcctttgttagtttggactagggattgcttagccatgcttagttcaactagcacacaatggagaaaattatattaatgtatagacttcaggatctagtgttgatgttggattagagccaccgtcctggtgtcgcttcattaaaatatgttaaatggtgggctgtgggtgcatggttttgctagtcgcgcccatggcacttaaggaccagttcgcgggaaaccctggaagaattcctcgtacttaccacaagccagcgtgggcaacggctgggcttgtagtgtagctttcctctagctaacgcatccaggcaagggtgggcgtgatggagtttggatgggccctgcgacggcctatgcggctttcagattcacctaggcacgagaggggactgcccgctgccttgcgaggagtgggggtgaaacctgaggtgtggtgtgcttggttagagggggttatgcgaagggtcctgtcacggcctctatccggtatgtcgtggtggcatgtcggcgcacggaaacatgttgtggggctgtgtcttgtgggtacagttgtaaacctcttatcagagtaaaactatttgaatagccatgcccgcggttatgggcggtcaaccagattcaccgtgattagtttcaccctagtctagtctaatggaattgaatagtataggtgggtggttgggcctgttgcaacgtggtatagcgttggacagtggatgattaatattgattaattattataattgttttactactttcaactactgtttataaatgctcgctttatgcaaacgaacctctatagctatcccttgataattccctgcatcatacccctattccggtatgacttgctgagtacagtgggtagtactcagtcttgctctattttccccaaaccccagagtttgagtatgcgtcaaatggtggcttctccgaggagtaggcttcgtccgtgccgtcgatgatgcctgtggagtggtgatcccgctgcggtccaagtcaaggcttagctccagttatcttttaattttccgctgtatttatgtaagactttatgatgtttgtaagacgtggatctgtatgtcaactttatcgtttgtgtaccccggccggtcctggacgggggttttaatacacattctgcttggaatcctattcgggaatttctgggcgtgacaagttgatagccaaatgcagtaatcagcgtgcagcggctccatcgaccaccgttgctgaccctcctcaatctcttggacctctcccaacggatagtccaacattggttagaagaactggagtggagattcggaaattttctcagtggattctgcatgaaccaaaagagaaatgggccaaggcgtatgacacaggtgatgctagatatggaataatgataacaaatttggcagaagtttacaactgggtgatgcacggtgtccgtggactcccactagttggcatagtggagttcattttacaagggacatgcaggtattttagggatcggttccaggcagttcttccctctatgccgaacaacagcattttattcggaactttcatgcagaaaaagctagaggagttgcgtaaaaaggccatgaaacatcgagctctagtgcaaggtacccaacagcacaggtttgagatactttgtcaagataaggcaggcaggggtatctaccgtaagagagtgaagcaggaatgtgttctcaaagccgacggcacatgtcattgctcttgtgcaaagccgaagctgctccacaggccatgcacccatgtcattgctgccgcaacggagtgtggcataccatatgcagtatatgtgtcacagtacttcagtaagcaagcagtatatcatacatggagtggcgagatttatgggttcggcatagctggggagttcacagagactaacaatgaagtactaaatattcctgacccatcgaagctccgaggcaaagctggaaggaggaagactcgtcgcatccgcaatgatatggacgagtcggaggctggcagggtgaagcgttgcagcaaatgcaatgaatgtgggcacacctacaagcattgtcctaaagacaaggagaaaccaaatgcggcggaggcaggactatcaggatcagcagcaaatggagctcgccctacgggtgaaggcactacctcaactcgactacgtcctaggcgtcgtcgtgccacgtctggctacgtggtgtagttcttgtgttctatgttggcatgtggctttgcttgtaatttgtttcgaacttaccgatgtgtttatgtttcgtcgtgtaatgtcagacttcggcatgtcatgtatttaggtctcgtgatgtaacgtcagacttaggcacctaatgtctttaggtatgctgatgtaatgtcggacttcggcatgtaatgttatgttattttatgttatattatcgaactctacatatatgttaaattgcacgtcatcgttatgtacccttagtaacatttgctatatttaaatagcctgtactcttgttgtacataataattcttatgattttattactttttcataattttacaagttatcttttgttctacattactactttttgaattgttctaacataaaacactatatttttcagagatagcacgtcatgatacacctaatttttataatgacatattaatttgttcttgcaggttgcgtgaggccggcctcctaccgatgtgtcggctggtggaggctgcagccggccacgcggacccggccaaacgctggaatgtggaccggtccctcctagcagctttggtcgaccgatggaggccagagacgcacacttttcacttgccatgcggtgaggtagcccctaccctacaggacgtatcgtacttgttggggctaccgctcgcgggagacgctgttgggccagtgaccacgggtgtggactggaaggatgatctgacggcacgtttcacaccagtacatcgcgcaccacatctcccactccagccgttggcacaccaccgcaacaccggacctacgaagaggtggctacttcagttcatcgtgagtgtttttgtaccgaaatgacaagcgtactacatatttagtcgtaaggtaaggtgcctaacattttatcgaacgcttacaggtcgagcagctacaggcggaggccgacgagtactcctacagccgttgtttggaggcgtacttgctcttactttttggctgggtgatgttctgtggcggtcacgggcacgcgttcgacaagggactcgtgcactacgccaggagcatcgccgacgccgtggtaggcgaggtgcctcagtggagctagggttccgcgttgttggtggctcagtaccgtggcctttgtgaggcttgcacgaagtcggatcccagcacgacctttggtgggtgccctctctttctttctatctgggcagctgagaggattacgatcggccaccctgaggtggaccagcatgcgtacgaggagtcactgtacgcggagcgaccggaggtcgactaccctacgatgggtactctgtggtgccgtcgtcaggtacgttgcatcgatcttctcttattgttaagttcattgctaagttcattgtacatcacatcgatcatctcgtattgcagcgccgatgggctcacgtccaggttaggcggtcgtatcctgagttcgttatggagttcgaccgccttctgccgactgacgtcgtgtgggagccctacagtgccgcggctacccaggctcgtgcgccgttgggtctgtccacactctgcacaagggaccacgcgtactggacgactacggttccgatggtcttcgatatctatgttgagcctcacgcccctttccacgtgatgcggcagtttggcttccgtcaaccttttccagtaccgtttccgacgaccgtcccagctgctgttcaccggtaagatctttcactacgctttgatttgttgcattaaaatctacctctccacaataatttgcaacatctgttgattcacactaatatgatacattaattcgcaggtactcgcacaagggtcagcagtcagctggcgactagcccgccaagttggggacttttgttgagaactggttgctcgcaaccaaggaggtcgtggagcacgagggagagccacacaccgaggaggcgtaccaggcctacctacgctggtaccagccacgcacccgtactagggtcaccttcgctcccttggagcagcagacccacgttgcgatcactagagacctctacgccaggcaccgtgactaggacttcgcttgtgctgtgagtaccctgcatcgcaccattcctttatgttttattcctttctcttcgtcaaattttacgaatatttacgaacaaattaaccatgcaggtcatcgacatcaacagggtcgtcgttgacggttcaacgacgatccaacgtttaggcgcggggattccgatacctgtagaggagcacctgacgacgtacacactgatggtggagtcgatgcgctcgattctccgagtgctcacctgtcgtgcagacgacgttgctcgggcagacgcagcaccacagcggccacccgtaccgactggtccccgtccaactgcgcacgttcctaggccgactccccctccgcacgaaggtaagtatttttaaggatttttttgtacatgcctagcacatctatgtgagccgattcatccgattgcttcagggtttcgtgcaccgttcagcaccccgcctttcttggctaggccttctgttgtgccccccacaggtacttaaaaaaacaacagtacttcgacaattaatttacatgcattttatgtcttagcttacaagagtcccgttgtcgatgtgtaggtttcgcccagttcgctatgacacaggccgcccacttctcccaggctgcagggtcagcgtctcaggcagctgcgtcgacttcgcactcagcgcagttctggcagtacatcgggacttcatcacacgcagctggcacgtcgagtcagggtccaccactagaccatgttgggacctcatcggaccacttggtggcttccgccttgctcttcgacatcactgacttcgacttcgcttcaggctcgacagaggacgtcatcggcccctcacagctaagaggcgcactgccggtgcagacgcaggaccaggcgcatgccactccgccgccagacactcgtgctacccatgctgtgccaccggatcgtttcacctactcccaggaccacatgcgagcacaggcccggaggaccaagcgtggtcgcggcgcggggcagggccagtagagcagacttctctttgtttatttgcttcgcatgctagtactgtatgcttgtgtaatgaatgcgttgttgttatatgtgcatgatacctttcggcgcatgcacgatacctttcggcgcatgcacgactactttctgccgcaccgatgcagcctcctttattcgcgtgctatacgagtatttgcccgccatttgccgcatacgaccaatgtaactttcggcgccaatcaggcgtacccaccatgccccgccacgttcacatgtcagggatatcactcgatttttggtgcctatataagtcgccttaacgagcgaggcctcacgatctttcagaactcagtcacattcagtactctcttccccacttgcttcattacaaatcctaccggctttcgtcaatggctagacgcctgggcgttgaggatccgaactagcgtagcgatccttatgtatacctactaccaccttggtgccggcgtcctctctgcctatgcagtgatcgatgccaactaatggcttcgaggaatcctgatatttgaggaaggcgcttttttaggtgccctaactatgaccgtgaggtattttattatctgcatatgcttattcattccgtatgggcaatcgttttattcttcgtaacactactctattcggcagacccgcactacggcttgcgcatacatcgagtgggtcgatacagaaaatcccgttctcgacctaaccacttgtttaaaagaaggtcgctggtatttcgcatccgaaagtactgagcaatacttgcatagaaaagcagcttacgaacgacaatgtcgtgaacaacagtgcgactggtgggtgctaactacgacactccctccatgggaagcccgtccaagatgcaggtgtggtaatcgttgtcaggttcttcgttccataaagcctacaacattgggtcgaaggttctttgtttgtccaaatattcttgtcgacgatttcatggtaagaatattttgattacatgaatccttattttctcacaacatttactaactttgctcgcttcacatctattctttcctcccaggaacgaccaaggagatgtcaatacagagaatggatagacactagaagagttctaactccacctagccgtgttgtgcagcttgaactaccagagcaatacatggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcaaatctaatatcatctatgtaaccgcaatggaaatagttgtatcatgttcaaattatactactatttcttcatgttacataattctccttgtttaagtccatataatgtttctacgaccgagactgcgataggcctatatcaattctctgagtactaatacatcgaataagttacaaaataataccttacttaatatatgaaattgcgaaacaaccaatttcaatacatttttataacaatattaacaagttttaccaataaatacttctttaattattattaacataacatagaaaaatcatttggcgatactttttgcatccgggtaccttggggcggcaaggggcccaaatgcaaaaagtacgaaccccaagctcttttggccgacaaggggcggcaaggggctaaatgcaattttggccgacgtcgtgtgccacgtcagcttgctgcccaccactggggcggcagggtctatttttgtaatttttttggccgatagattatttctgtaaaatttttaaaaaaaatctaaaaatgaaaaaaattcctacgaatccaatgcggagtccgactacgtatcgaatacggagaccgtatcgacagtaaatcaaatacggatacctatcgattccgtattctcctctgttccgctctctcttccccaatccgattagggttttacgcttccccgtctccgcctccacctcgaatccttctctctcgccgtctccatctccgcctcgaatccttccctctccccgcctccgatcaagcttctccggcttccgattctccctgacgccactcccttcaccactcttcacgcccgctgtcatggcgtacagggcgcctactctccggccgcagctcgcggcgtctccggcgagccgagttccgctatctgattctcgtcggccgccagtatattccggaagtaacggcttctggagcggcagaggcagatcgggtcgcgcttcgaccagctcgagtagggttgaggacaaggtactccgacgacgaggtttggatggtgaccaaacttcagtccgcgttttctcaaccccaaaaaaaggggcaaattggatgggcagtagtcccgcttcctctagcagcagcagtagtagccatgcttcctcctcgagcgaaagttggattagagataagctgtccggtgtccgtccgtcatcgctcgccgggcgggcaccgaccaccggcaccaagaggcagtgcagcagtcctccgccatcagctgatcgttcagagaagaaggcgaaagaagatctggcgatggaggagcctccggaggctctggcaatggaggagcagcaggatgcacttgcaactaaggagcaagctctggcaatggaggaggagcagggtgcccctgcaactaagggggagcaggaggtgttgcccgagatggaggaggagcaactggtgatggaggaggagcaggagtcgttggcgatggataagatggagtcggggatggaggagcagccagggatagaggaggaggtgttgccggagatggaggagcaactgatgatagaggaggagcaggagttgtcggcgatggataagatggagtcggggatggaggagcagccagggatagaggaggaggtgttgccggagatggaggagcaactgatgatagaggaggagcaggagttgtcggcgatggataagatggagtcggggatggaggagcagccagggatagaggaggaggtgttgccggagatggaggagcaactgatgatagaggaggagcaggagttgtcggcgatggataagatggagtcggggatggaggagcagcctgggatagaggaggagcaaccggcgacggaggaggtgccggcgatggagacaccagtgctggagaaggaatctgtgccgtactttgctgggccgtcgttcaacttcgcaccacatccgagcgaactcccttttccatctttacttattcacttaattcattctcactgatccctttcttacattgtgttttatgatgcgaattccttactgtttttttacctaactaagtgtctttattctattttccttaacaggacgaacgtggagaggtgaggacaagatgaatgttgattcgatgcactgtcggcggtcagcttacccagcagtcactgcctcagctcagccatccaggccactgccttcatgagacatgctccaactagaacatgtagttatttgttttcttcccctctccctatcaggcttcagggcttgatcagttacttttttttcttcttcctccctccctattaggcttgatgtcaatacgttttgtaacttgctcaatcttaactaaatggatgcaatcgttgcccctaagattatgtaaatggctcaatcttaatggaataaataaatggcaatctttaccctcccttgtaaatttgcagctgtgtgttgtgtctgtgtgttctccatatgagaggaaatgcttggggataatggtctttgcagtagaaagagttagagggaataagctgttctgggcttgaaaaaccagctgctatgccttcatctacatcctcctaatttaggtaatatatcatattttactgacatcgtttccatttaatataatgctgatcatgtcccgtggatatttctctaagttaaaagagtttctatgcacgataaggttgtttttgtatggctgcagttgggcgccgatgatgcgctccctagtgcgaatactcatctggatctggtctcctcccatctccgcgatgatggcaactggctcactgtgatgtcctctttatgccatcccagcaggggttggtgcctctgggctatctttgggtcgcacgcttttgccattgacaccaccgcggacgcagacattttgacattggatttggctggtattgttgccttgaccttttgtttttgctaatttttgatgttgcatgatatatatgtgctcgatgaaatggggcccgcatgcaatacttgttcttatttcagtagatggttataccatttgcagtgtattttcaccctaagtactactatttggttacaacatcgtgtttctgttcatgtgaagtgagccagagggttataacatcagctttaattcacttttttattttgctttaatagctacggttgggtctgaaacttaattgttgagatatatgtgcagctccattttgcactagtaataatagtttgttaggatggtctgtcgtaacaatttactgttacttctgtgacatttgttcaatcaaaatttgatgcatttgtgatatttgctgtttaggactgaaagaaactacttcttgccctagagcaaaaggtaataatgtaaagcactgtggcactgtaagtttataaccatagcagaaagtgcaaaatgcatgactcagttaggagaaaacaggaacaggctgagaagaagatgtgtaatacccaggaaactttcagcagcaaaatataattcagtaactatgcaaaatcactacttggacctaatgggctattaatgtgaaattgaattttcaggttatagatggtgtagtgaggttaaatatatagggtctgataaggtgcaaacactgctagtgctggccttgaggttggaggattagtaagattctgcttctctctgtttttttgggcacacacaggagagctgcgcatcatcatggatcaagccaggaattctgcaaggttagggcttgtttcctatagctagggtcgcggtgccatagatctttgtttaatctgaaagatattgctcttgtttggctctgtatgtgatgtagctattggtctacgtttcgtattatatcttggatcgttttgattttgttctaccactgcatgtttgttcaaaaatctgaaaccgctcttctttgcgggtcttttgttgaacctaggcgttggcgtttcagtattggttgctgtgctcttctaaagaaaatggcaaacatttgaggccaaggcaatttgggcgtctcctttgtgcatgcatgagctttgtgtcatgaccggcaatggtgacactgagaaagaggtttaactgtgaatgatagtgtgtgtgttttgggctagactttatcaaatagaatgcggcctgcgtgccttaaatcatttgggccaacggtccatgtaatcaggagataaatactcaagagagagaatggctgtggccagcctggcaaaaagaaatcgaatctatctctctccaaactgtctctcctctgcctcagctctgtttctcttcgtccccaactccgatctcgtctaaatatctctctctctcgtcggcggtgagtttcgcggtggcgtagtgttacagtggtatcagagacaggttgtgggcgtcgccgtgcgttggattcttcctgattcgccacggcgcccacaaaactttcagcccctttgaagccaggtatggactccatggagtcaaaatcttggagaagttggaaggcatcacaaagtggatgcacgagattgatcagcggctggattcccaaagtggcagtctcgagaaggtgactaccaaggtggatctcgccatggattccgtcggcaaggtgcagcaagagtgtgctgagttggcccgttcgatgaagcgggtggccagctgctctgatcaggccgggattttgggttcgcctttcgggatctcgcaggttagtgcaagtggttccgcgactcctccgccgttgaatccacttgttcctcctgtgttggatggggttgatttgggtcatggttttggtgatgggatttatcggcgtcatcagccacttcctaaaatggattttcctcgtttcgatggttctgatgtgcggatttggttggatatgtgtgagacttattttgacatgtaccaaatcactcaaaatttcaaagtctctgctgctgtgttgcatatgtcgggaaatgcggctcaatggtatcattcttataagttagtgaatgaggttaactcttgggatcagtttagaatggcagtcgcaacagaatttgagtgtgttgtggaacgtgagaaaatgtctgcactagatactctgactcaaactggtacaatgactgagtataaacaacaatttgattctcttgtctatcagatcagagtgtttgatccatctatggggggtaaaatgttagtgactcattttatgaatggtcttactgaagaaattcgagctgctgttgttattcaattgcctgacactgtacagcaagcat

SEQ ID NO: 23090 - DNA, 373 bp, Oryza sativa
ttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacggctgggcagtagtgagttgtggtcatgccacctccaggagtatgaactcgcattggtatcttaagcttcactaaagataacccatgtgcaccagcaaaaagcttggaaatgaaggaatgggttgcaccagaatcaaacaatattactgctggtgtcgagttgacggggaatgtgcccaatataacctctggtgctgactgcgcctcctctgcagatgca

SEQ ID NO: 23091 - DNA, 536 bp, Oryza sativa
  unsure (1)..(536): unsure at all n locations
aattcgccctatagtgagtcgtattacgcgcgctcactggccgtcgttttactaagattgagcaagttacaaaatgtattgacatcaagcctaatagggagggaggaagaagaaaaaaaagtaactgatcaagccctgaaacctgatacgggaacgcccttacaaacagttgctcactctgaatggtgaatggnnnnnnnnnnnnnnnnnnnnnnnnnnnnntgagctgatgcagggactgctgagtaagatgaccgccgacagtgcatcgaatcaacattcatcttgtactcacctctccacgttcgtcctgttaaggaaaatagaataaagacacttagttaggtaaaaaaacagtaaggaattcgcatcataaaacacactgtaagaaagggatcagggacaatgaattaagtgaataagtaaagatggaaaaggaagttcgatcggatgtggtgcgaacttgaactaccgccctacataagtacggtacaaattcctttccagcactggggtctacatcgacggcccctcct

SEQ ID NO: 23092 - DNA, 1368 bp, Oryza sativa
ggatgatcaaatattggggactgaattacagcaaaaggcaatgactaaattgatgggtttgcaatattcttttcaatacaagagaggggttgataatattgttgctgatgctttatctagaatgccttcctcctctcaattttgtgctctttctgtggtccaaccgatctggattcaggaggtgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcagcttcctggactgttagctcctctcccaattccaaaagaggcctggcaagacatctccatggattttattgaaggtttaccgccctttgatggttataatgcaatttttggtggtgggggatcgttttactaagtatgcaaatttcattcctttgcgtcatccattcactgcatcacaagtggctcatttggtggacaaaactgtatttaaaactcatggcatccctcgttctattgtgtctgatcgtgatcatctctttactagcaagttctggacaactctttttgctacttgggacactcaattacagatgagcacagcatatcacccgcaaacagatagccaaacagagcgtgtcaatcaatgtttggaaatgtatttacgatgcatgactcaggctaaccctaagaagtggagccattggattcatttggcagaattttggtgcaatacaaattatcatacatctcttggctgttctcctcataaggctctttttggggtggatcctcattattctcaagttcctgatctgacattggctactctgcctgatgtggtggatgtttagactgaaaggcagcacttgtctgaatttttacagcagcagttaactcgagcccagctgcgtatgaagaacaaggctgataaaggtcgttctgaccgtgtttttgctgtgggtgatgctgttttcttgaagttacagccttatgctcagtcctcagtagttaatagaccatatcctaagttggcttataagttctttggcccttttactgttttggagcgcattggagtggcggcttatcgtttggatctacctgccaacaacactgtgcatccggtgtttcatgtttctcaactca

SEQ ID NO: 23093 - DNA, 3611 bp, Oryza sativa
ttaactgtgaatgatagtgtgtgtgttttgggctaaactttatcaaatagaatgtggcctgcgtgccttaaatcgtttgggccaacggtccatgtaatcaggagataaatactcgagagagagaatggctgtggccaacctggcaaaaagaaatcgaatctatctctctccaaactctgtctctcctctgcctcagctctgtttctcttcgtccccaactccgatctcgtctaaatatctctctctctcgtcggcggcgagtttcgcggtggcgtagtgttacactttgcttatgctgccatgcaggtgagggagatgaacttccggaatgaaattcccacacatgagggctctgagacaattttgtgatgttgatttcatttataccgagagtaacgtgcaaaccagcggtaagtatgcaatattttaactaatcaattctttctaattcaagtatcaattcaattaatatttttctgtcgactttgtgtggattgagaagttatctgttgactctcctgtctgtgaagtagtatcagttactcctctcaaataatcaccatgattctgttctgctatgcacttctctgtctcagctgtcctgattaatagtacttcactaacattcttgtcttgtactcgccatggcacccctgtgccctggttcataatgttcgatctaccctttaaaataaacgatcgagattcattctacttgtagtagaatactgcaagtagaatgcaccagagcgtacccctcaatataattgttaaatctctgcagtaaattaataaagctgataaatgaagccaggttggaatatgactgttcaatatgattgttactttggtggctggaattaatttccaaagtctgtatccattttatattttctctgcgctacaatgtgatattggatttggtatacccaaggtcttcactgttccggcagctaactaattagaggcatcaaaatttcaaaccacatacatccctatcttttttcttttgtttcttaactgtactggcgcactgaattttggggtactgatttggtgtgcttttgtttgatattggttaccttcttctcttgggagaaatgtttagtctctgctcccttgctacacttgcaaccaagtttgtcttctgagaagttaaattagcctccatgcatatggcagtttgctacttgctggtctttgagattgtttgcttgtcaattttgttgggtatgtgcaattaggaaaatagtttctgatggagcaccactaattttgtttaatttccagttcggctagagttggaacagatcgtggattcgtggtgatgattctattcaccaaaatgaggtcaatgaccaatatgaaagtgatactcagcaaattctgattctttcacctgaccaatagtcagccccatcctcttaaagttcaaaatactgctgatcatgttgtagtggatatctatagacatataagattctatagattttaggaggggcatctcagatgctacaagtgtaacagcaccaagtcatggttgttgggtgttcatctgacctcattgttgcttgttggttgctggacgtacagggggcgaaccatcagcacctagttcttagccaggaaagggtcaagctgggcgattgtaagaaagcgttgggccggccgacgacgtagctgccggcggccggcgactgtgctggggacggcaccgccgagccaatggccgcggacgccgtcgttcattgctgcctaccgtggatttgtggttctaattttcattctttggatgtcatgacaagtcacccggcaatctactcgtccaaaaatataagtatttttaaatcctgatacagtattcaagatgctactttgaccagcaatatttataaaagtaaaatgttttaaataaaaagagttgcatattataatagtttatttaataataaatctagtaacaccaattttacatgattgattttttttttgttattaatagtcaaagttaaaaatatttgacttatcactatgctaaacatgcttatatttttggaacggagggaatagatttgtagcaaccaacaggcaacaatgacgtgctttggtccgttgtcagatcattcatatgtctgttcatgtagagctcggtggattttgaggctgaaaatggaccttctagcctttgcagttcctatattggtatcttcgaccgttacaatgtgcttgctttaacttgggtgcttcacatattatcgcatcttcattttttcttttcatgtgcctttcagacctgatgcttggctctgtttacattagtggtcaacagtttttataaaaaaactttcaaatatagtgtaattatattataactattatgtaactactatctaattattatgtaacttgcacaaaagtgcaatggagcaactggttaatggaggttaactagcaaaaaccgttgacttagtctatagcattccttgtttttttttattttttggaactggtaaattcctgaaatttggatcgaacggtggtgagggcacgatgattgcgcagcgtacaagtcaaggccaagtcgtcgggaacgtggacattccgtaacggactttccaaacgccgtcgctgtcgtactactccctcccgcttctcacgccgtcagcgctcgtacaacccgaccagtagtactactcctagtacaacctcgcctacccgctgcaaccataccccacccgacatggacccacctgtctgccagagtagccgacgtggcacgagtaatcttaaccccgcgagccaacccgcagtacaaagtacataaacgaagaggccaactatcattttactatctaaaatcattttaaatgcagtcgtgtgtttctatatccaacgtttgactatcttaaaaaaaattataaaaaaaataaaaaatagtcacacataaagtaacatttatattttatcatataataacaataaaaatattaatcataaaagtttttcaaataagatggatgatcggatataaactgtctttctagaacggaggtagtaattatcagtgacagatgggcccccacgtcagtcttctcccgccttccgtataaaaacggcctcacccgaatcgcgtttccccaccatttggcgcacccgtcatcggtcgaacaccacacctgcgtccatggcgggaggcaggggagcccgcgccagcctccacctccacctcgcctggctctgcgccttcgcgaccaccgcgtgggcgcatggcggtggcggcggcgggggcgattctgacgccgacgccgacggcggcggcgaggggaagccggacctgcgggcgcgggggctggtggcggcgaagctgtggtgcttggcggtggtgttcgccgggacgctggccggcggcgtgtccccctacttcatgcggtggaacgatgcgttcctggcgctgggcacgcagttcgcggggggagtcttcctcggcaccgccatgatgcacttcctcgccgacgccaacgagactttcgccgacctcctccccggcaccgcctaccccttcgcgttcatgctcgcctgcgccggctacgtcctcaccatgctcgccgact

SEQ ID NO: 23094 - DNA, 29060 bp, Oryza sativa
cgccgccgccggtgcaggtgagcagcctactagggttttcacgtgcttgtccgactctgtttttttcacagtagagatatcgtgagctcgcggtggaaaggtggcggatggccgttggattagatgcgactttttcctttattgctgcgttagtacataataccacaccgattgattggttgctattattggttggactggtcagcgaaatgggccaaatttactcctcttgttttacagttttactactacctgatcaaaatcttgtgagtttgtgtgacctaccctaccctgatgctttcagcgagataggaactgatttgtttggttgttcatctttttgttggtgtggcttgtactctactccgtttgcaaatcagttagcagatcaattcaattgtggtgcttagttagttactttatattttttttgtgtctgtctgaatcgataggaacaccttggtgctactaccattttcctatgatcttatctgaatgaaagcatatatagtaggtggtggttattgcctgtactgcatagttcctcttaattactgtcctactcataagttattttgtttagcctgctgctcaaatggccaaaagagaagtatttttgctgctcgcattatctaattaagcattggattatctgcctgtcagggctggaggagggtaagctgagcagcacaaatggcaacgcctctgacccaccagcagctgtaagcacctttccttatgaactcgagtaatttatcctgcgcagcaacagcgcaggttgttgcgtttggtttccaaatggaagaaggctgtgaagtctcaacttgtgtttgtgcaggatgcggcggcgcaagaccactccgtggcgtcgatgctgcggaacgcgagcacgctcggcgacagcgtgctgctcatcgccgcgctctgcttccactccgtcttcgagggcatcgccatcggagtcgccggtaagattattattatttttttgacatagacacgcatggatatactccctccgttgattcttttaaacatatttgacgttcgtcttattaaaaactttttgtgaaatatgtaaaactatatgtatacataaaaatatatttaacaatgaatcaaatgatacgaaaagaattaaaaattacttaaattttctgaataagatgaacggtcaaacatgtttaaaaaagtcaacggcatgacggagagagtatatatatagagagacctcgtgaccttgtccgttagtctcttgtccggttgtccctgcctgctcgacttaattaacactcgctttcagcttggaatttaaatggcccgtacatatgtcttcatgtgactttttatatgaagaacgagttcatatggttaatagttaatggtagttcaggtgtctataggagtaggtgaatctgtccttttttttaaattataagtgaacagatgatcacgtataaacacgacatatggaagtattgacgggcagagcttttgcgcgttcgtgaaaaaaaaatgcttgaaagtatcatttaagcccggggtttcttcctagcttgtttcttgtgaaagtctgatagatcgatgccgctgctaactgattaggacaaattggaatcgtgcgttgttttctcggtcaaaattgcacaagtgcttcactattttctcatagcgaaagctccgtgcgcatgttgaagatagccagaataaatgaaaaaagtcctaggactcggcttatattcaaagccaaacataggcagaataatcaccccgaacccttcatttttattttatttttattttatcttgggttcacgtcttatcgccgtttatcgcaatcaatgtttctgttcactcattgtcacgcatacttttactcgttccagtctagtagaatagatgctctgacctgaatttccctttcatcaacatccatttcgacaacattttagtttgcatcgatctcagcaagctttaccaaaccattcaaatcatgaattcatggatcaccgtagtccatttaaagatggatgcagattgactgacagtggctgtttgagtttcgactgctggaaaatcagaatcagctactcacaacaactagcgtgcagagacgaaggctgacgcatggaaggcgctgtggacgatcagcctgcacaagatcttcgcggccatcgccatgggcatcgcgctgctccggatgctgccggaccggccgttcctctcctgcttcggctacgccttcgccttcgccgtctccagccccgtcggcgtcggcatcggcatcgtcatcgacgccaccacgcagggccgggtggccgactggatcttcgccgtctccatgggcctcgccaccggcatcttcatctacgtctccatcaaccacctcctctccaagggctacaccccgctgaggcccgtcgccgccgacacgccggcggggaggctgctcgccgtcgtcctcggcgtcgccgtcatcgccgtcgtcatgatctgggacacctgatgccgctcatgatttcggacgtttgttggttcttgcaggaatgtgtgtgtgtagtaagttcgtcgtgaaattagcatgtgtaaagtttgtgccactccaaccaaagtttcaggattatttatagctttgaatatatcatcaacgctggggcaccattgtttttgtttccatggattttgggggtaagaaattgaccaaaatttaagttcgaatgcagattgtcaaacacttgagagccacacatgagaagaaaatcgaatgcaaatatgtcaaactttcccctttgctgagctgatagtactgtgttaaaactacgaaatcgatctggccaagctaagaaacctgtttgctcgcctttggcggttggcccagtcagctcgggtcggcccaagaaccaggcaaggctcttttgctgcctaaaaagccgggaaaaaaaatcaaacaagcttgagaaaagttggaaaaatatatttttttttaaaagaaaaaacagcccgaagaagtgccaggcttgccaagcttgggcccgactttttggtcagtttaaggctcaggctttgcatatttctctttcgatcgatcgaccgagtttcgacaggcgtcgatgactactactccaaaagtataactttctccgttagcacgtttatgtacgttttgtgtaaaaattttctatatagaatttttttaaaaatcaaataaatttatttttataatttatgataattaatattcaattaatcaggcgctaatgagatgtcatgttttctgtgctgctgctaatatgctcctccaatgtggaatttcaaatgggttagaatagttttcatgcgtgtttggatgctaatgggatagctaggtgattgagatttgagatctttctcacaccgcatcccaaatactccattcatttcaaaataagttaacctagtatgaaatgtataccattccagaaaggcacacgtacatatgcagatcagtatatagtagatggctagatgcattgcatccatcttaaattactccccccgtcttaaaatataagaatctaggatgggatatgacacatcctaggcttatgaatgctacttatccatattcgtagttttaagatgtgtctcatttaatcatcagttcttatatttttaggacagagggagtagtagattagatggagttagacgtagcagcagtcacgatgccgccgctggcacaactcctcaacgacgtcatctagttcaacatcctctcgtgcctgccttctcggtgctcatgtgcctcgccatcttctgtaggtcctggcgcgacctcatcctccatgacccccgccttcaccatgcaacatgcgcaaatctcttcccggcgatctacgagttccacaacgtcttcttcgaccacactactagaaaaagggttttccttgacggtcatatgagaaatccacctgcggaattttaacaaggggtggagggttcaggaccactagcgaaaatccattttcgctgattttcgctactggttgcttaagaagcccgcttgcaaaaaataaccctatttttattgacgggccacttagctcaccgccagcacgcactaaagagcgacacccttgaaaaaattcacgcacagtagaaaaatcaccgcccattaaaaaaaacgccacccaccactcctcatccacccaccgctccaccacttaccctcctcctcctccatcagcaccctctcctcctccctcccaacaggcggcggctccggtggcggttctcaggtggcggcggtggctccggtagcgatgcacggcggcgacggcgacaggaggcgggctcttcttctccttctcctcctcctccccctctccctcccacggtctcgccgccaacacctcctcgccggtgactgtgattcccaaattcggtggctccactggcaaatccgacggtgacagctacggggtttggtgcgacgggaggagctcggcggcggcggggcttcccacatttgttggctcccccattggatccagctatggcaagaatcagctgctgctcggtcagcgacggcgacgacgacctccttcctttctcctgctgctgattctagcaattctcttcgtgggacgcctcctctcttcgcatgtctcgccacacactatgctcatgccataggacggcctcctcccaaggagaccgccgtatgcgagcaggcgtgtgtagtggtactggcttgtttcctcaaacataccatcgtttgtaagtttttttttctattaagtgatttatattagattgaaaattgtttttgggttaattttgatattttaaaagacattttcagatttgagtaaaactttttaatatgagttttcaactcaaagtttcaattcaaatttgaaaaaagcaataaactttccactgaaaacttgaattttgtgttgggtttagtcccacatcggtaattgatgatgggggaccacgacttaaaaggtggaggcggtcctcacccatcagactaatcttttgggttgtgtaggcccagaatctaaagttgtggcccacggttggtgggccgggctgcgcactctaacaagtgggtatcagagcccaaggtttggaacccggaacaatttccatgggtcacatggtagagaggccaggtaacaagtctccggggtcacataggttgatgtgacgacttaaaaggtggaacccgggtcacatggtggagagaccaggtaacaagtcttcggggtcacataggttgatgtaatggggagattgttgtgtttagtcccacatcggtaattgatgatggtggtaattgatgtaatggggagattgttgggtttagtcccacattggtaattgatgatgggggagcacgacttaaaaggtgggggcggtcctcactcatcagactagtcttttgggttgtgtaggcccagaacctaaagttgtggctccctgtggtggagcaggttcaatgtgacctgggtggcctacggttatcgggccggttatataacatgttgtaactcaaattttgaaacttttaactcaaaatttaaaactttcaaatagagaaagttggtaaagtcaatttgcaacttatatgtggtggagcaggttcaatgtgatctgggtggcctacggttatcgggccggttatataaaatgttgtaactcaaattttgaaacttttaactcaaaatttaaaactttcaaatagagaaagttggtaaagtcaatttgcaacttatattaagcgtacatgcgctcatcccttgcatgttatgtgaatgatcatagtataaattttctgacccttggatcaagatccgaccgtgcacaccatattcctcatccctcatcgaatatttagtcgatccaaacatcaggaccgccgggccgatatgatttagcgaaaccgtttccacttctacatgtccattgcgatccaaaacatacgcaagcgaatctcccgacccgaagagatgacaaagcatcgtttcgtactttcgtatcagtttcgatggagatttttttttccgcaactctccgacgaccttatcgagtgcaacatcctcccgcgcctgcccttccggctgctcctgcgtctaggggtgaaaacggattggataatatctgatccaatccgctccgaattcgtccgaaacgaggatatggtatgggattttagaaatccggcagatacggatacggatgcggatagtataaagcggatgcggatatggtatatctaaaatccggtagatgtggattatccgacattgttgtcaaattatccgataagccgtttgctggataatatgaaattatcaacatatataacactctatctattgcatataacataagttggtatatccaataccctaattcatcaattaacaaagattttttagtctaaggcttttatcgtctcatgtcacactcactagctatatttttttatattatggacatcatgtgttcatgttgtttagcacttaatcatataattattacgacgggtcatttattgattattatattattgttccttggattaataactcgatgttgcattgattgtatatacacgtaacatccgataaatttaatccgtttccgaaccgattccgcaccgaccccgcaccatttccgacatccaaaacaatccgctccgcatccgcattcgtacactatccgcacccgcttcgaatccgctcaaaaaatatggtttaggatatggtatggccactatccgtccgaatccgctctgttttcacccctacctgcgtctccatcggatatcgttcgaagaattgcagatttgagatttttgtaaaaacataaatagtattttgtaataaatatttagacccctaaatgatcacaaataataaaattgtcaataaacaaaactgtagatctcaccgagttttataattttgatatacagtttttcttcatctgagttcgtatgcaaaaattatgtatatatatatatatatatatatatgtgtgtattttccctaaaaattgatccctgtccgcgaatataaaaaaaaatcttggatagtttcttaatttattcatttttatttaaaaaaatctaaatttgtttccgaatccgaaaatatttagaactatccaaccgaacctatccgactccgaaaaaatagtccgaatggacggaaagtatttataccagtttcatccctatgaatacccaacctccaccggatgaggcttgtgactctttgcagtttgcagttgtgccactaacatgtagatgaaagtaaagtggagcccacatataagtagcacagctccataaagttagatgacctgtttctctctccacctttaaccttgtgtttttagggattactccctccctcattataaaaatttgagacttagaatatcattttattaaacttttaagactaagtaaaattctctctctattttttttactcgatgagaccgtattctgttttaggctgagttcttatctccactttcccaactcatatctctatttttccacgcgcacgcttttaaaattgctaaaaacggtgccttttttaaaaaaaatttctaaatgaaagttacttaaaaaaatcatattaatctattttttaaatttattttagttaatacttaattaatcatgcactagcgctgctttgttttgcgtgctagggagtgaggggctttgccacccttgaaactttgcgctcctctattttatcactatttcgttatcattcattccacttttggtagtcaacgtcatttgaacatacgatttagccctcagtctgaaacaagttattagaaattccaaaaaaatacgaaatttagttttcagtactttaagttttgaaaggttgtataaaaattgatggtagaaaaaaattgggttagttagaacggttttagtgcaactttaaacaaaattttcaaaggaaaaatatttctgtgtatacacatataaaatgttttacgtgtaacttggaccttcaactttatattacgtagtagaataaatttatgaaatctagtgagtcaatgatattatgatactattttcctgtttttaaactaagcattttttaaaaaattgatgatcaaagttggtttgagaaacgtcaaaagtttctctctgtgtctctcgctcttactttctactccccccgtccctaaatatttgacaccgttgacttttttttaaacatatttgatcgttcgtcttattaaaaaaataaaaaaattcaagtaattattaattttttcctatcatttgattcattgttaaatatactattactactcaagtttttgaataatattcacaaaagtttttgaataagatgaacggtcaaacatgtttaaataagccaacggcgtcaaatatttatttagggcagagggagtatattacagtttgtttctaggtagactactggaacaaacatacaggtcggttttttcctgttcttgggacctttagaataaaaggatgttctgaaccctttacaatccatacacgtttacacatattaacagctaaagttttctaaggttgacaacaggaactcaaacagccaaacccaacttcctgtatagagcaagtagctgtagttttatatttagatcgaaacccgctaaagcgcagcatgataataaaataattcgctgtattttatcacggcaagcttttgcttacccacgtaccaagataaaatagcgttacagagggcaagagacgcaatttttgcactagatggcacaaatagattgaatgcctgtaatactactacaagggagctcccaattctgcactagctgacgggagtgacggcgcaagatgtctgcaatggatcgtcaggtttaactataaaacattacttcttcaactttggactaccatgttcattacttctagtcttttcttcctgcaaaatgttaattgggaataaggaaatcaaacctaaacatcaaatagatcaagtggctaaattcatattagcaacaatataagattcactgaaatttggcagcaaaatggatcgttctctagaaactaaatcattatgccattgtttctggaagcttgtttcagttgtttgtatcttgctacataatttgttcagctccaaggataattcaagtctgccgacagattcattctattaaatttgcttactgttcttctattgaactaattatatgtttgttgtgtaaagcacagtgtatacaatttacactgcaagacgtgaattagaccaaaagctatgagggattattgatgaaatttaatacaaaatttttaaatatgcttagggaatattcatcaccttaaatcctaaaaaattgtagttttgcagcatgatttttggaaggcgttgttcagaacagttatagatttaaaagttcaaagccatcagatttattaaatgcaaatgtaaacagtttgatacttgcccagatcatttaagccagaatctctcatgaatgagaacaccttgtgttcaaattatcattatctgtttacgttggataaatttatgaatcaactaggtgtgtctcgagtgcaaataaaagtatacatcgtgtttaagtacataagaagagggattggccagcaatgaattctggcatcatcatacctcattcactggctgctccagttcaagcctgtgggctgacattcgagctatctcagagatggctgcatcacggacctgcatatcatcaccagcaagctcttcgtaggcagcctcaaaggcttcctgccagaatcgtggaagtcggacctcatcaccggtgcgtgtgtacatgtcccacattcgacccactaatttttccctctcctccatttcctgcgcacaataacctaccaactcagctgcttatattacacaaagaatttgagaatagatttctgctgcaaatattaatacaaggagtagcacgatagttcttcaataactaggaaatcatagtgcaggaagttttatcggacctccagaaaaagaaatggatttcaatccaagctatatacagataaaaaataataataatcacgctttatacacataaaaacgtcatgctctagggtccacacatactaaagttaaacaatgctgtttaaggtatgtttgcatcttaggctagaggattccaagccttgcctacagcaggagaaaaactagctttgacaagtgagacaacaaacatttacaaacaaataaaaaggcaaatagtcagctggggcaagaaaaccttcacaccaaggcacaacatcatcttctcccatggtgtgtgatcattatcgaccgcattcctagcagcctatggcttatgttccatctcatccatgggccatggcctgagaaaagcccaagctgtcatctgtgcccctagctaatggcagagccctcaaacctcgatgcagacttcggttttgttaccaatcaaccttagtacttgactatgtcgctctgcatgccatatctctgacacgaatcaccaaaagttggctgcagtcataaaactgctgacttctatattgcagatcatgcaagcccgactacatattcaggtttaatctctataatatgttatgtaagagtacgatctcctgattttattctaaatcacatctagggccataggaactacatatgcttgtatcacatatcatacctaatatcagaatataaattactgttcacacatcttgattcttgaatcactatttgttatgtaaatgttatgacagttgaccaaacaaactagctttactcccacgccacagtccaaataagctttttttttttagcctaagctaagcaagttagacaaaagaaccaaatgtacccgtagcatcgatacgcagttccctgtcgtaaacagccccagattagctagtacaaaaatgttgtgaggtcttgaacacgaaaacagtagcatttgcattcagatacaacctttctcacttaattacgacgacagttgtgcaaatattttttcctgcattttcccacacaacagtcaaacagccaaaacaagaacacacttattcagagacctccaagcaataccgatagcaattcacaactgtttcaaattcaattcctactcaaacaaggcattgcgcatatagacgagaccacgcagcaagcagttggcaataagcaaaaggggaagaagaggggagtggagtgggaggtaacgagcgtacgagcgagtcgaggtcgtcgaggaggggcgcgtcgaggtcctcggaggcggtggcggcgaggaggaagcggccggaggaccagcggagggaggcggaggcggcggacatggaccagagcgcgaggagcgcgatggccgccaaggcccacaccttgtaccgccccttcccgaacggcggccccgcctcgccggcccccgccgccgcggagtagtacgggatggtgatctttgtcgccggggatgccgcgctgtcggcggcggagagggccttcattccggcggcggccgcggcgtcggtggcggtggcggcggcgtcgcggcgatgatgagctggtttttttttttccgttccgtttggtttcctccggtttttgtagcgtagtgaggttggccgtgtgggccccgcttccgatacaacgccactagtgatacaagtggtagagagccagagagtgatagtgggaggatactgaactttttttttttcttttggggagaattggaggatactgaactgaaccactaatcggtgtgacaaagatcatcatgcaattgcaacagcatttgaattttttgaatttttagttttgatctcaccaaaaactcaaaggaagatttttttttttattctccctctgtcccaaaaatataagagattttggagggatgtatcacgtcttagtgctactatgaatctggaaagagtaataggatgtgtcacatatgtcggtgatatgggtccgggggtatgcgaagtgagggggagttacctcccgatctagccacgtggccctacagcctggccctccccccgcgcctcggaagacgcaaaggcagccagggggcctcggggtgccacatcacacccctcggaccctcgcgctgcctcgccccgaggccctcaggcagctgccatgtggcgaggggagcgagcaaggaggagacccaggctgggcagccatcattgcgcggcaccccaaccgtccctcaccgcatttaatgcggtaagggcgaacatgcggcgcggcccgtttgactcacgtcaatcaggcgtgaccagactgtgactggcctgtcgccggtcacgtccgatcggacgggcagccgtgcccccacgtttgcccctgtacccagcggggtggaggcaggtatgtcccgtcccatcgaagcatcatccggagctccctccacgtgagaaggaccgccacaagtcttcattcatttaagagggaatgacagggctgtcacccgtgtcaggtggggggcggcgctgggtcccgctcaaggacggattgctgcttagcttccgggcgaaggcacggatcgtggtccggtcaaggtaaagtgggtccccctcacgtgaaaaagtaggtagaagcgatgcatgtagtatccccttagactataaaaggaggaccttgcccaccgagaaaagggacgacgctcagtagacctgaactctaggagggaaagagcgagagtgctctccagagtttaggaatctttgtaacactcgaccataaatcccacacacaggagtagggtattacgctccatagcggcccgaacctgtataatcttggcggccgtacgcgatccagaagcactcagggcgaatacgcgatctcgacaagcgagtttttttcccccggccgaactcacaaaaggggatctcacgatctcccgctagagaggatcacccctcgacaacatctatccaaaatctcttatatttaggaacgggggagtatttatttagtttgacatatgtgaagtgtaaaatctctcctttgtcaacagcccatcagcccatgtgttgggttgggttgggttgcaaactttgcaattggaacacaaaagttgcacacagtctggaatcagctcatgggaaaatctacggagtaataactgatgttttgctgtctaaaggatcatctggtctacactaaacattagcaggaccaatgcattgagaccataggctggcggcatgtaaaaccagatccaaaaaagaagagcaaaaaatcacactcaacgcagagatgttttgctcataggagcgatggcgatgcattcaagtctcgcagatccagcctcctgtcattggagtccttgaactagaaggacggcgaaaatctcaacttcagctccagtttcacaatccttgtaccagcctctgctaatcaaactgtgcctaagtgtttgtttgttagtatcttgtttccagcagggcatcaactagtccaaagtccatggcctagggtaaaaccaaaaaaagaagggggaaataagttataattcacatggcaaatgatgatttactttcttctgatacatttaagagatgaaagttacttcagatgaagacatgaaacgatccctctctgtccactgttgtaccatatccaaggtttgcccagtaaaagcagcaaacatcttatcaactttctgcatccagatttttcagaagctttaatcgcttagagagcagaatcaagagaaattccttaccctcatcaaacatctaattcaaatgtacactgaagaaaatatagaacttgttatctatcacaaaacacttacatcacgagcataaatggtttccccaacctgtcgcctcacctcctccacattaccctgcaaatcatccaatttttagaataaaaaacaaacttcaagtacaacaaacacaaaggcaagcaagtatgtcctagcaagactgtatattgtaagtttcatgtggccagctaaaatgatgatgattattatttactgtagtcacaatgttagaaaatcataatgcacccgctgcagtaactcagaaaggcagaaagccccagaatcatacctctgatacaccttgaggttgatgaatcattactctagcatttggcatggcataacgcattcccttctcaccgccagcaagtataattgctgcctggctagcaacaacaccaaagcacactgttccaactttgggcttgatctgcaataaatggttcatgtgttagtgcagaacaacaaaaaaagattaatattctgggatttatttatcagtaggcgaaattgtagataaagtatttggttatggaaaactggcataacaagtaaaaacacagccaaatctaacaactaacaaggctggtccagctcaaagccagttttagagacaggcatgatttcaggaaatgagatctgttgtctgcagtaccagaccaaacccaattagcacagtctcagcatggcaaatgctcatgtctagtatgtactacaataaaaatataagaatacaaatgttgcaagcactaccattgatatgagatataatttttgcctaaattacattaggctttcctgtaaatgctatatctgtgctatattataaatataaattcactagctaggggcatgcataatgtggaagatacaaaatgttgagatgcatctataatgtgttctcatccaacaatgtaaatattaaattagatgagaataactcagaaagcatccacaagaataaatataggtgaatacaatctctgaaatttgaatgcatgaaggacatggaaaaagtagctcaacatagatggcatacccaggacatgcaatcataaattgctaagatggagtagagacttccgccggggcagttcaggtagatctggcaaaacagaattatacaaaaggagttataagatatagagcaacacacctgtgagctaaaggagcaagccaagggagtgaagttgagcaatcaagagctgctgcagtgaacaatagggtaactgttatgatctgaaaaacacaaaaataaacactaaccagaatatcagcctcttcatcaacagcagcaagtgtgacaagctgtgatattacacgctgtgctacttgcgagttaatatattgaccaatgaagataatgcggttccccaacaatacagttgccagatcaagagcaccagcaggagtcattatggcaggcattaaaggtggattttcattctctgatgctacaattgtatttttcctgtgaaaaaatatttacaatattacgaatgaataaaacaggattctgatacacagcacaaataaaacctagatgagcagtttcaaatcaggcaatgtatcctcattgtatatcaggcatgacagtttcaaatatatcacctcagagaagaatgacaatgtatcctctcgtccaactttgaagaaataccaggtggtacaaattgtggacctaggtgtggaaatttgagtgagaatgcaactcagcacatttgcagcaatatatcatgtgaaagacagatggactaaacagtaaaggaatccaaaaaacatgtccaaagaaaagtttgtgctccgcatatcctgtcattatggcatgttgagttgtgctaatacaccatactgagttactgacaaacacaataacacatatacagtctggaaatctcattcagcagtttgctaaaaggccctaaactaatttcagaatcagaccaaactgaggtgatatgttatatgcaggttatcgtttttatacatatccgttcaaccaagcacatccatttttcgtgtacttagtgagctaatgctgatgcataccagacattggcccaggaaggagttgacactggttcagataaccccaggtcggcatactcttggataatgccgacattcagaggttctatatgctttgcaaaacctaccaatgacgactccataaaaaattggcacagagaaagacaactaggagctgatgggacggctgcccaaatggtcatgttctaatatgtgcaccaccatggacaacatctcagtaaagcttatcaaatcaacgatcaaattccaccaaacagtcctggcctaacgagctgaccaagggaaatggtttgctaaaccaagggttaggaaatctcacctgggagagccacgcctgatttggctccgctccgcctgaagaaagaaggaccagacagagggtgaggggacaagaacgggggaatccatgaagagagaagcgcggggcgagcgagcgagcgaaggaggtggaagttgtagttccgtggagctcacctgcgggagaggaggcgggtcggggaggcgcggagggcgagcggggtggagatggccataggcgccattggaggcggagctggagcgtgggagggagccgagccgaggcgaggactgaggagtgaggaggggagcgaactggggatgaggttggactagtatgggcttgggttgggctgggctgggttagggttttctcatgggcctaagttctagcccatctatgtgtatgggttggaattattattatatttttaggaataagttcaccagaggtcgctcaacttaatagcgagatttttttaagaccccttaaccacaaaaccagaaatgtataccctaaactcatctaaaccgtgcacacaaggtcctacggcagtatatatgggtggtttctttgacgtggcatcatagtcagcaaaaaaaattaaaaaaagtaggagaccacttctcttctctcttatctcttttgtttttcttctcttcagctcttctctcctaggaggccgtcggtcggcggcagataggggcgaggcgatccggcgagagggaggcgaccagccacgtcggcgtgagatgggggagaggagagctgctgcgctcgcccgccgcttgccgcgggatttgaggcttcctctgccgccaccaacaccaagcccatcttcaccggcgtcctcctcccatttttggccccgcccctctgcagggaccccactaacaggggagacggcgcgcccgcgatggccccgctgaggctgccgaggaggctgtatgtatggcctggcatcgagggcttcgcgcgacaaaccggctgacaggatttgaggtcccctccaccgccaacgacgtcgagtccccttcgccggcgtccttctttcacttccgcccccgccccttttgcaggaccccgaccgccacaatcaccctccacgtgcctatactcgactcctgcgaagcagtgacaacagcgatggtgcgaggtgcgaagcatttcttaaatggaccttttcgcaaatttttgctttgtactttcatctaaatttttttattttatttggtcttgtgaatgtgtgttcttgttttggtcttctgattccatgcaaatctttttgtgattaatgccaaaagggggagaatatttgaggatcccacatttgatatgatcgttgatataaagggggaaaatattctaggatcccacattcatttggtgcatgtcttgaaaagaagcataccatcatctaccatagcatccaacatgcaccatatgcacaagcatcacatgcatggatataaatcaattgtcaatttctcatatcatgttgatttatatcattaatttcacctttcatatccaaatgtgattattactaatggatttgtcatcaatcaccaaaaagggaaagattgaaagttcaagtgccattgatttggttttgatgattaatgacaaatccaattatgtgagactaatgtttttataagcatttctttgcctagtctcatgtggatatgaaagtggagtgttggtcacaaggatgaaatgcatggagatcaagctatatgtatcactctttctcttcatgtacatattgatatgtttgtatataatatttcaacgtgattggcatatgcatttgagactaatgttttgtttgagtattatctcttatttagtctatttacattgagaacgtggagatgatgaaggtatgtttttattttaatatctatatttgagaaatgccttctattcttgtataggataagctcttaatgtttaatatcttattatgcatactcttgcctcacataaatattttgtatgcatacatttagggggagcaaatcctatgctttagttatgcatgtaatcgatccaagttattcaccttcatttaattgggatctttacatttgaacatatatttgagtatatgacacttatggtgttgattaatactcatcatttattcatatccttttatacatgcgatcggttggtcaacatgtggaggttgacaacatgatcattgggactaataattttattgagttgaatgaaagaaataggtcccaaggattacaaaggtgttgatgctcaagtgatacaattacacctaataataccaagaatgacaaagtgaagatattgaagatgtgtgatatgaagtggctattatggcaagacggtgaagggcaagcgatactcggtcgcgatggaccatgcggcggtgaagggcaagcaaggggcttggcaccgaagaaccaaatccggtggtgaagggcgagtgacgactttgtcatgatggaccgtgcgagaccatttgaagctacaagtaaccgcatcaatcatttgaagaatatatggtgaaacggtatcggcattggcgtccctcaagacaatgaaagaaagatgaaaaaaaggcattcctaatggtataattatcttcttatttacatttgagtttaggaatgccgtactattaagagggatgtaacgtcgaggtgtttgtgtatgcctcgatgctcaaagtgagctatcatagtactacctcgagagaaacccaagcattaacctatcatttgagtggttttagaccttctttttggttgagttgggtaatcctctgagtgagcttttcatagagtccaagttcatcaaaaagggactcccgggtgaaaagttatagtcgttttactctgtgcttttcgggaagtccgaaaaattaccgtaaactccgaaaatttttcggataactccaaaaattttcggacattccaaaaatggctgcgaatctgagatttgcttctgtaagatttcggacttgttcgaaaagcattttcggaaactccgaaaattacagtcttggcctccaacggctagtttttgagaggctcgggtatataaactcctccaccccacctttgagtggctgctgctcttggggagtattagacacatccaaagccaaatagccatccccatttccctacctttgtggtgcctctttgtgagtgggatttgagaagggaaaagagttgggttgagagagtgaggagttgagagctagtgagcttcactccatcctttgtggtgcctctttgtgagagggatttgagaaggggaaagagttggattgagtgattgagaagttgagagctagtgagcttcactccacactttgagcactcgagttcatagcaagtaaatcttcgattgtgtttgttactcttagggactaaggtctcctagacggctaggcgtcgctggtgagcacccaaggttgtggtgtgccacggaaagtttgtgaaggcttcgatttcacctccgcaagggaagaaatcaagagtgaaaccgaggagtgcatttgtgcaacctcgtgaggaaagggttaaaataggcccggcccttgtggctcctcaatggagacgtaggatccgtggatccgaacttcggaaaacaaatcacgcgtctcctctcttagtttgcccatttgtgcattctctcatattgtgcttgagcttgtttttacccgatctacttgcatgcttaattgatttagttggtgaccttatatcttgtttagataccttatttgtcaccttttgattcatatacattttgtttatttgagctacaagttcatagctagtgttttatttcattatccgctgaacttttcggttgagaccggaacttccaatctcatatcgaaagttcctatttgaactgaaagttctctgaagttgtgatattttttaggaacgcctattcaacccccctaggcaacattaaggtcctttcaattggtatcagagcaaggcaaggtctctcattccgggcttcaccgctgtcacgccctgaagtttccccccttttgcttgctttaaaaattggctaaataaatcgtccgaagaaattatcttaattaacctagagctaattccctaattaataaatgcaaataataatcagaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccgtcgcccgcgctcggcctccccttgtgggccggcccgttcccctttcccctccccgaagtcctccctccctccctctctccttcgggcgccgacaggtggggcccacctgtcggtcgtcttcctcctctagccggttggagccgagccccaaccgccggcgccccacctccccacgccgcccgccttctccgtccctctccgcgcccgcacctcgcgcccacgtcgccgcctcttcccccgcatctcccggcccgcgcgcgcgctaaagagggcgggattcgatttcgaatccacctctctcactctccctccactccccacgtcgccggccaaatcggccacctccccggccacgtccgccccctcccgcacctataaatcgctccccgcgtcttcctctctcgtttttcgcactcgccgcgctctcccgtgcctcctatcgcgctcgcgccgcttgttgctagtgccgccgcttgccgccgccttcggccgcgagccgccgccgctagagtcgccgccgcgccaaaccgccgccgccgttagcttcgccgccgcaagagctttcccggccgccgcctcgcgtcgccggaatcccaccggagcacctctcccctcgcgagccggtgagtttttccctcccctccatctccggccggcaattcaagccgccgtggtcgtcgtctcctctcctaacgcctctccatcttctcctagggtgtcgccgccgcccgtccgtgcctccgcgtcgccggtcatcgccgctcgtctcttcccacgccggtcgccgccatcgcctcggtgaggaatcccctttcctccttcctttcctctccccccgtgagcgccgccgccctccgcgcgtgcgccgtcgtcttcggctgccgccgccgccttcgcgccggccgccgccgtctccccgcgccgccggtcaccgccggcggtcgtgcgccgtcgtcgcctcgccatggccggccggcttgagccgtgccgagcatgtcgccgcccactccctcccccttgagccactgcccgtggggcccgcttgccagccgccccctctcccccccttagtgccgctgatcagtggggcccgcctgtcggcgccaccccctcccctcgctgacgtcagccctgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagttgtcttatagcctgttttgcttgtgtgctttgtttgtcgcgtaggtttcggccgttttgtcgatccacggtttctcgaagacgttgctgaggtctcgtcagtgcgagagcaaggcaagtcatgcaatacgtttgatcatattgtacccaatttacaaatatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaagggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactattttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcatcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttttaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcagatggagacaaggaatggttcacgcgactcgaacaacgccagtggcagcgaaaagccgatcaatggagcacgtgccaacagtgcatctgacaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagctgcagcagcagaacctgcagtttggttctccacctcctcagtccaaactgctagaatttcttcgtgtcaagccgcccaccttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaacctcctcgcgcgctacgcccctgaggacgtgcgtaccgatgccgagaggcaggagaagtttttgtctggtcttgatgatgaattgactaaccagttgatctctagagattatgaggactttgagaagctggtggataaggctatccgtcaggaggagcactgtaacaaaataaaccgtaagaggaaggcagctcagttcaggactccccaggggaagagtcagaagcctcgtttcacaatgggacatcacggtggaccttccaccatgattatccggcagtaccgtccctaccacccgggtagcttcaacaagaaccaccatagtgatagtcacaacaacagtgagcagcacagcctcaaccctactctgagttcactaaagattccagctcaatcagttcagccagctctgccagaacagcccaagaggttgggagaaaagcccgaactctgcttcaattgtaacaaacccggacacacggttggaaagtgctcgaagccaagacgtgctggacccaagttcgttcaggcccgggtcaatcatgcatctgcagaggaggcgcagtcagcaccagaggttatattgggcacattccccgtcaactcgacaccagcagtaatattgtttgattctggtgcaacccattccttcatttccaagctttttgctggtgcacatgggttatctttagtgaagcttaagataccaatgcgagttcatactcctggaggtggcatgaccacaactcactactgcccagccgtgacagttgaaattcaagggttgatttttccagccaacctcattcttctcgaatccaaggacctagatgtcatacttggaatggattggttgacaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggacgatctgacaacaatgccaccaaagagggatatcgagttccggattgacttggtacctagaactgcaccgatccacaagaggccttacagaatgggagccaacgagttggcggaagtcaagaagtaagtcgatgaacagttacagaagggatacatccgccccagcacgtcgccttggggtgctccggttatcttcgtggaaaagaaagacaaaaccaagaggatgtgcgttgactaccgcgcactcaatgaggtcaccatcaagaacaagtatcctttgccaaggattgatgatctgtttgatcagttgaaaggagctattgtgttctctaagatagacctgcgatcaggctatcaccagttgaggatccgcgaagaggatattccaaagacagcattcatcactcggtacgggttgttcgaattcacagttatgtctttcggactcaccaatgcacctgccttcttcatgaatttgatgaataaggtgtttatggaatttctagacaagtttgtcgtggttttcatcgatgacatacttatctattccaagtccgaggaagaacatgagcagcatcttcagctggtacttgaaaagttaaaagagcaccaactatatgccaagttcagcaagtgcgacttctggcttaaggaagttcagtttcttggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgttgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcggcactatctcatcagtaaccgttgtgaggtatatacagatcacaaaagtctaaagtacatcttcactcaagctgatttgaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcaacgcgatttggaacatctgaaccttggtatagttgagcacggattcgtggctgccctagaggcacagcccacactggtggagcaggttcgcatagctcaagcaagtgatcctgaaatagcagagctcaaaaagaacatgagagttggagaagcccgaggttttgttgaggatgaacaaggaacaatctggatgggagaaagattgtgtgtacccgaaaacaaggaattaaaagacctgatactaaccgaggctcatcaaactcagtattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccagtgcacactacctactcagggaagaaattagcagaactctatctatcaagaatcatgtgtttacatggtgtacctaagaagatcgtgtctgatcgaggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgactttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagtaggggattatgtgtatctccgtgtcactccgctcaggggagtacaccgcttccaaaccaaaggaaagttggcaccacgctttgtgggaccatatcggattttggaacgcaggggtgaagttgcttaccagcttgagcttccctccaacatgcttggcatccataatgtgttccacgtctctcagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagtttccccccttttgcttgctttaaaaattggctaaataaatcgtccgaagaaattatcttaattaacctagagctaattccctaattaataaatgcaaataataatcagaatcggcatgtggaatttttcttggattctacatgtcacaatatattaacaggatttttagtggaattttcagagccttggaaataattttaaccaattaaaaatcaccaaagtgcaatttttaaatcccaggaaaatcctttcttttctttttctttttcctgtttcctcctttttcctcttcttgggccgtcggcccagtccacccttcgcccgcgctcggcctccccttgtgggccggcccgttcccctttcccctccc

SEQ ID NO: 23095 - DNA, 10059 bp, Oryza sativa
gtggatctgtatgtcaacaattgtcgtttgtgtaccctggctggtcctggacagggatttaatgcacattcagcttagaaattctggttcgagaatttctgggcgtgacaaccgccttgagagaagatgtcgacaagaggtgaaatgttcctagaacttcttttgctagatggttcaaattacatatctttgagtactcgtgtgcttaatgtgtttagggccatgggtcctcatatagagcgagttgtagatgtgagtatttctcctcctaatgataaagagctatcatttgatgaggaagagaaatgcacatatctcaatgctcaagctactaatgttttgtttagtgctttgagtgaagatgtgttcaaaaccattattcttagcacattagtttttgttggaaacatagtaaaaatacaggcacccaaaacctacccctatgagcatgttcgaaaaactaggccggtatattttaagagtgacgaagtcatcacgggcttctcgttatcgatgggtatgtcgcctaacactgagcaccagtgtcaaatctaggatttgagttgaatgggctgattacaccacaagaaacctaatcagttgagttacgctaacctcgctcagcacattaatttcattgtacaagaatccaagcatttttagcaagaacgggtataatagcagacaataagccatctataaaaacatatcgaggagataaaagaggagagagaagagcagcgggctacagatttgtaaccagctgtagtacggacttgcaagacgcaatgtgtgtatggtaggtggtgggaccaggtatcaattgtgtagtatatgtttataagtaactattgtatgtattaactattaaattgactatagataatttagagctaatagatggctatactattaaacttgctctaagtcagatgcataggagagaaatataaacaatttaatatttacagtagtgctaatccgcgcgttgcgcgtggaatattagttcgagcaccgcacaacgctccctccttccggttttcccttttttaccaccccacctttcctcagttcgttttttaccaacccacctcccgtgtttcttttttctcttttccattttgtcgtgcttcatcaaagggcctggtaaaatattaaccatccagacttttttgtttttgttcattctatccagtttttctgttttcgcatttttagtaaaatatttaccatctagtttttcttttcgagttttctgtttttctagtgtctccccacgttttaaaagtaatgaatttactctgtggagtttttccatttactctcagcctcacacatctgttcattaaaagtaacatttttactcgtatgaatgccccagttaaaagtaacaaatttacttgcatgaatacccccacatcgtacggcaccattcttagatggtcataaaagaattactaccaccttataacgctagtaattcttttactagtgttataaatattgtttagatttcatgatctgcgagtaaaacaattaccaccctcctctcaatatagcacatgatctcgtagtcaccgtgtagtaatatatttactgatgtattcaatacacagtataagagtaaaatttgagaccaagagtattgttaatatgtatcacaaaatgatcgtgcgaatgaaaaaagtacaggctcaatcacacacgaatgataaaattactcacaggtgaatcaaaatagaaaagaaaaaaaatgattcaataaaaaatccatcgtgaagccgggatccctagtggcttagctagatcttgctataaggatggaaaggttggtctgtgtcttgtgactgatagtggagagggcaaccgggtggcgagcggtaatcgatgatggaatcatgaaaggatgtagcggcgtggtatagagatgagcacaacgttgtgcagtagcagccatccatcatctagcaagcacaaaaaaaatgcaaaaacattatcattcatgtcatagagacgacgagaaaaagaaaaatagcaaacaacctccatcaccggcggactccaccctatcctctgcggctagtcacatggagcacgatatacaaatgtaggacctgtgcagcccatcaattcaaataaggtaatattggatattgcacgttaatttaattggcaaaaagaaattggggctttacgcgtgaaggtgtaggagagtatgcagatgcaaatcgaaatgtcattttcttacttgcttcttctgtcaatgtcgccgacatggagcaaccactggttgttgctcttggcccaggtgaacacatccttattggaaaaatagaatatatactgaaagtaaggaagttgtttttattgaagtaaatcatttactctgataatggtgggagcatgatgatgagacatagggtgggatcgaaagtaggaaagttgtttttatcgaagtaaatcgtttactccgataatggtgcgagtgaggataatatgatgtagggttaggtgggcctgtgctgatatacgtttggctagtagtatctctataatagttaactaataagttgaccaataggaaatatttttgactgaccttaatctttattaaaaggaaagtttgatatggagagtactaatatgtactccctccgtccaaaaaaaatcaattcctagcatcccaaggtagtattagtggagagtggaaatgactataatgcccttaattattgaaaaaaagtagtaagagtgatatatataaagggtattgaagaaataaaacttctcgttttacgtgctgagtgtaggtaagatggtagaagttggtttttttgataaaatttaaactctagaagttgagtttttcgagggtaggtaggatggtagaagattttttttttataaaattcaaactctataatttgaattttttttgacgaagggagtactcatctcgttccataaaaaatagtataggatatgacatatcatagtactataaatctagatatacatatgtccagatttacagtattagcatatatcatatctcgttatttattttttttatgggacagagagtatttcattgtttacacataaatatccgtgaaatcctctttggaagaatgtccgcataagcaaaattcagcattcaccattgatgtgacggatcaagttgttaaaaaaaaaaagaagaaaaaaccatgtgcgcgcgtttgagagacgaaagccgagccgagcaagctgatacggataggcagccgctgatcgaaccgcgcatatgcccattgtttgtttgtttatccgtcgtaatctctcgcttacaaaaatatctcccttctccgcatcactcactactcaactagcactactactagtaagcaagcagcagataagcatcactccctcccactccaaccaccacatcagcatcagcaagcagcagcagcagaagcagatcgatcgatcgatcgccatgagcgtggtgatcctggacgggtcgacggtgcggggcttcgtggcggacgacgacgccttcgcccgcagcgtcgacgcgcgcttcgaggcgctggacgccaacggcgacggcgtgctgtcccgcgccgagctccgccgcgcgctcgagtccttccgcctcctcgacggcgccgggttcggctccgccgagccggccccgctccccgccgaggtctccgcgctctacgactccgtcttcgagcagttcgacgccgaccacagcggcgccgtcgaccgcgccgagttccgcgaccagatgcgccgcatcatgctcgccgtcgccgacggcctcggctcccagccgctccaggtcgccgtcgacgacgaggggggcagcttcctcctcgaggccgccgagcacgaggccgcctccatcgccgccaagatcgacgcccagcgcgccgccgatgccgccgccgccgccgacgccaagtgacgccggccacgtcatcgcaaccgttgcatcggatcgggcttgtttttttttttttttactcttcacgtgtaccgtgtccgtgtgtgtcgaggtgtcggtgtacgtgtacgtatcacaggtggcaacgtacctctctgctacgcttatcaaactggagactactctgctttgaatggaaataaaataattttctatccactctaaaaaaacgtcatttatttgtactcattgtctttttctttttcacgctactcaggcctttctgagttgaggaatttttgaattttttttatggttgtcatatcggatatacacgaatacacatttaaagcattaaacgtaatataataataaaacaaaggcacagatgccaccagagaaccgttagacaaatttattaagcataattaatctatcattagtaaatatttattgtagcacactttcaaattatggagcaattagttaggtttaaaagattcgtctcgcaatttacacgcaatctgtatgattagtttttttctatatttaatacttcatatgttccaaacatttaacgtgacatggtgaaaagtttttattaggaaagtaaacagagcctaatttttactacagtaagtctttagagttgatgctgatcaatcctaggaatgctatctggcacacatacgtactcgcacgggttagctggcgtcgccttcactgcgccacatgttttccatctgtctttccgcaatgtttcctccattctggcggccgctttctgcgatttttttctctattttggtgtccctcccctcagcgcgcatttttcattttcttttgcactctttccctttttttttctgaaaaagtccattatacaccctcgaacttttatacttgtctgaaatacacccccgaactacgaaatcgggtataatacaccctctaactgtgaataccggatacttgacccccttgggctgttttaccatggattttacacacgtggatgacatgtaggatgccccttcgccacgtcagcacttatgattatgtgggccaagcccatattgctgggttgttttgacgttgctttttcacgagcggcggcggtagcggcactgcgaaggcagggttgagcggtcagtggcgcgcatctccgacaagcagctgcggtcgtcggcggaggagttgtcgcaggaaagtagcagctccaagccgctgcgcgcggtcgtcggcggaagccgcgcacgaccgcagagatggctaagcagggagcaaggaagaagcagctccgacacaagcgcgatatagacctcgtcacctcgacctgtctcttgtgacctgtgtgtgatgcttctcctgtttatcacaactactcatatatactgctctccctccgttttaaaatgtttgataccattgacttttatatactactctctccgtttcaaaatgtttgataccgttgacttttagtacgtgtctaaccattcgtcttattcaaaaaatttaaagtaattatttattctttttatatcatttgattcattgttaaatatactttcatgcacccatatagttttacatattttataaacttttttaataagacgaacggttaaacatgtgctaaaaagttaatggtgtcaagtattttgaaacgttgggagtattactaatctcggcaagctagtacgttgtgctgctagctactcatctttgcagtcatgagcatgtcaatcccaaggctaaacctgttcggcttccacgcctccaagcaggactgcaggagacgacggactagcacaagcacgagcaggagcaggagtagtactcgactgagccggagaacgcgctggtctgcggcaacggagacggagctcgatcgcagaggaggagctaggcggccagcgatgacagagctagctcgtagacgccggtcgcgccgaccacagtctgatggaggcgagcccgctcctcattgagtaaatctcgagcttgcttccgccaagctcggcgaatgggtgcgccaaactcgcggtggtcatggcgctcgagctcctccccgcgcgtgtatcttcggcgagctccacctctccactcggagctgcttcgtccctgcgccgctcccttcgccgaagaacgccgcccccactgccgcctccgccaccaccgccgtaggtgctggagctcgatttggttgcaggcggcgaatctgcagctccgtcagggacaagatgtagcaatgagcttgccgatgggtgtgcggcggtcctcgctgggcagatggatgagccatgcgcccatgccgaaggagagagaaagagagagagatagagagagagtggggaggaggaagaggaaggatcggactgacatgtgggactaactaatctatataggtggcatcctagtgtaaaaaacccgaaattttcacatctaagcatatgcaaccttctaattccaaatatgagtaggtaatggatggagttatatttttaatcaagaagcccacatgtgtgtgtgcagtggtcttccatcggacttaatgtcaaacgaaatataacaaactaatggctgctgatcattggacaaatcactagctcgtaggacttgtttaggtctaattgattgtttgtcgtcagaaaagaaaatcttattaccatttgcaattggttggatcaaccattacgagatagggcaccgtgccgtcatgccgttagtctagagctttcttcgtcttttttttttcttaatccatatttgacttggatgttgttttcgttttgaaaattggaactgtagcggtcggttgaaatataatccatctgcttggatcatcaaaatcataatattatgtgtgctaataaatcttgatttgtttcacatagaagctgcatcaacaaagggtaattataatactagcgaaacatattagtggatcatttgctttgtgcctgctagctagtttgattagaaagagaatccaggacaatacatgctcacatttggaattatgaggtcgcatgtgcttagattaaaaaaattcgatacaaaaacagtgtagaaaaccacttaagggggtcttttgcacagtattgaaagtttgagggggtcaaatgtccggttttaaagttgtggggtgtgttttagacaagataaagaattagagggtgtaaaatagagttatccctttttttttaatctgcagcacacgtgttttcaagttttcaagttgaaagttttgaaatcttgactcgaacaaatctaaactaaaagttttcaaattttgagttgaatgtttctaaatctgagttgaaagtttttaaatttactttcaaatcaagatttgaaagtttcaaattctgagttgaaagtttccaaatcaagatttgaaagtttcaaaatccgagttaaaaattttttagtttcgtgttgaaaattttcaaatcaagatttgaaagttttaaaaactgagttgaattttttttaaatttaagttgaaaatattcaaatatgagtttcaaatctagacttgaaagttttcaaatcttagttaaaaagtttccaaatcctgaataaatctgatttaaaagtttgttcagtcaactaaaaaaaaggaaaacacacgcgcatggcgaatttttatcccaaagaaaaagagggaaaaaaaaaggaaacgcatgagggagattttttttcttgatatgaatctataacaacacgcaatagaagggcgtacagctgcgccagttagccagctagcgcacgcgcctattagtagcccccgatctatccaaataaaaattaagtagtatcaaaatttggcactatcaggccacgttcggtattccattttggtacaacttccttatttttcattagcatatgcttcgtgaacggcttaacaatatttttcattatttaaaaaagctttttatataaaagtttttaaaacattcaaataaaccagtttttgtttttctaataattaatactcaattaaccatgtgctaattaacaatacgttaatgcaaaagaacgctttagttcgtgagtgctagagttggagaatttgtcaaaaaccaggtacaggattcccagttttgcacatttgctcactggatgcggcaacaagcttagcgtcaaaaatcggccggagcggatttgccacaaactgtggattactccggttgttaccgatgaccatatgcacttgtagcactagataacacaagctggaatcaagaatatgcatttaccatcttgcaattagcctttaaagtagtgctccctctcgttgcatatggaacttgggtctaggtttgtgcaaggaattaagcaaaatagttcaaatgactaggttatccttgagttaccagacaaacaaaaatactaactacagaagtaaatgcagataacacagcagcctatagcgtttatagatcaatttacaaaaacaggtgattgattacatgtggcaaggttctataaaaccatgactgattacataattggagggtttttaaggcaacttggtaatgggtatacaccaagagtataagcaaaaggcaattaggtacatcaaaagcttcaggatttctgtacccacaacatacaaattagccatctgctcgacagttcgttcagtcatagcttacaataaaacaaactataagagtttatctgacagaggttgcattgcatataaactgacagcagactattatcaggtagatacttcataagccaaggatcaattgccacgggcacaccggagtgcgccagtgagggtaaaccagaaccgcccgtgtcccgcgatcccgaggttttcacctcatgacggggacacggtggttctggttcattgtggggtggcgatcagcggatgcgaagctgatgtgctcttggtgagccagcatgccgcccccaaatgagatgctggagatctcggagcctgtcggtgtcgatggcgagcaggatgtgctgttctctgggcacaggttcttgccaaggacaacggcaccgccgctcgttctggctctacctgttggagactgagctgatgccggtggtggcttctgctgctgctgctgctgctgctgttccagcagctcctttttggtaaggaaccgaccacctgatccacgggctcgcttcatagcatgatgatgtcgagattcatggaggtaaggctgggaacataatggcatcacaattattaatacaatatagaaaagtgtagttacagacagcaggcaggaaggcacgcatgcaggaaacaaatgcaaccaaacaaggactaaacataagtggctacaaacaaaaactaagaatattaatttcgaatcattacagaaaatgtaactgcctctattgatgtttgcaggtaaaggaatgttacaagcataaatgatacatctgacatcactaaaaaggactaatcaatgaatagtacctggaggattaaatcatctaaatatgactatgtgacactgcccaagcttgtagagattgctaggaccaaatatgaaatgcttcagccataccttcagacctttcaccgccttattttgggcctccaattttgcacgcgtttgccttcttctaaggatcgcattgtattgctttgcattgacaaatatgggctcttctacagaaggatcaacaggcaatggcatcctagagtttgcagcaccagtaatttgaggatgaacctgtttgataatacacaagagtttaataccacaccacatatattttgcaggttttcttctatgcctatatattcttctaggtttttccactgggcatagtcctcactaaatgtcattattatttgaaaaactaaatttgtagcattctcctataaaattggtgagaactatttggataattttcatttccatttgaaagcatttgttgcttctgtttggataaataacaaagaaaataaaacaaaaggaggctgaaaattacagccctgtctttacttacaaatgcatgtgaagtgtatcctgttaatactccaccataatatggatcagtaccatatggataagaaacacatgcctggaaaaacacaagaacaggtaaactaaacataaggttca

SEQ ID NO: 23096 - DNA, 1697 bp, Oryza sativa
ataacaaagatatagtatttttcaaaatattagagtgacaacttaattcgccatactgaattacattaccatatatttgaagcctgaccatttgaagaacagattttgatttagcgttctacaggtgcaaagactcgtgatctttaaagcaataatgctcaagatcgagacaatcatcatttgaaaggctagcatgatttatttcacttatatacaacaaccacccacttggccaatcaacaagaagaaaaactaagtgtttctttcatgtgggtagaaacatatcattagatgcataattaaatatgatttaggcccgtgaatttacatacaacattccaaaccaaaacattgctccgtcctatgctgctcagatggattccaaagcaaagatttttctttggtgtattcttctgactacatagttttgtagcaggtctggttgccgcagacgtgaaagtagacaaatgaacgctatgtaaaagctatgggcagggataatacagaagcacatctaaattaattcctatagggattagggttagaatagatatggattaaaactcttatctgcccttaagtaatagtatatttacaatctttcaccaaaataaagcagggaagtaggaataataggtgaatgagcatcattcaaatgcaatatacttcttttgtttcaaacttaaaatggatgatatagtcacagaagaatatattcgcgtttctgcaattttagccaaacctctaagattgaatacgacattttctcccactggcataaaaatttcacaatgaaccaaagtttaaccctatcatgttatgtggggggagcgcatttttgtgttttctttcaaagttttttaaccaaaaattttcccctttacagctaataactatatggcactgacccgaaataataggagcaggtcccaaaagaaattgtttagcgtgcttgagagtcactcatgcatgtgtgttgtattatcccagaagacacgccacctgctcagttggagcgcttcaagcaaaaccaccacaaaatttgattgggggaaagaatgcgtttctggtatagatgagtcattgaagaaaaatgtattacctgattgtggtgaggtgtgttgtccgttgagactgctgtcacttactgcagatgcttcttggtgagactccccagactttgttggtgacgagtcaccatcagagttcctctgaactaactgtttcattggatagttattcctggcaagaaaatcctattcacatagaagtgaattggtaagttcattatcttcagtttaatagctatgattcagtatcacactgtgtggaatatgtacttacatagttggtcttggccatgcattggacaggatgattctccatttcttgcaacagcattatcattattagaaggcattactcaagatccacaaacattttctgtcctattttgaagttcagaaaattttcaggtcagactgacagtggcacataaagaaagccaagttactagataaattagtacttgaattcggtttgtatagtatccacatacaatgattagggattaggttgtcaaacatccaaactcagctggatgaacagttgaaaatgatcgaagcataaaataaatcaaagaactattgtacggcctctacaatatcattaacaaacaatactatgtcaactttatg

SEQ ID NO: 23097 - DNA, 410 bp, Oryza sativa
catgcagttctagcaaagggtaatcagaacagagtgcttgctgtgccatcaggaacaaataattttactggtgaactttgctgctcttcgtcagatccaatacatgtaccctctcctggttctaaatcagctgggacttttggagcaataaagcgtgaggttggagtagttggtgctaggcaacggccatctgataatacagcaacaaatacatccacttcaaacagttcagttaaggtgccaacaagtacagcaacaaaagagaatgcttcaaatggacagcaatctagatcctctggtgtatcatcgaaaaactcccgtcctagttcatctacacacttgagcagtagaccatcttcttcgagtcaatatcattctaagccaaatactcctgttggtcatccaaaagg

SEQ ID NO: 23098 - DNA, 4088 bp, Oryza sativa
attagctcctgatgcttcaactaacagagagtttaatgcccattcttcttcaaggtgattttgctgcatcttctctttgatataatcttgcatcataactattgttgaagtgttcagatttctactatgaagttatccttgtgtccaaattaaatctgagacatgccacatgtaattattcgttgattgcagtttgacgcattatactcttgcagatcaactgatgatgtgcctcctactgaccagacggatcttgttggctcttgtgtcatgcttccgaaatcagattcctttgtttcagtttccgaatatcagcacccattgactgaggacatggaggtcttgagtccaggtgtttttggagagcataggacaaatgatatgatttcaacccaggtctcacattcttcacctcaaccccagcatcaggacaattcagcagtgcatgactttaaggtgaatagaatatattaagtggatagaatatattaagtggatggcagtgtttcttattcgtggttcagcttagtggttttacctgacattcattcattcattctttttctcgtgtaccaggaatatgagccagattctaggtatgagatgccatttatcactaaagctgttgatagtgaggcgacccaaaatataccttatccgtctgaggaataccaccatgccacctttatgttcaagtccggttattatgatctggtgtctgcctgtctgctatacgtcgctttcgattttacattcataaagcacacttaagcaaacagcctttatattcaagtctggattcctctagatttatttgcagattgtgaatgcaacggtttttgagaacctggttatttgaccttgtattagaagtttcagaagcatcagagatctgcatttgtctatgtgaacatctgttacagctccaaagaagctaaaagggaatccaagctgttaacgcagcttgcttttccatactacctgctagtattttatcttttggttttgcacttttggcctgaaattatgttttatcaatggttggactaatcttgactgatggctccagcatttacttgtagttatagtactggatgtttagctttttcttcttaaggcttatccactgtccaagatcaatgtttccttagcagctgtgacattgtgtgaaactctgttgataggggatgggcttgcatgctgcaaatttcaatcagttatctgttactgcagcaactcacacccagtgcctcaaatgtaccacatgcatgtatcgcaatatccaaactgcttgccatatcgacatgttttctctccatactatgtgcctccagtggctgttcaaaactattcaagcaatccagcatttacacaattgccaagtgccagcagctatttggtaatgccaaacggaacgtcacagctagcacccaatggcatgaaatatggaccaccttatcagtgtaagcaaatgttcccttgtggccctgcttgataccgtggttttacaaattaaaattgttacccaatccattcttgtgtaattggtggcacttgttatggtcaaaaatgccatttctgttaattttagggccaccattctttccccactcagccctcaggtaattatatatttcatccttagaccaagccttttctgatcataattttgacacatgctgtaccttaacatgaataatatttgtgcttggttgcaggctgaaacagcagatgtgtggattcaggctcctacagatattcccgtcatgccgtcaacaccattctacaacatgatgggccaaccaatgtctccccatacagcatacttgccaccgcacaatggtcatgcccctttcagcccagttcaacaccctgctcacctgcagttcccagccatgccccacggactgcagccgacaacgatgaccatggtgcagaacccacaacccatggtgcatcagccagcctgtccgccgttggctggaaatatcggcattgatatggcagccatggcttctggagctcaggttggagcatttcagcaaaaccaactcagccatctcggctgggctcctcccagttttttatgatgatttggatggcagtgctctcatgagacgacaagtgagctggtttcgtatcgacaagaaaaagaaaagaaaagaactgattgaagagctatgctctaatgcaagtaactcatgatacttgccaccttttgtttatgatgcagggaaaaacatgttagtattccagttcatcttgcaccgcccaaagcgtgtcctgcattggaaacaccaattttgactgccagtttgctatcttatttatttctggttttatagtatacatcagttcgatcttaacttttctgatcgatgaaatgtgtgctccgaaatgctttatgagttcaactcaaatcgcatgataattccgctgttccctggagattttgtcgagtacccgagttgttgctctggatacacctgaatgctgcagtgctgcatcagatatgctaggacagttcactagtgaggtttaaattaaacacagtaataaaaggttcagggtgaaagataccatcaaccatgattcgacgtaacaaattgttaaatcaacgtcacatggttatgcgttaggtgtaaggtgcatctcaaaattttaagacgacagattggaaggtggaaagtggttgtggataaacaagattatagttcgtggaaagcgatcgtgcttaacacaaatactatgatagaaccctacttttctgctgttgatagagctagctcaatagtttaatggcggtagcaataacgctcatagggatcaatcaaacaagtcggctcgtgtgtgaaagcacgcctcatcttttcacttgtacttatgctcatcagctaaaatttaaattttcagtcttaaatttgaagttgattttaggttttttttcatcaaaatttatttttcaatctttgtttttaaatcgctaagaacatgtatataaaagttttattcacaaattatttttcgtttgcaaatatatcgtttggcttattccacaaataagcgaaacaacggggccgtctactccttattggtagggcacctataatgttaatatgttattatcttcatcccatattgatctccctataatgtttatacatcaagaccaaggataattttaacgccatgcacaatatgtacacattctcccgtaataaatgcatcgattaaaaacaatgcataatcgcatcctttagcatgcacacattctcccgtgctgtattaattgtactccgatgaaatccatgtccatgcggttatacgatgatcaatttgagaaattttagttttcattatatgataatcaatttaggaatgagggagtatataaaactaactagtaagcattaaatgtccctacttactactttctccatcccagtttgatcatcacgtaagcaaataacaccaagaccaaggacaccaaaatatttatcattctcaaattaaaccttatcggctaaagtgcttcattgcttcatcttcactactaccttaagtaaggaaataaaatatgacatgtacacaatgttttttgacagcaaaattaaaaaaagcagcggcattgggtggtggggttggaggggaatgtggcgtcggtttcaaggacggagtggattgcagcgtcgatgttaggggtggagcggattgcagcgttgggtggtggcgacggacaagtttgcggctcccggcagggacggagcggattgcggcattgggcggggacggagcggattgcggtgttgggcgggaacatagcagaatgcgacactgggtcacagcgaaggagaatgtggtgccggtggaaagagtgagaagaagttgagaggaattagggattgatcctgagctcatccatagggtttccatgagcgatgattttttaaatcctgtggaccccaccttaatgccgtctcgagcaaataagaattatggaggatgtctgctcctactaccacccatagcacggtcccacattaatactgagctcattaacggaaagggattctctgacttaactgctg

SEQ ID NO: 23099 - DNA, 1818 bp, Oryza sativa
acagcagttaagtcagaggacctgcttccctcattaacatatacttgctgatgcccacaggtgtattcggtattgagggttgagaaccctctctcagaataaacgaatcaatagattagcatataattaattaagtactaatttaaaaaaatagaattagattaatatattattttttaaaaaaatatattgtttatcagtctagaaagtgtgcacgcaaaaaataaaggagtggtggttgggaagagggagtatagaacagatactattgagcttattggctcaccagcaatctactaagctctatggaacattacacggacatttgagtgagttttttctctacgggttacaaatccctaatctaaaactggtttgtaatgtgaagcaaaatgctcccccaaacatggctataattaaagcatcaaaagtttttcaccgagggatcacggtaggcgtgcacatatataatcatatacccagtctacaaatataaaataattttctaaatataaaaggctagggaccatatcaccatactgattttgtgaccctgttttagcagttgttcaacctaaagaattttctataagtggccaaacataccgatagtccacatcgcaaagatggccatgcgtatatattacaaagacctttgcattgaatccaatgtcgtcaacacgtattcttcgaagtagagcttcaacttctaaatttaactctagtattatgtctagagtaaagttgtggagtagtctaaacccatccacttctttagtttattttgtgacagcgttccacctagttctgctcctattttagatagagctggaattatttggttggactttagcttcagaagaggtggtagagctagaactagaactatgccaaatagatcctgacccaaacaggcccttcctatccagcagcttataaaaagaaaattaatggcaccatagctgttggattactgactgcttaacgtatctagatgtagtaggcatgcacatgtagaaaaagggaaggtattttggtctggtcttatccatctgcaattttttagatgcttttctagaggaagttgttggcacaaaagatctcatcaagtcgtcatcatcatcaggctcgctagctggaccaacaagcagagcgtgggcaaaatgtggctgatatatatgtgcgctgatacgtgcagtggaaaaaaaaatctcctgctcaaggacggtctggctcggtttggagagcctgtgacataactctaattatgagaagctccagaacaattcatattatcatccagattataaaatttagaaaataagcttgaagtcaaaaggctgaaaaataaaggttttttattttcagattctcacgagctactcagagtctcagactcttaagctcactaaataatgtttcattattagatacaagccaaagatactagtcggaatattaggtagatcattttgagtgacagtctcatatgatcgggatcttattagattttaaaaatacttcacattattacgtaggatcgggacattacacaagaacttgatcgtatggatcggaatagtgaaaaaaaattaagatactaaatgagattgatattatttcggcttggtatgattgatactacaatacttgcggaaccatcattttgtttatccttatacttattcgtacaatttactagaaaaaataatttatgggtaaaatttatatatgttttcataacgacgtaaaagcaaatgttgtaaaataaaccacaatgagaaaaccacaaaatcaactttaaaaataagttttaaa

SEQ ID NO: 23100 - DNA, 3902 bp, Oryza sativa
tgcacatgcaggggagtgtgcagtactgcaggggatctcaattgcacaccaccaccatcaccacctccaccagtgtctgcttgtgtaggctgtaatatatacaggctgggaggatattaggatttgggtgagtcagtagtttgcaattctgtaggtacctctttaattttctaagcatgatatttctttcgaaggatgaaagattttgtttcaattaattaaaaaaatatttttaacaagaacttaattttgctattttaacaatccgttgcaacacacaggttttcggctagtagatataaattaaataacatggtaaatgaacttaataacaatatcttagaactagggatttgagcaatacttacataatttttttaagggagcattactcaattggctagttttcttgtgttgtaaccagccctctcgggttcaaattctagatttgatacaggtgttcgcatttacggctaattattcttacatacccgtcgataacgaggcgcccatggtgacttcgtcaatatatcggtccaatcttccggaggacttcatcaatctcaagatatgacagcccagtctttaggaggtgctcatagtggtagtgtgcgtatgtacgttcatggggtgagtgagcgcgtgtttgtactatttttctaagaaaataattttttttcaggaaacactgttttagatatgtgaaacaaataaactgatgaaatagctgaaaatagccgggccaactggccaattccaccggtgtttgccaattcttcatttggtattgcatgcacacttcaattaaaaatatttaataataaaaattatcctccatctgctgcacacggttggttcggcatggttagcacactcttgtcttgggtgtctcttgtccgtccaccgcaccgcacccaccgaaatccgtcggttatgaatcgtcgtcatccccacaccccactattgacatctggcagcaacaaaaattagttggcgtccttttctgataataacgcgtaaggcaaaaacttttcatcctatcctaccaaatatctagactcatatatagagtattaaatataaaaaaaaactaattgatatagattgcgggtaaattacgagacgaatattttaagcctaatctatctattatctattattatatactaaaagtccatgaaactttctacaaacgctctcaagccgtcgcgtggtgctcctaaaaacactcataagtcgccacgtggcgcattgataaatcctaaaaattctaaacatctaaccgttgattttcatttaattggatagacccattattttcaaccattaaatctattttataaaattaccaaatcaaccaccgatagatctatattacgagtacaaaattaccaaatcaatttatctctcttaaattatccctcggtccgtgtacctgtacagcatgtatgtttgtacgtacgtatcatcccaccatacttttttttctattttttctttcttatttagattagatgaaaaatgaaaataaataattcaagtccattcacaaccattgattttccataaaacatggtggactaattagatttttgttattataaaattgaaaggcccacgtgtgccacgtcctcccttccatcatgtaagtgcgtacttagtatatacatgtatatatcggtccctctacctattcggttccctctctctatgatgtattattagccatcaaatcgttttcacaatggttgtgtagagcctcacgcactatatatgaatcgttcccaaatgaattatctatcacataatgcaaatatattggagtatacaaacctatcaatttaccgtagccttatgtcccatataatctatttattaataaataatgagaatctataccaatcttacttgcttactgataatttttttttaaaaaaaagttgacacacagggtgtaatgatgtcactatttgtcatatcatacatttgaacttaaaataatatttgtataaaatgaaacaaaagtgtaaaatgaaccaattctagaaaaccttataatttcttagaaccattgtggttcgtaactttcccttaaattgagacaaccatgcataaccacttcatcatttttaagtgactacatatcaatagacttctctctgttctatgccatagcagaagatagttggctttgaatattatatttcttactattaaatttgggttttaacactcaggttgactaaatgtatttaaacaaatatatagatcacacatattataggaagcgaggtctagaatatatctactctatgtttttattgattcatacataagtacgtataacaaattgcatcaaatgcgaaccaattaaaagaagtaataaaacacatttattataaataacctttttgagatttttttttaaaaaataggagcccaaaacatttaaataaaaagaaaaacaacaccttactttaatttggatttaaagacctacgtcttcttaaatgatgaagatgattaactttatagatatgtgcttatatagatgaattaaatattacatattgtaaactaacaaatatcttaaaagaaacatttaagaaatgattcatgaatgtccgcgcgaatgcgcgggctaccatcttagttgttccataatttgacactgtggtgctacagtaaacaattgctaatgacggattagttaagtttaataaattcatcttgcagtttacaggcgaaatttgtaatttgttttgttattatactacatttgatacttcaaatgtgtgtccgtatatccgatgcgacacgccaaaatttttgatgccaaaacttttgatccctggaactaaggcggtgtttagatccgaggctgaaaatttttgccgtgtcacatcggatatacagacacacatttgaagtattaaacatagtctaataacaaaacgaattacagaatctgtctataaactacgagacgaatttattaagcataattaatccatcattagcaaatatttaatgtaacatcacattatcaaatcatggagcaattaagcttaaaagaattcgttctttcgcaatttacatgtaatctgtgtaattagtttttttctatatttaatacttcatacatgtatccaaacattcgatatgatagggtggaaaaacttgcgaggggaaagacttgccaagggatcaagacagaccctaaacagggcctaaactgcatggccttcttttgtgcaattgcaacaggacaatagcatactagtagtagcaacatgacattccacttttgcccctacacgaacaatgccagggacccagggcacataatctcagctacccctcgctatgctgctaccaacgataaacaatcttctaacttatcccttccacttatattataactcgttttactttttttataaaaaaaattactaaaattttcaatataaaacaaacatattatcaaaaaaatattcaatgctaaatttaataaaactaatatagtgttataaatgttgctcattttttctataaacttagtcaaacctaaataattttgactaaaaaaataaaataacttaaaatatgaaacggagggagtaacttatagcttcaataaactaacatgtgagcctgctcgtgagctcatatatcaacaacctacgtcagacgactatacattagaggagcttctccttatccaatgctattgatagacgacatggactctctactgtatgtttatctatctaagaaaatccaacaaatataattgaaaatgctttattattaaaaaatatcatcgacaaatagaactttcaggaaatgttattgtacaagtcaacttggcacataaataccaccgtcattagggggtccat

SEQ ID NO: 23101 - DNA, 687 bp, Oryza sativa
ttgttgatgaattattggatgagctctcaggtactaaattcttctctaaactggacttgaaagctgggtatcatcaaattcgaatggtggaaactgatgaaccaagacagcctttaagacacatcatgggccatttcagtttagggttatgccatttggtctcacgaatgcacccttcaccttttaatgccttatgaactcaatctttgcactatttataaaggaagttggggttgtggttaatggccaaattttaagttattacccttaaccttaatagcaattgccttaatcttcaccaagttttggtaattttaaggcacaaccagttatttgctaaaaggtctaaatgctcttttgctggcattcaactggaatacttaggacatatcatttctgacaaaggagttagtactgatcctgagaagacagcaccaatgctggcttggcctgtgcctacttctgttactgaattgaggggattttggggactgacaggctattacagaaaatttgttcagggttatagtatcataccatgaccattgacactcttgttgaagaagaaggcctttctttggactgatgctgcttagcttgcttttgatcagttgaagcagctatgagtaacactccagtgttagctttgcccaattttaagcttccttttacttttgagactgatgc

SEQ ID NO: 23102 - DNA, 423 bp, Oryza sativa
cggtgtgatggatatcattgctggaattaggacaacctatcttgcagcggcatgtatacctgaactgtggccatgtacgtaccgtctgtttgctactctgggctggacatgccgtttgcagatattctttcgaatggaaaaatatgtgttgttccggatgtcgacgacactacaggtatctggagcattacaaagcagatccatgtctattccgtgtgtcattgccatgattaatgtgcctaatacatcatcgtcgtcatctctagcattgtcacatctcacttgttattttttggtgctctttaattttggcgatgattatgggttgccatggaccgcaacgcacggatggatggttgtattcttcaacgtcatcgcgaaggaatcgaaatcaaaggacaagcaacgattggaacgtaaagc

SEQ ID NO: 23103 - DNA, 16292 bp, Oryza sativa
  unsure (1)..(16292): unsure at all n locations
agttggaggatctaaaagagtgatctgcaagtttagggatcgggatgacacggtcgaacaagtttgaggatttaaacggtcgatttgcgagtttagggaccgggaggaaacatcgatacaagtttagagaccggtgatggattttactcttttttcaacaagagcgtaatatttgttgctattttgaatagtacgtagcaacacgggggtatgctgaagtccagaaaatttttgatatatgatgaaccaggcactggaagcttctttaagacgctgggacctaaactgaagttggctcaatcagagtcatactctgaatcctaatccttaaatttatagtacctatcatcagttgctgcatgaatacttttaatttttttcacgaatgtgtaaaaatattgtacgtcagtatattagaagaaaagagtttatgttacacaaccgacatgaattcgttttagaaaaaaaaaatctttactcagataactttagttgtgaaacacaattctacatgcagtatctttattcgttgcacactcgaaatgttcaccttttattttctgtggctctaggtggctaacgtattgcaagatgttgcttttgccatactacatccatcccaaaatataataacttttagctatgaatctagacatacaattatttttatttatagctaaaaatacttaggtagtgtttggatccagggacttaactttagtctctatatttagacactaatttagagtattaaatatagactacttataaaactaattacataaataaaagctaattcgcgagacaaattttttaagcctaattaatctataattagagaatgtttactgtagcatcacataggctaattatggattaattagactcaatagattcgtctggcgaattagtccaaaattatggatgggttttattaatagtctacgtttaatatttataattagtgttcaaacattcgatgtgatagggacttaaagttttagtcccatctaaacatggccttatattttgaaagagagggagtacagttttggtacatactatcatgcattgctgaacccaaagctgtaggaaaaggtgacaacactggtcaaattagttttcagagacttcggtgacatctaccgtctggctctttgttgcagactgaagttgtcaatgaaaatcacaagtactccgtacttctggatgcttgtacaggctattgcaatcaaacagaggtactgcatgctagtcctcgtctctttctgagaaatgaacgtgaaaaggcactaatcttttttatgtaaacagaggtatcttgcattcgtatttcagtacagctatgggaagaagggggatgtgtaatccactaatcctgaaattctacctgcagaaattcatcgaaagaaaagtagtagttaacactcaagactattcgcaattttattggcctgctgattacataaaaaagattgagacctttcacacgccatgaggtatactactatctttttaaaaagatcctcaggagttaataatatcaggctatgaattagccatatccattggaaacttcttaaaccaggtcttctttctggatctccatatttttgcttgcgccgacatgtgggaagctaaagggcctagctaaacacnaagctcttcctctaattagcagttcagcggcattgatggacgattgaccttctgttaaagcgcggaatcgacgaccatttggtttgccccttctatgctcaagagcttgagacggcgaactatatattacttgattgtgtgttctcttttcgccattgcgttgtgtattttgaattctggttttttctaatatattatcgtgtaaattttttgtgcattcgcgaaaaaatcaggtaaagatgatgcttgggttccggatgacttgtttcctaattttctcttgttcaaatggtcagttccgtatttctgatgcatgggctagctgtatgcattgtgcacatgtgcactatcatatccttctgatcgtgcatggtgctaacatttccctccgtgattgaagggaaatatttcctgtcatctttaaggcaacttgggaactggctcgccgaaattgacaggattttgtccgtgattgaaggatcggcaggacataccttcgccagcttcaagttcaatatggaatggccagccagccgttagtggaagatatggcagttgttcctcatattctgagtgtgtcccatacttcaagcacaagtgcacaagttatgtgaagaaaagcttagtcagtcagtttgcattttacagtgacagagagggcctgaattggagagtttctcaaagcctcatacgtagtgtaaatcgagtaaaggctaaacagtttggcattggcagtatcaggaaacgttaccgagagagaacacacggaggtgcagtagtttaacacaagacatggacaccagctatcacaagaggcgagacgattccggcagaaatgtccagaatccctcgtattctgcttggtgaaataaacaaagcatatatttttgctttttccttgtgatagatcgaggatgcagaccgcagatgcacccgttcgagacactacaaaacaacacgtccaatgcactagagtgtagagggtccagagaaggtcttatatagcattaatctacactgtcaagttgcttccatggtaaataacatactaatagtaaggtttgcttctccattctccaatgtttgagtacatccactgatccacccatttcccccaagaaaacaactcccctgcactgcaccactcgcattgcatgttggtcttctgaaacactcagatgtgggatttgttttctgcacccaaggtatgggtcgaaggcgttgtagttttttctatcctgttaactagtgttaactgttgtgtgcttccatagttgttttctgagagggtcaaattaacaagtactacatcttgctcaatttgcaacaaattaagcaagaggttcatggaggccctatattttgttctgtcagataaaccgatgtctatttgcttcatctgaatatgtttctcaaacgaaatgaaacctgtccccagtaatggctaattgctgccatcattccaaggatggatggtttcaatctcatcgaaacttgcggaagaaacgcttgcaccattagtccattatccatcagacactagctagtacactgctgctgctacaagttggtcacagccgaagacgatgctggagtgttgcttattgtatactactagctaaatgtataggcagggaaagcgggcgtgtttctgtgcaacatgtccgtgaatcttgtatttttctccggggtgcgccttgggtagcggagacagggaaagggagacggcattgctgccatgccatggaggtggagggaggtgaggtgcatgctggccacaagctggacgcaacgagaccatgtgagaaagctttggatggtagctactctgaatatgcgtgcaagccgagagggttcttcagctcactgcagaggagacgatgctagctgctgccccagtagccataccttagacctggtgcacgcacgcgacctcttttttctcgctgctcgtatacaatgtacaattatacggagtacaatgtatttttttcttcagatgtacacttatacagtgctatagtctacagtagatgtaccctagttctgtggctttgtgctgctatctggtctttagttttcgttgctgaatcttacaagtaaagttgttgcagtacatcacacggtgtcagtggcaaatgcacgtagtaatcccccaatctagctaggttggctgagtcagccccgcaccaaagctgatcagacgccgcacaaaaaaaaagcgctagaaaaatgtttcagttcatcgataaccggaaaagggaaaaagatattccgtcccatctgcgcaaagatcgtaaccacttctatgattccggactgtttagatccgctcgtatcaaatacttgacacatgtataaagtatcaaatataaaaaaaactaattatatagattgtatgtaaattgtgagatgaaatcttaattgcttcatgatttgataatatggtgctacagtaatcatttactaataataaactaattatgcttaataaactcatctcacattttatagacggaatttataatttattttatattaatctatattcaatacttcaaatgtaaatgtatatccctatacctgatgtgatacacctaaacttttaaccgaaatctaaacacagtctctatctcgattcccgccgtaatgtttccggctcctcctcccccacatcgcccgttttttcctttgttttctcaagctaaacccctgctatatattgccacccgaactcccgcatttttctcctcgctcccgcgtcccaccaccaccctcaaagcagaccacacactgtgtcgctgtcacacacacaccgggccgagctgagcctgagcttgttcggcgatggccagggcggcgcacggcggcggcggcatggggcttctcgcgcgggcggcgctcgtggcattcgtggcgcttgtgggcgtcggcggcggcgcgagggcccagctgcggcagaactactacggcagcacgtgccccaacgcggagtccaccgtccggtccgtcatctcgcagcacctccagcagagcttcgccgtcggccccggcaccctccgcctcttcttccacgactgcttcgtcagggtacgtcctctctctcggtctcggtctctcggcgttttgggtgttcatcttctcggcgtttgcgtttgcaggggtgtgacgcgtcggtgatgctgatggcgccgaacggcgacgacgagagccacagcggcgcggacgccacgctgtcgccggacgcggtggaggcgatcaacaaggccaaggcggcggtcgaggcgctccccggctgcgccggcaaggtctcctgcgcggacatcctcgccatggccgcccgcgacgtcgtctccctggtaacaataaacactactgtacacacaaatccccgtcctgtcgcgactcgtcacgtcctagtgtgcgttcaacaatactagtactacaatgcggtgtaccgccggctcgactgtagtgtagggcacgcccttgtcagtcgccagcaagcacggacccaccctgattggcaagctcaagcatcggcgtagtagtactagcgttcatactccccatcatcctgtgtgtggagtactcctagtacgttgcaattgcaagtgctaacgcttttaagcagagagggcagccgggggcccaccacgccggtgcgatgacaggtggggccgacggagctactgttgcatccagcgcgccagtaaccccttttttttgacaaactggaccatcgatcgatcgatctatccagccgtgagcccatggccatgagtcatggctgactccggccatgagacaccgcagacacgagccacgcatggtccatgtctccccggttggttccggtgctccacgtctccacagcctgacccgcacagtggctgcaggcagtagccgcaggcgctgtgctgggttcggtttagttcggtcgctctggctggctggcctttcgcagtttggccccctcctacgaaaaaaagaaagaaaaggggaaagtcgcttacggagacatgtgagccgtgtcggcctcggcttccgcgcgaggaaaccgccgcgcggcgcttgcgattgcgcatgcgcacggtcgtggtttgctggctcgcgcactgtggcgcattcgccgggtttgataggcgatatcgcgtagtggcggggcgcggggcgcccgagcatacgagcgtacgaggcgggtattctcctcctgtgtctccggctatccgctatcttttgagatggcaacagctttgagcgtactgcggctactgcctgcacagtattgctttgagcgtacgatgactctattgaacgagtattgctttttctgcggcatggatttctgcgaaagcgacgtctcgtagcccgtaggagtggtttctaaattgtaacctcggtccaactgggtaaatacttctcctgaactgtagtacgctgctcctgtccgtgttgcccgtgacgcttgccgtattacccttgcctaaaaacagtcccgtggctgggctcgtgggcgctgccagagcaaggctggaaattttcctcgttctcagcaagcaggcagacaaaatttccaccgggtagacatctagacatgacgttgtattaacagttctctcggagagccaagaaaaggttgctgaataatcacaagccatgcatatctacctgcattctgaaactgctaataatgaagtaacgattgccgttgaagcagagatgttagtgcgttgcattcgctaatttgttcacttactgacattgcatgatatgttgctttgtgttgttgtagaccggcgggccgagctactccgtggagctcggacggctggacggcaagacgttcaacagagccattgtcaagcacgtcctgcccggccctggcttcaatctggatcagctcaactccttgttcgccagcaatggcctaacgcagaccgacatgattgcgctttccggtaagcttcttccttcctgcctcaaaatttccattgacgtggagaaattttacatggttgatactagccgttctgaaaaagcatcaggttactgttttgtgaacgttgaggcgacaatagcatggttgccggttacccacagaaattaacaattcctcgttagggttgcattttttttattacaagtattagtagcaggttgatcgcagtgcaagcatctttttttcgtggcctctgcacttcacgtgagtgacatatcctctgtttgcaacagaagacaaagcagttcgctgttttatactggtttcatctgttcttttcgaaaacgaaaagaggctcgtttgtttttgtttgattataatgcaaagtagacaaaaaaacacaagcgtggagtagtagtacttgctttgcagggaatttcacatttagatgtaaaaaagaccggcagaaagcgatgaaatattctttgtagctactataaaaccgaagctgtttttaaaacacacgcatgtttctttcagaaaaaagaacaaagtgtactacggagtatttcctccattctaaattataagcattttcataatagtgctaagttaaacattttctattttgaccattaatagcaaaaataaaataaaatgataaatcatataaaattgatgttattagatttatcattaaacaaactatcgtaatatgtaagtctttttatttagatcatcttacttttatagatattattagttaaagtagcatatcaaagactatgtcaagattcaaaaatacttatattttaggatagattgaagtagtacattgtagaggatttttaaaagatttttctgttccttttgtgcgttccaatgggtgaaaaaattctaatgataatataagtttttcattaataatcatgtcaatgacaatgtttgtattttaatgagcggtttgttcttttataaacggtgtttttttcttgcgcgattttctcaaaccattcagaaatgacgcacttctttctaaaagtttttttagcatttttttgctttttatttacaacaaaaaccatatttttctccctttttttcattttcttttctcgtgtgttttttgccttttttttgacaattattttctcgcgcgttttttgcttgttttttcttcaaatgttcttttttttgcttttttccaatacatgagaatatattacggaataaaagccatgtagtaggtggcaaaaaaaaatcgatggatcctatccgactcaagcgtccatcgatttaacgttttttctgataattttcttagagtgatttttttaatagacgctgttttttttcttgcgcggttttctaaaaccattttttagaaatgtcgcgtttttctgacagttttttcctcgcatgttttttttaaaaaattaccaatgatggaaataatttttctcgcgtgtttttttattttttatggaagatggaaaacctttttagcgtatttttttgcgcttttttcttaccttttttctcacgcgtgtttttgaaccgtttttattttctcgtgcattttctctttttaaatagttagattatattagagatagagaagagatatatattgattagaaatcggactttgtttcgtcatttccattttatttctagtgtgcatttttttattttatacgaaccaactttttattttttatgaactattttttttgccactttcttaggggatcgaacgaacggacttgtcagatgttttttcggttttttcgcctttataggaatcaaactttttttccctttttaaagaaatcgaatctagtgttttttcaccactttttttttttgccttttataggaatcagatttttttttcgttcggatctatggtttttttcgccacttatgggaaacagaacttttgttgtttttctttttatgcaactttctgcttttgttatctctcttttattattatttttaacaaaaacgacctcaaataccttattgtaagattatagggactcaaatgtaaatataaaaattatagggactcaaatgcaaaagtacaaaccaaaaattaaaataatataaaaatggaatgctctcgacctgtagattccgtttttgtaaacagatcttcaatccgtcacatcattttgtttcaccaagatgtgagagatatcacggtataaattgaaaccgagaggagtggtggctggtatctcggacttaaaaggagtggtgacttttatttttcagggggatcggatctatagtcggactttttttttcgtttctgagagggaatcagataggagttggattttttttaatttttcgctaattttttttgttttgacgcacgaaggaaacatatcttttttttaagttgtagagatagagattttttttcgcccttttttttggcacggaatcggattatttttttcgtttttttgtcgctcttctttttcacggagaattttttcagcctttttttttttgcatggaatcggattattttttcgccccctttttttatcggacaactacggtttttttctcactcgtctggtttttttccggtttttttgtcgcagattgtttcttttcgcctttttttatcggatagttacggttttttcgtccggttttttctcactcgttcggtttttttgggcggttttttgacagacaatggaagcacctcttatttttttttaagtagtagtaggcatatttgattaatcttaaatacccttgctgggttggggcaagggaagaataaaaaagatcttagtactacatgagaactggggcgattttgtctgaatgtttttggtcctgtcagatcctaagcttagtttaaacaatctttgtgtctagatttggacacaagaggccctacccttgtgacaaaaccgaaaccaccacaaccactagcggtaacttttgaccgaaccagagccactcctgactctgcatatagtagtacagtaaaaaggttaaaacaactgtacaggcacagaccggaacaaacaatacttcctctacttactctgtttcacgatataaaactttctagcattactcatatttatttagatattaatgaatctaaatatatatatatatatatgtttagatttattaatatctatatgtatgtggttaatgctagaaagtcttatattgtgtaacggagggagtagttttttttctcactgaaatgattctgatattgacggtgcacacgcactgcaggggcgcacacgatcggggtgacgcactgcgacaagttcgtgcggcggatctacacgttcaagcagcggctggggtacaacccgccgatgaacctggacttcctgcggtcgatgcggcgggtgtgcccgatcaactacagcccgacggcgttcgcgatgctggacgtgtcgacgccgcgggcgttcgacaacgcctacttcaacaacctccgctacaacaagggcctcctcgcctccgaccagatcctcttcaccgaccgccgctcccgccccaccgtcaacctcttcgccgccaactccaccgccttcttcgacgccttcgtcgccgccatggccaagctcggcaggatcggcgtcaagaccggctccgacggcgagatccgccgcgtctgcaccgccgtcaactagcttgtttacgtagtacttgcatatcatcttctgctacttaaaaagtggagtacttagctgggtaggatggtgaaagaaaaacacgtagtagtagtactacgattaattaatttcggccgcagatgcagggtgttttttttcttttctttttatttttggtttctttttgttgtttatatgttttgtggtgggattttgtagccgattctttgagctgagacggaatggatgatagaatggtgctgatgggtgatgcattgttatgtccttgcctcctagtcttggtgttccagcttggtgtggtacacggtgatcgaccagaaaagcactcgtgacatctgagggtttggttttggtcttttggcagttgcagaagttgttgacatcgttctattgtacgcgaataccaccgaaaaagaacgttacatgtgatgtgagtggtattcaccgatggagagaatttggaattatcaatggatcaacgtacgtatagccatgctgcatatgctcacgctagatcgatggattcttctgcgagatgtcgtgatgggagatggaacacactagtagacgaaaggcatatgcaatgcaacagtacaaaacaggcccgtgccgacgggtcgaacatgttacatgtcacatgcgaaaggtacgggaacgtgccatgtccatgggttgggattgcatcgaaacatgacacgacatcagatacacccgcacggaataagttcacttcgtgaacctcaaaagtgatcaaaatctaatccgtgactctaaaccataaaactggatatctcgacccccaaactcttaaaaccggagcaatttgactccctgggcggtttttggatggcggttttgctgacgtgacgtctatgtggtggtattgactcggtcttctttccacatggcattgacgtggcgctcagttggcattagaaataaaaaaaaaagtgtgggacccatttgtcatccaccaaaagtgtaggtgggacccactaacacgtgaggcccacataaaatcatcctccccctctctatttctcttcccttcggcgagcggcggccgtgtgacggctgacgggggccagtggcggcggcagtggtgcgcgggatccgccaacggtggcggcgggagggcaaggcgggtgcaggcgtaggaggggaccctggtgacaatgtcgtcggcattgcggtagtcgtcggctttacgggcgtacgaggggcggtgggcgggcgaaatctcgggaggcgccgcctctcctccctctcttccggccctcgctcgccgccgtcgccgctccggccctcgcccgccaccaacgccgctccagcccttgtccgtcgttgccgccgcctcaccggcctcgcccgccactccagcgcagcaaagggggagaggaagggggagaggaagagagagagagaagggaaggaccggagatggacggagagcggcagaggcaggctcggccccttccaccccggcgacggcggcatcgagcgacgagttcccgacgatttctcttccccttcggcaggcggcggcgatggcagcggtaggcgcagctgccgccactccagctccagcccgtcgtcgtcgatggccgccgcatctaccgccctcgccagtcctcgcccgcccgctcgccgatggtcgccacatctaccaccctcgccggtcctcacccgcctgctcgccgatggtcgccgccgccgtccagcatgagcacgtcgatggccgctgcatctaccgcccttgtcgtctccgctgccgctctagctcccacccgacgatgccgccgccatccccattgccgctccggtggtgaagagaggctaggggagagaatgagagaagggagatagagggaggaggaaggggatgagagaggatgacatgtgggatccacatgtcagtgggtccccatgtcagtgagccccgcatgtcatcctctgtgtgaatgataaatgaattatttttttaaattctaatgccacctaagtgccacgtcaacgtcacgtgtaaaggatacccggtcaataccgccacgtagatgccatgtcagcaaaaccgccatccaaaaccgttcaggtagtcaaattgcaccagttttaagagtttgagggtcaagatatctagttttgtggtttagggtcacggattatatttcgatcacttttgagggtcacgaggtgaacttattcccacccgcacctatcgcaaaaattcacagctcacatgccgagaccgtgggccgtggaggttctcgtctacaggctgtttgggccgcgggaaaacggacggtgcaatgtaactctcaaaaggcccaatttgagcttaggccatgtgtggcaggccacactacggcccagaaaacggcgttgttgcaggtagcgcgaggttcacaatcaaaacaatgatgaaaacgtgagcggttagtaaagataccaattaatcaccgacgtgagtacgtccgtgtatggtactgtacgtgacgatcccatgcacgaaatccctccacggattatacggcggcgagcccgatcgatccgcccccacccacccacgcaacgtccgtatctgcgcgcgtacgtaccgcctcctctccgcccggccacctacccggccgccgcgcagcgcgcgcgttggcttctcgccaagaacggattctggctgcggaaatacggattctcacgcggccgggtcgcggacgaggacgaggggacgtcgtcccgcgcgcgcggagtgcggccgcccgcggttgcgtccttcggaaacacaccacatcagcatgcataccgatcggcagaaatacgccgcgcatatgtacgtacgtgcgacgccgcctgcaggaggcgatcggcgcctcggtggcgggcggagttagtactgaaggccgtgtacactactgagcttctgatatgggaagcttctttcaaattaatctccagctctcccccaaatagtttagatcaccacttaggattgtgagaatatatagttttagaattcagaaaataaaaggatagaagatggggaaccatcttttttctgattttcactagttaattacttagaagttagaacagctgattcttacactctcactctcctcgatcacctggcctaagtttcttaagaagcatgaatgtgcaatcaattggcctaatttatatcggctaatcgatcaattaaccgatcgatcttgcgtacgtacggccatcgactttcttgatttctttccttcgcaaagcgtgaactagtattggattctagctagctagctactccatccgtcccaaaaaaaaaagacaaaccctgagtttccgtgttcaacgtttgactatccgtcttatataaatttttttataattagtattttaattgttgttagatgataaaacatgattaatactttatgtgtgacttgtctttttaattttttttaatattttttttaaataagacggacggtcaaatgttggacacgaaaacccagggtttatcttttttttttgggacggagagagtagctactacatgcatgatcatgccagctgtgtaccaaacagccgcaggttgggcggcctctttctgtgaaaatattgcatatttgcatgagcatgacaattaccgaccagacagcacccaacatgtccttcaattcaagtatagatagcttcagatcgaggctaaaccttgcctagctaagctctcacatgaaccaaccatgcattacagtgccttgcagagagctgcatatgctagctaaattgcaaacgcaagctacgtacgtacctgtacaaataactgcaacaccacgtacgctcctctaataattaatggtgccaaatgaatctgctagtaccagaatataaggtacaacatacataataggggtcttactgttgatctggcattcatatgcctagctctcgttgcactacttcataaatgaggccaagctagctgatcgatcatgcattaagcctcctggggttagttgtgtgcataagtcaactttcaacaaccgggtgcccgtaaccaaattagcttcgtcatcgatcctttgtaagttccacggttaggttgatgagccaaaacaatagccaattaatatgtaggttctaccttttcctaaaaaaagaaacagatgcagttggtaagttatatagagtgaataagaaaccggccgcacgagctgcttatatgcatttgtagctgcagatgggtcttaagttttaagtgcatcttagatgtagatgtcggggatgtatattctatcttccaaactctcaataattaagtacatattcacacaaaaattgacaaaatacatcaatgcgtttgataaaaggcaattatttatctagagaatatcaatttcactaattattttttaaaaaacacaaacgcctgcccctttaaatgcacacacgtataccatatccgtataaacaccttgaaatactaagtcatcatatcctaacattgacaaagtcactatagctgtctcattggcgatgcatacattgcctacaacttaaaaataattaaccataagtacgagcaccactgttaaatttaggatttaatcccgttgtatttatatccgaacataatatttgttctgttacccaaaacaaatatatagtacagcttaattagttgttttctaaaagcaagtacgagtaactatgtacgaaggacaaataaaaagggccatttcccccctaccctaattgcattttataattccgtttttggatgaaatggttgcatgcaacttaataaataatgttggaatggatgccggacaatgtcaattaaatagtaacgagcaaaggatatgcagtgctagatgcgctgtgtagctgacgctacctcatgaagtcatgatgcgtcaatgatcaagttttaagataagttacagtaccaggtctatcgttagtttacatagatgtatcatcataaatagtagctatggatgacgtcaaagagagcatgggcatatgcatgcatgtaccctggatcaatatttccatctatgtacatatatgaacgaccttagccgaggataattgatttgctagcagttacatgatcaaaaaatcctgatcaaaggatttattgttttgaacccgtgatataaaaacaacaatttaattgttgggagacaatattgcacttaaaactcatgtgcaatttaccttagagaaagtaaaggaaacacaatatcattaattatcgagtaaatttcagaaaactcatgtttaagagtcaagttacataaagcccttgatattatgactggtggctcataactccagtcgctaggtaaatggttttaaagtttcacaaaacctcactcctatacatgttgagcacaaactcaattacttgaatttctaaaaagtagtgaagagtaaaactatcagtataacttcatatgaaatttttagttattaagtttttactaaagctgatagttttactcttcacaacttttattttaaaaaaagaaaatccaaatatgctgaaattaatcaaattatgaatgacggcgggtttatgaaacatttaaaccacaaaaccctatggttaaatgccaaaagtcataacacctgtggtattttacaattttgactataaaacgtggggcttttaaaacctcactccttttacatgtcgttgtaaatactaaattggaaagttttgtgcagaactggctagctttaggacatgtcgtagtcaatcctcgagtacaagtaagttcaaatagaaattcgaatttcctctaacaaagaacaaattcaatttaattcccgtatagtagcagttagaactaggaactttagccgatggtttggtgtaaatttaactggactatttctattatattgcttgtggttatttttttccattgggggatgtactggaaacatatgttgataataatcaattgtcgtaaattgatatgcataaccggata

SEQ ID NO: 23104 - DNA, 8935 bp, Oryza sativa
ctcaaacttcaaaaaatggcatatcaaactgtccccaccagtttcaacgaatagaaaacaatgcaatattctcacatgagttgtaggtacaaagaaagggcacaataatgaccatttcaaactgtcagttatatttaccccaaagaacacaagaagtccatctcatcttccaaagaaggaaacgggccgttgttttgggtgccatttcgaccattacgaagattaattttggctgcttcaactgctccagccaatcaaccatgcacattacagtggtactaagagcaagtttaatagtatagtccactactagctccaaattatctatagccaatgtaatagtcaattcatacaatatttgcttactacactattaatacatggtcccacctgtcatacacacattatgtttgtccgtgctgcagctgactacagatctgtagcccgctgcttttctctcttttcttttatctgcttaaaatatgtttatatctggtttatagcatgctattgtacctactctaagtagtatactccattccaaaaaccaaaaaaatataaaatacattgcacagaaatccgctcaagaaggcatgtagtaccatcaccgtactcacattgatgtactctcaatatccatctggctgttcctgacaagataatctttgtaagcatatggtacggacttaaggatttcccaaaaaatatatatattcctctctatccgtgacctaacaataacacagcaagagacacctagctaaatccaagccctgaagcatccctcgattgctccatccagaccgccgagatggctacaaatttcgagagatttttttgaattttttcctcggatggaaaaaaccagccgaatcttccccgtttttgtacggcctcgcacgcgtatggaacggaattttgtcgtgaataaccgtgaggataaggtgaatgaacgggggtgtgcgatagaagggaagaagggtcgctttttttagatctcaagttgcattcatcgccgaccctgttctgtcctgaattattgtccacaaaagattttactaatttgcatgccaaggagactttctcttctatctgcccctatataagttttttttattttatgtatttttcatataaaaaaagtggatgctgctagcagctaggtgatgcttccgtcacctgcaaattgctcgttgaaaccggctttattcaagtgaattatttgcccattatgtgcaggggattagaataatgctaggggatggtagtacaacgcttggtcggctcttacctctttgagagcagcagggttcagtttgacacttgcaattttatatgtaaacccccaagaaaaaaaggtttagtggaacagatgggaaatagctgaactgaggcagctaggcctgcactggaacatccctgatgaactatttaatttcttttaaatccagcaactacacagatacaatcatgtcttgtagataatacttctatcgaacggtacgcaggtgccatttgggcgaaaataagatagtacttctagagccggccattgtaaattgaacaggaacaacaaatttagcgttagttcatattaaagccaaattttatcacatggatactttgtaagagcgagtttaatagtatagcccactattagctccaattcatctctggccaatctaatagtcaattcgtcatataataattgcttactatactattagtatatggctccacccatcatacatacattttgtcttagattccgtactgcagctgactacatatatgtagcccgtagctcttatctctcatattttattttattaaaatatgtttgtagctggataatagtctgctattatacctgctctaagtcttaaaatatttcgatttagtcttctacagatatgagtgtacgcgcgtgtttatatgggtaggtgtacgttcatactgtgtttgtaatttaatccaccatcgagatcagctagcttcgttcgtccgtgagccgcacgatccacatccatcggacggtccagcttgtaaaatgaatctcactactctactcactccaggcacaacacggacggttccccacggagttaaaaaaccacacacacactgtacacacccaaagcccgaaaacccgttatctctcccgtgatgcggcgtggggcccaccaccacacaccaccccaagtggctgacatccacagctccgtgggcccgggtcccacagcctccctttcccctccccctccaagagtcaaatctccacctcccccctacgcccacggcccaccgacacgtgggccccacgacccagccagccagagtcccagaagttaacgggggcacgcgaacagagaggggggccccgcgcggcgaggtggggcccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggtgagaaaatcactcgccgccaccagctacctactacttcttcttcctcgcttcctccctctcgcgtgttgggttgcttaggctttagctctagctttagttcttaccatttttgactggcgatagaaatagtctgagaattgaaaattaatgataccggctagctggagctgagtagatttctgatacgcttaataaatgaaaaggaaaattttccatgtaaagatgagcacggatcgttcgtcgtcggcggcggccttcacgtcacgctctctttctcaacgcggcttttcataacagaaggggccagttgtccatggccgcctgccatgttcttctcttattcttcttctctctcaccctgttcgctcctctgtactgttttgctgctgttcctctcaccatcatcaatttgttcatctgtctccggctcctccttttttttggttgaaatgaaactttttgaaagatcctgctcacatgcgtgtttaatctgtcatgtaggagtacactataccactatggtcacttctccaccaaactatagtataaaaaaaattgaatctcagatctacgcgtaattaaatgcccacctccagttattagtattactcttgcctctactttcctttttttttagttcttcatttatacaaagaagcagtgaacaaatatactcaaatagttcttcagcttcgcaagtactcctactccataaaactatttttcagcttcacacgtaaaattaaaattattcatgagcttcatacgaatttgcatgtacgtaaagtcaaaagtcacttgagcacgggcgcgagctaatcacgcagcggagattagtggctaaccaccataaaggcaagctaaacacacagtggaatccgtgcgtgcctagctgagctgcggccttttttttggtttgctttgttttttttttgttcttttttgttgaccaagcggacagcccaatccaagagcacaacgtataccagccgctgctcgctttatcttttttttaaaaaaaataaaaatagattaaaaatcagtttaattttgggctggttttgttcccttcggctcacgcgacgagaaaacgaaaccgcatcttcccggcacgcatctcaaggacgacacgaggggggccacgggaagtacgcgcgcctcctctgactgccgctgagccgtctgatctccatctgacggccgtactttctccaatcattggccgggcactgcaacccccctgttgccccttggactcttcctcctccgtgtgttcctagtagatcctgaccgcttggctggtaggcgctgacggcgtgggcccacacgcaccacctgggagatattttatctgtcaatgacaggtcgggcccatccaccaatagtaatagttttttgataaggctgtaaattgttcaacacgcgaatctaattataggtcgaataacgagatagtgataattaaggatttatcgctgtactcgcatatcatagacccgactgataaattcttaattgtcacgtcttactcgaataactgggtaacccgagttcttatttctcactctgttgttgctgactagtgtggttgtggcttttgttgttgttgcaggagaacataccgatcgaggaggtgttcgagcagctgaaatgtacgcgcgaggggctctcctccgaggaggggaaccggcgtatcgagatgttcggccccaacaagctcgaggagaagaaggtgcgtgctatgctttgtcaaagccttttgcattctcttgttgcgtgtggttttctttcatttctgacgcgaatcgctcatctttgttgcgtctttttgtttgtgtgcttgtgcaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgagctcaagaaacactggataggagtactaactaatgcactttgaactggaaaccgaccttaattattccgttgtaccacacaaggctttgatttttgtattgactagttgtcataatagtattatacagtagtggaaggaagaatctctatgtgcgtacttttcggacgggcactttcaattagagtgcctagaaactgagctctgaattgtccagtggatgggtgggcatatattccattattgcaagaaaataaagatagggacccacctcttggacagtactgttcatttggcgtaaataatagcctaggtgttctgcaattgcggctaatttggatattgttagcaaaacaacgtggtctaatttttctgctctggagctggaagtcaagtttctgtctttcatacgtatgatagattgataggtctatgatatcaggaagtatcctcttggacatgaattatttcaccatcacaattctttaactgctacggagctcatcctcagttagctagtcgtccctttcattgtatttttatttaataggataaggggagaaaaatgtggcagcgcacgcacgcacatcgttgtcacgtggaatttttcttttttcgtgcaacttgtcaactcaaatcagccgaaatgaaatgtgttaggtactaggatgtggtcatgtagcagttggcactttggaataagttgcaataatagtgaacactgattacgtaatcttgaatttttcttttaaccaaacttgtttgcttattccaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcaggtgagaaagattgacccttgtttcacttttttttttttgctaatttctttacttataatacgtgactgacatttttttggttgaaatttggacagatcctgaccctgtgcaactgcaaggaggatgtaaagaggaaggtgcatgctgtgattgacaagtatgctgagcgtgggcttcgttctcttgctgttgcaagacaggtatgatggctgccttactgaatgatctatcacctttttagtgattagggaaccatattctcataccaatatgatgtcgcaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtatgtacaaatattataaaaacagaaagcagtataatagaattttgcaagagctaatggttggattttaatgtacatcaggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctggtatggcttggatcgatgcagacttacctgcttgtttgctttcaatgtttgcattcctcaatgtgtttcttgttatgcagagcacaaatatgagatcgtgaagaggttgcaagagaagaagcacatcgtccgtatgacccgagatggtgtaaatgatgcccctgctcttaagaaggccgacattggtattgctggtgctgatgcttcaaatgctgcaagaaatgctttcgacattgtgctcactgagccaggtcttagtgtcattatcagcgctgtcctcactagcagatgcatcttccagaggatgaagaactataccgtaagttcttcctttgcaaataacttgtgttctctgtaaaacatatgatcacatcgcattctaactttgtattattttgtctcgtgtacatcagatttatgcagtttccatcaccatccgtatagtggtaagtaccatttcgtacataaaagatggaatataagctcttttctcgattttccaaactctaatatcaattttattttccagcttggatttttgcttattgctctgatctggaaatacgacttctcacccttcatggtccttatcattgccatcctgaatgacggtatgcattcctattgcccagataaattactgataactattccctccatgtacattcctagtgtaaggatcagttctcacgcaatatttttgcaggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggtatgctctcaccttaccctatctgtagtctgtccactacacttctctctcattatgtatgcttttgcgtgaagttttgttctcactaaagtgcttttgttcaggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggtatgtacaagacagtaactactcaacaatcgagctacgtcataacaacgtcacggcaaatcatgcctaatcctaaccttactgtttctgtaggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaaggtacatatccagatctttcagttgtcagaaatgtacatatatggttgtctgctccattttttgtttcagctggctgatgatccgaaccttgtatttgcagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggtacattgctcacttccaacactgataaaatccatcaagtgcctaaccacttatgttaattaattaattactactacatcaatgagaaaatgttgctgaaaactaaaacacttgttctggatcataatctttcaggctgagagagctgaacactc

SEQ ID NO: 23105 - DNA, 5885 bp, Oryza sativa
  unsure (1)..(5885): unsure at all n locations
aaaattttctgccacgttaattctcactttggcaaatgggtctgcttcaattacttcttaattactctgcaatgccttcctctcgtgaatgaatactgactgatcaattggtgtgttgcgagtttgtgtattctacttccttcatacacaatcatattgtttttccgttgtttcacaatacaagatcgtgtattgtgttttatattttaagacggaagtaaaactaagattcgaatcctaaacctaatgtgtttcttgtggtgcatgctcactaactcaaaagaattagcctcctttggtttggaagttctaaagaaattttgcatgaattgaactaattcatgtgaaaatcctgtacaatcttacgttccaaaggaacctaatataacttatctctttccctattgttttctttttttttctctgtcctaaaaagaaacactattacaattctagcaacgaccttatgaaattagtactcctataaaattaattggttgctcggattacaagtactccccaccttactagtactatactctctataagctactccctccatcttataatatactacgtctagtaccagattgaatatattctagtattataaatttaaacatgagacatgtccaaatttgtaatataggctatccagattcatagtattaggatgtgtctcatccaaaactaggttgctattttatagggacggagggagtagcattgcactcggcatggcaaattttaatgctagaaatgcaattttttgtacacaaaggtagtatcgaatacacaaggaatttgaagaaaccctgtagcacagctccagctgagaacataatgtgaatatgaaaaatagtaaatagttaggtgttaatagaaaccgactaccctattgttaggcttatgcttataaaccaaaattattttttgaaatctaattttaaagttgatgttgtgattttttttatcatagtttattttgtagtacttatttttgaattgctaaggatacaaatataaaatttttatttataaattattttttatttattaataagccatacgaataagtataagtgaaataataggctctgaatagggggatattaactggctaggtgttatatgttcaagccacaaataaagcggcatccacatgggttgtaaaggagaagcttcattggtgtagtatacaataagcaaagatgccttgaggtgcatcaattatattggaggagattctacactccaagactcgtcaattatattgggaggattctgcactgcagactcggacaatacctactccgtagtcctaaccatgtggaggagatgaggcgaatacagtacgctggctataaaaatcggaaaaagaaatatgcctagcactcactggtcactactgctatatctttcctgtggaaaaaagggtagccgaccgaaccgtctgcagatgtagccaatacccaccacagatgagcataagccagagaacggaatctctatcgttttatcattatcatcatcgtgtactactccataaaagaagatatagtggaattcggttcgtacttcgcctacaattccccttcaaaaaaatcgccacccttttttcctttccacaacccaaagaaagatgctccatgttgttggcagtgcgtccgtacgccaagccggcgccggctgaggcctcaccatttcgtttacaaccaaattttaaattttaaatttaaagctgattttaagaggcttttaaagttttagcttttgattttaagtcgctaagaacaagtatatgaaagttttattcataaattatttttcgtttgtaaatataccactttgtttatttaggcaaataaacgaaacgatggttccgtgaaacgccgcatccacccacccatccgagcagaggatttagcgctgcaattcccagcaaaacaccgcggcgacgaggcggggtgcgtgtggcgcgtcccgtcacgttgccatcccgcccgcgacccatccaaccgacacgcattttgctccgcctccgcgccacccatagtgcgcgtcgccgcttgcccttgggtcccgtcccgatctccgccactgccacgagaaggagaaaaaaaagcggccgattctcgcgctgttcccgcatgcagccgcggacgtcccgtacgtcatccgctgctccaaatcaaaccggcggccgcacgcgcttgtctgatgtcccttcccttccccgtaaaaatcaccacgcatcacgcggaagatagatatatggattggcagcaagattgttccctttccttcgcgttttatgcagcgagccgagcgatcgctctccgtcgctcgccgctacggcagaaaacggcgaccggtgcttccatcgatcgatcggctctcccgtcactgcacgcacgcctaaatctcacagtatcaccgatcgactgactttacaggttcgcgtcgttttccgggggtcctggaacgtgtttagcagctacggtgacagttacggcgcccaagtgtcgtttgctcctggaacatccggtgaaattaaaatcaacaaacccaaacagtatcagcagtactagtaactgtgctactatagtgctaaaagtgatggtttaggaattgtttactggagctcgtgagccagccaaccagctcgaccgtgcaccttttctctgcaaaagcgtcgtcgttgttgttgttgtcatggacggcctaaatgcgtgatacgatttagcattattacgatccagactgatttggttggggtgttggcctctcgctagggatgcacgaagtgactggatgagcttaaaagaggcgacagcaagagcccggtccgtgcacaagataagattcagttcaattggcatctgttattctccttttttttttcttctctgcatgagcagccaaaagccctgaaagttgtgtggctctactaatcagtgtaggataggacggctaatttgcctaattcgctagctgctgattactaattccatggaaaaagttgtgtagtactagtgctactacagcatcagcaacgctgtcagattggttgattggtcccttcaccaaagtgcagggaaggaggacagggacatgtccagatcaggctgcgaagaacaaatgaattagaaccgctgactcagcatcggcgaacgttgggacggcgactttgttagttaaaaccggcaccagtttggacagtcactagtagtactactcggcacagagtttaccagagtaatttgcggttgaacttagtactcctactaattaagatggtttgattatcttcatgatcacagtttgaagccgtcggagataaacaaatcccgagacggtgaccacatcagaaaattttcgcctttcctttcattttcctccctccgtactgttcgactattttgtgttttttgggtccaaattcccttttttttcaggttatttaattttaaattttgattactatttttttacttttatttttttgcttactaaacgttttggttttcctgttttgatcaagtactttcatccttttgttttttttatgcctgtaccagtttttttccttttgatttgtcagttctccttttgattcttgaaaggagagtgagagcaaatatggaaatgaaaaacggggctagtaaggaggcctggggtcagattttcaacgtggccttataagccattgccaaagtttaaaattttaaatagttaatttggggtgtttttgctgtaatttattttttagcactgacaaatcgttaaggacatagatatgaaagtttgtcatatttttatttcttcgataagccttcagggcagcatgaaaatgttcctagttgcaactcaagcttcagggggaagaaaaagtctgcaataattctcagaattcatggtgggctggacatggacatcagacagcctactttcaggtgagcagttgaaatgggctactttgagttaggccaatatagcccaattacatcgcttcgcctctctgtagctcatcggcttgtaggctggatgggcggaaaaaggcaatgnacacctcctgtcctgtatctcgattttttttttcatttttaaatttttattttttaatatttacaggaatataatactggcgaaaatatttacaaaaatagaccctggagggcggcagggtgatgtgtgtgaccaggcgctggaggccgttgagcggtcatgcaaattttgcatgcggcgaaaattgcatttcacccccttacggatctcagcacaaaatgcgcacacggcgccgtgtgctacgtcaccttgctgccctccacttgagcggtagggtctatttctgtaaatattttcgctggtataatatttctgtaaatattaaaaaataaaaatttaatatctcctcctctccagactccagagaaagaaaacgtctgcacatctttccctggctttgtacgcatgcatccatttcataccgttcgatgcagaaactgtaactccttttggagtctagcttgtacagacagttaaaagttgttagatgaaatcctcatcgacgttctcatctgccggctagtacgtagatcgatgatgatatcctccgaccgacgcaaggatgtttccaatcataaatgccgcagagacacatgtttgctgcagtgcattgccatgctgccatccaatgaactctggcatatatactgctcccttttgctgtggcaaagcaagcaggatatatcgatcagggtttcctctcataaatgggcaggagactagatccaagaaagaagctagctagcatgggcatcaaactattcatgggccggccaggagctgaagcccattattatatctatccagcttttcaccaagaactagcccacctctacagtctgcactatacatgcagacatgcagtttgtgtatactatcttctctctctcattggttatcactctaagacagttatgttacacagtgaacacaactagctaggtagatatattgatctgtttaattagtgtgggagatgtcggtgtcagctagcagtagaatatcacacaatccttctttttgttaatcgatcgtcacgtcatattcgatcttgtatacgtcaattaatagtatgatgtatatatgtgtgtatcctttcaaaaagaccaaaaaggttcgaggatctctgcgtgcaccatgcatgcaccttacgtaccacagctcttggaaacgaggttctatcagctacagattttattaaaaaaaaaacaagtctaggcacaatgattgagatcacttattggatggacaatatgtcaatatatacacatgaaaattgcctggaacaaacgaattaagataagccagcaagctagcatgccagcgatcccccatccaataaggttttagattctcgatcgaacagtgcgcatgtacttactctattatattgcaaaataagtttgagtttcagaatttaaaatttatttttaaattaattaatttctactctcttacctacgccctttatatatgaatcgagaagttttatcccttcaatatcccttaccttctaccaactaaatatactacttttgcattaattaaatgatatcctttttttctacaagatatcgtaacttcgcggctttagttgtagaacaccacaaaaagtgacttttggaaaatacactctcaaaatatgaaaatttactgttggacactgtactcatcaggatattcatttctggttcaacaggagaaagaaaccgcgtgaaagttctgaaataccccacttgacccacatgtcagatctccatcactttctctctcgatgcctcgatgatcgctagcagagccacctccatctgcgagct

SEQ ID NO: 23106 - DNA, 4514 bp, Oryza sativa
gtgcgtgttttgcagcgagattttgcgttgggggtagctttgtcctggcatgcatgaaagcaaccactcgggtcgacgagacttgctactgttgggaggcttgcattgcatgcatgtgcgatgggacgcggcttttgtgtgtctctctgcgtgggctccatcgtcaccgcccccggccccagcagtggcagagaagggcgtacgtacgctgctgctgggtctgggtgtgtgtgcagggatggtttgccacgatcgtgcaaccccgcagccagcccagcgcagctacgtgcatgcatgcgtcgttgcatctcatgcgtcgtcgtctgcttcttccttggttcgatcgatagctccgatcctataattaattgcagcattttaattttgatgtatatatcagcgtccaatctacatatgtatggattgttaatttcctgtctacaacttaacgactagcaactatatatatatatatatatatatatatatatatatatatataacaaattgagacagtctcagcatgtgtgtacgtccacgtacatgcatttgattaagacgtcgacctcacataaaagtccatctcacagatatatatatgccgaggatctagctagttagtaactacgagcactacattattcatgatatttaagagccaatggcatgtcatatgtgtgtgtagctactatcttggtacacgacagctaaagatcttgacatttggtagctaaggtggtactacgcattcatgtccaattgtaagctgattcactcatcatctttgatccggcccatggatcccaatcaccaacgttttataacacttttttaagtactagaaaccgagaattatcaagaaaaaaaaacccctactggcctactccgcatatctaagatcatttgggagtcgactatttatgtttagtacattttgagttaattaattaagctcgttgaattgactcgactaaactttctattaattgtttatgcctgtatcccaaataaaagaagacaatctctatatgtttcatattatttatcatcctagcatttattttttttaatcaaaatatttttcattcttgcattccaagtttccaacataattttagaggtgaacttcccctctctacccttcacgaatgcagtcacaactcttattagcttatttgctttggaaaaactaatgggatgtacttataatgagagtaacaatgtaaactaccatatatcaattggtttgtgtgaggtttgctagaatgataagtactccgtccgtcactaaaagagcgtagttttagcgagtccactactgaaaaactgatctctgctcagtcgccctaaaaccacaatagtcccggttataaaaagaaccgggactaaagatgatttttagtcccagtttaaaaccccatagccattctacgatctttagttccgattggtaataccaaccggaactaaagatcatcccatgtcagtcccttattagaggggcagggatctttagttccggttggtgtcacaaaccgggactaaagatcacactttagtcccggttggtattattaaccgggactaaagatctcctatatctcacgcgtagtatataatccctattccctattctctcccccacaaccggcctcaatctcctcaacaaccgacctctcctctcctcagatccatcgccctctcctcctcccctcctccccttcctcctcccatcccgaccctctcctccccctcctcccttcccgcacgtgtcaggcggggccctgcccggcggggccgcacgcaggccgcgcacgggccgagtagcgagcggcagcaggcggcgctaccggcatccattctttttttctttttttataatttgtgattcactgagatgtataattttgtgatttgttgtatggatctgatatgtataatatgtgatgtatttggtttgtgtgtaatctttttaagatttgtgatgtatttgatttgtgtgtacaagtaacttaagatttgtgatgtgaatgttttgggatgttactttgatttggggtttgatttgggaatatgcatcccactcgatttgggagaaaatacagggattaactctggctaaaaaataacgaaaaaaaagaaagaaaaggagacctaatgggactgccgctacccgctctttagtccctgttggtaacaccaaccgggaataaagataggtatctttagtcccggttatttcacccgggactaaagatagcgatctttagtcccggattcgtagtcccggttggataaccgggactaaaggggggttacgaaccgggagtacaaagggtttctccactagtggtcaaaaaaagattaagcaagagatataaaagactactatgtcgtttattaatgctgagagaaaggccctgtttagatttcaacttttttctttaaacttctaatttttccgtcacatcgaacttttctacacaaacaaacttttaactttttcgtcatattgtttcaatttcttcaaactactaattttgatgtggaattaaacacagccaaagtaagaagggaaaaaacaaagaggaggagggagtaacgacaagaaaaaaaaataaagtactgaagtattaagaggtttactggacccactttaaagatatggacagagagtaaatgagtaggagtataattcagtagttttcatatatgggattatgggttgcctccaagtcgaacccaaataagatggactaattggataattacccatctgtagtaggaggctggtgattaattcacaacttatgtcttgttgacttgtggatcctccagctctagattgaagcttattgccatggcgcaatgaatgaaagggggtttgagcaccgagcccccagtaggtccggcactgttgttcatttctgatgaacatatgaatggattaattatgcgtacgctttctaaacttttgaacatatgatttttaagaaaattatatatatatatatatatatatttaaattcatttttttaattttataatagataattcattcattgttcatttaaataattatcacacattattcaccagccattcaacataaaagaacagggaagaagaagcaactatatggattgtgtccccctgatgataatagatactatgtactctctagcccgatatttaattataaagggggtgatctataggtgcaaatgaagatggtgacctggtatgatcaatgtggacaagtgggacataatcataaaaaggagtccagatactgaccaatgcaaatgctgcgtcagagattgtgatagatggagggccagatcgagtcatgaccgggctgtgcatgctactagctattactcaaggagtactgatccagtagtactacatgggaaggaattaggaataacaggcagcataaggcctcaatgacatgaaaatcttgtatgatgtattaatttgggtgtaagatcactgatcacaatgacctgttaaagttaaacacctatttctctgaaagtttctcgaaaacgtgtggggttgctgcatataaatccaccactgtctcgtcctgctctgctcactttcaggacgtgtccttggtgatcaaaatttcaacaatatatctacatattgcccatatcaccatctgcatgattgaaaccttggtaaattttaattttacttgtgttcagttgatcagttcacatgtgtctgtaccagtgaaatggagtaaaagagtgacagtacccggccgatcgatatgatatgatcgagccgctcgcggtcccctacatatcgatctatctatctatctatcgcacaaaagctgccgaaaattgaaacaattattgggatgataggaccagcaatgtaagctgcatcagaggcgagattgatcggttgatcagagggcgatatgtttgcgccgattgattcgagattttgtggacttcaagggggttttcctgtgctgtgctgccttttcgctcattcgaatcagagcagctgcaacgcatgcatgcgcttctgaaacctgcaaacgcctgaccctcaatgctcaatgcaactttgagtatattatcgtgcacgtggacggcacagcgatcccaatcaggttttggtggatagagtttgtctcattcgatccaatttatggctctgtaaatgctgtttttgcagagaaaaattcagttcattgttttccctgaatcacttaattaattaatctcgtagaggtatattggaaaaaaaacaaagaaaaaaaaggtaggagatcgatcaagaaggatgggcggcgaaaggtcagatttattcggatttaattcgttttgaaaattgtgcaagaccggcttgaaaaacaactctcagctacaaggaaaatcttcacgtcctttaacacttattgaaatcaatatgttttgacaagttatgtaagtgagaaatcgattaatcaatgcgatgttgtacatcatgtggaagaaattgccct

SEQ ID NO: 23107 - DNA, 8882 bp, Oryza sativa
atatattaacctatcttataaatatttttaaaattttttcataattatttaggcggcatgcaagaaacgggtggacgtccacccgagagattagaatccatctccgggatcatgtctcttttggaaagatagatggtgagcagattcgactgaaattgttatggatttttcaatagtttgacgaatagcaagggatgtaatacaacgtacaatttactatacgtggggggaaccggggcccgtttcttgcatgcaaaagctagggaccgccccctgatgatcaacaaatttctgttgtgatataacccggcctccaataatttccagtgaaaattattctttctcttgcattaattgtgtagcttgtttttccttctgccactagccaaacttcctgttgctataaatgagcgtatattaggtcacgcaggaccaccgttacttatagctaagccagagatcgtatatctcattatactgtaccactataccatatgcatgcttgcctgtttgtccatatggggtatatatcaggtagatctccatgactgcgaaacacgaatatatcgatttccatgactgcgaaattaacaattggaaaatatatatatacatgtgtgtgtgactgattaattcagccatgcatgtatagtgatacagatacagggtctcatcgtttaccctatggcttataagccaaaaccaaaaattaaattttaatacttgattttaaatttgattttgattccttttcaatatagtttttttttcaactttagcttttcaatcactaaaaacatatatacaaaagttttacttacatattattttttaatcgctactccctccgtcccaaaatgtagctatttctagcatagtgtcttgtcccaaaatgaagctatttcttcacctacctcctctcaaccaatcacaaccatttttcttcacctactttttcttttcaaccaatcacacacttcctccaatcattctcacttactttcttaatacccgtgccaacctcaaaaatggtttcattttgggacggaggaagtatgtattaagctgttatggtttataataaaactagaccagccgatgaggaccacagccaattaataaccgtttcgttgcttgctgatcatgtccgtgcacgcgagacgacgacggcggccggccgggcattccaccggccggccggcgcgtacgtacgtctcgagccgacgagaggcgacgaccgatcgatcgggcgcgcgactgcgcgtacacatgcctgcgcgcgcgcgtgcgtgtcgtctcccgtctccccaaccggccggcgtgtcgcgtcgcgcgcgcgcggcgacccgtccgggcgccggccggcgccgtgcagcgagtgagcaaacctcgccgccgagatcacgcgcgcgcgccgtgtcctcgccgccgcgcccgtacgcgttcgcgcacgccccgatcgaacgggaagcaaaaaataatataataatactgtaatacttggtcttttctcctcgtcgattttaatcggtcgtaagttaattgggtacgtacgatcttaagaattaattgcgacacgcatacatgtagttgacgggttagaatttaaggatgcggtacatatatatatgtgctgtacagggcagtgaggtaaaaagggagcagtacgtggtaattaaccaacttggccggaaaaattacttcgtgatgagggcctaattagagtaagtttgatagtatagcccactactagctccaatttatctatagccaatctaatagccaattcatatatacaataattgcttactgtactattagtatatggtctcacctgtcatacacatattatgtcttagagtccatactgtagctagctacagatctatagtccgctgctcttctctcttatcttttatctcattaaaatgtgtttgtagctagctaatagtctgctattgtatatgagtaggggcatggaatatgtgagccagcgagagtagccggtcgggaccagcaatgattccgtcgatcgagattgtaactgtttccaactcggcaagaaataatacggcacttatgaacaattcggtttttaaactccggtcaaaaagatgtaataaaaagaataaaaaacaaacgcccatgcatgggtacgccggaattcacttgactggatataatctatttttttctctttgtagaagttatatgttgagctgtaaatttgtagagccacagatagcgccgttatcaaagtttaaaatattttcaaattttattattgtttcatgagctttaaaatatcaatgtttaaatcaatcttaattaggtgcttctaacctaggtagagagagaaaattctaataaatgctagtaaggcataagttaatacatctatctacacccgaccaaattttagtggaaaaaacaacttatatagggaggagaaaaattagaaatactatcatggaataaataatattagtccagtgtaaaataagaaaaaaatagtttagggggttaaatgtattggtgaagtttaaaaatgtaaaatggacattttcttccaccaatttcattgggtcactcgttttaccttgggtgataggaggtgtaacatttaagctagtaattaagatatttgatatatctcgatcggtacctcttaattaagaccataaaatttttcatggctagaatgcttatttctccatggaatgcaattatgtattagtaatcttttttgaaaaacatagaaaaaaatatatgcttcatatttagtttacataaagtacaattataaacctagcttgagcttgcttaattaaatatgtaaatattgaagaactcgtggcaggttatcatgaagctagataaagcgcacacgccaatttctcctatttaaaatgaagtttgacttcattgtgaaattatagcgtctgcagatactctgtatatgttttttccctgttgtgtagtacaacttatgcaaaatgaaagacacgtgctgacgtgcatgtgagcacaccacaccgcttgcacaaactcacgtgttactagttaccacaaggtttttctctttactctgctgtctagttggggttgttttctctaagttaactgtgtctgttttttcaccttctatgtgtaaccccacgatcaggtcaactggttgtagttgtacaagtttttctttcttctgctaattaatatatcaatgtgtaaggtttcacacggtaataaaaaaacgtaacggccgatgttaaatttttaaccttactaaattttatcgtactaactatacggggttcactttatagggcccaagtatcaatgggtgatggcggtaaatctatcttaccgccaccaccataagaaacgtttaaaggtataaagattagaagagcacctatgcacgtaattgcaaccatgaagatttgattcttagtctatggatcattgaactcacctttgggcttcctttgttgtatgagaaattttatggtccttaaaaataatattttgaagtatttaaatttgaccttaaaaattttagtacctcgagatatctagtatctgaaggtatcaatttttatactagaaaatatgatgcctctcaatatcttcttagtgatagtaaaattctcagtaccttctcaataatagtaaaattacccttgttgtatattacagtttgatcataatttaaatatcattagattatttctagtctcttgaagaaagctataagaattataaaaaaacttaatcaaacaacacattaatatatgttagtttgaccaaatgacatgttaattggacaaggtttttgtgcttctttgggaagttgctctatccatcctaaaatataatagtctcaacctcttggtgtctgaagatacggtaaattattttttctgaaaaaaatacagtacatccaaagaaacaccaaaaaaaaaaacctcttgcgacagtgtttcctccaattttggtctgaattcagggcttaaaatccaattagccaagtcaattaattataacagaggtcgactagctagctagcatgtgaaggctgcacgcctaagcaattttggcagcactaaatgtttgcaagtgccttgacgcgcaaactttcgattaattgcccaaataatgacacgatatatactctctcatccatcgatcgatcgatcgatcgatcaactaattaattaatatttacagctagagatcgatcgagcaggaagcaaagacacacttaattgcatacccatctgtaaaaaggaattactagctagagccgtaatccgtagagccagcgcgagcgcgcatgacgggtaggcagtacacatgtacgtacacacgcgtccacctctttacgcaaatacagtagcagtcgctggatcatcatcaagattaattatcctttgtggaaatgggagggctcttgcgatgatctgggggacgatgtatcgatcgatgcgatgccacctcactccgatggagccaccaccagcaacagctgcagttagccatggatgatatgatccattggaagagtagctagctagctgctgctgctgctactcctagctgaggtgatgaggtcctccgttctgtacgtacctgtccatgagatcacatctcatgaatgggaaccgtccggcccggccggcgcccccggcgtcacggagcgtacgctccatcggcgcaagcgccatgtacgtacaccacacaacacccccccccccccccttctagctacaaccttcttcagttctccatcccccacatgctacaagctactacatgccactagttgcacatacctgcactgcatttgcgcgcgtgcgatcatatttatgatgtacatatgcgtcagatattttgtttaggttcgtactaataagatatgttatattcatattatgttgttttattttggaataaagcgagtatgctactaaggccttgtttaagttcccaaaacaaaaaatttttcacccatcacatcaaatgtttggatacatacatggagtactaaatgtggggaaaaaaccaattacacagtttgcgtgtaaattgcgagacgaatcttttaaatctaattgcgccatgatttgataatatggtgctacagtaaattttgctagtgacggattaattaggcttaataaattcatctcctagttttctggcagaatctataatttactttgttattagactgcgtttaatacttcaaatatgtatccgtatatccgatgtgataaccaaacccaaaaattttcccccaactaagcaaggcctaaccctggccggtcgatatccatatatcatggatcgatcagcctgttgcattgttcaaggcgcacacatgctatagtgacgtaccatacgttgaaacaaccactactactaccactacgcctaatatacggatggaagcaatggaaaaacggtggccaagcataaagcgggagcagcagaggccgcagcagcagcagcagctatcaccccctcaccaactccaattaagatagctcccggccaccccaacccaagcccttctcttctctctccctcttctggtttggtttgttgctggccctagcatcagcgagagaggccagaggcagacaggcagctgctgctagatatagctagccggcaacgcactccacatccagccgccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccattcctagtcctttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcaggtcagtgttcatcgtcgtgtttagtttgctgctcgaattcactattctccgatccactgttcatcgatttcccagaagaggatgctggcccgatttaatttgctttgtccgattgattggtttaattaatgagacacacatcttgttgcggcgtgtttaatttgattggagaatatgatttgtaggatcagagagttgcattaattaagtgatctggaagttccattctgctcactattgagatcatatcgaagggtgaaactttaataataaatctcctaatttaactacctaggatttaagcttttctttttttttcatacaagtaatttcagctcatcattagccgcctgtttgccctcaaagtaattacgttagttggaacagtcagatgaaattgaagacggcaattgctttgaactttaattggatgtgtggtaccatctttggcctcttttcctgagttcttccggttccttgcctcatgaacccatgagcagttcaatgcttgctctacatttgcccagatttccttgcctttacatttctttgaaagagagatttcttcctatacaattatctgattcttaactgcttaaactgatatttctagtattttttgatgaacaattccctaatctgttctcagaaatttgagctaaattggatgcatttagcaagctattgctgcatatttgatatatacgtttagccgatttcgcaattagctatggtgaggagaaaattttgcacccattttatattattgcctacactgcaggctaattaagataattcgtgtactatagttattaatctgttcggacacaatatataaattttgaattatcgctgttctgaacacataaacgttcattcgctttgcaaaacaaaattacaaatagtatgcgtgcatgtttctaggtttacccaggtgatgagctagagattcatatgccatctttttctttctttgtgtttcaaattaaagatctttctttggagaaaattgtgtttcaaaatattgatttctgtttaattaaattgaatcctgatcactatctatcacatgctgggacttgggggggaataaccaatatctgtacaaatacatattgatcttgtcctagatagagttgcttattttctcctcctttggttattgttccttgaaactagcccttcccatttatttttcttgacttctccttcgcatgtttgagtggttacttccaacagtattcgagacgtctgtacatgtattttggcctcacaaagtcagaaacaatgcgactttctttgcaagtatagcaaagactttgtacagcccgctcacgtacatatgtacgtaccagcacaagttgcatttgcaagcaacgtgttctttctctctctctcattctttttttaccctgaatgtgtggccggccgtcagtaacatttacctcactgagatgaacggctcggattgattgagaaactgaagaagaaactaccttcgatgcctcctaagcatgcacgtgttaagctcagcaatgcatttaagggaaaacaggaaccttttgcagtatggcacaccatatggaaacactccatatgagtcagctgcaaaactccaagctgtctctgggatggaacagtttaggtgtatgtgcttctcgtgctcaggatcatcattagcttacatattggtccccagaatgttcttttcatcagtagtttcttctgaactgaagtttgatctggcctgagcaacctgtcattttgtcttcgctaatgtgcacgtttatgtaggaaatatgcatgcaggatcatgcaacaagcttctcaatcgtagaagtagtacttcatcttccatatcctttatcgttgtaccgtagtatttcatgtgtattcgtcttcagctcttcgtagttgcatgcatccctctcatttctgtatgttaaccttttctaacctgttcaattattcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacagtgcgtgatatctctctctctctctctctctctctctctctctctctttattcagtattttcattcatgatctcaaccacct

SEQ ID NO: 23108 - DNA, 1199 bp, Oryza sativa
cccaacgtccttatttttgcctccctagaacatctatcgcaaaggccctggtgcttgcctgaagcgcaccaaatccccgtcttgctgcctgcgccacggatctgcattgccttggcactcgttggcagagctacctccatttgcaatgtatgctcattggccgaaaatgaaggagacctgagagaaagagagaaaggagatggagacctgacacttaggtctagaggtattttagaactttcacatggtttctctcttctattattgaaccgaaaagaatattctaatgggtatggaatcctacagcgaattttcatgttttgatagtgtcttctcccaaaaagtcatgacgtgcaagtgtcctatagctaaaaccataaagacacaatattttgtatcaaaatttgcctaattaataggcaaattttggtcagttctcctatctagctactatttttgtcttattaggattaattttgtgaatcattttttttaagaaaaaacacagtatgaatgcatgtaaatatattgacgtgcagacactgacccctctgaataatattttaggactgaagcagtgcacatcacacgcactgttgaacgatggtacggtaagcaagtatatccatgcttacagctagctagcacgagtgtccccgtcgtcctctgcagcaacgatcgaacatgcatgacaagctagatcgatcatttctgttataacaacgagtcgtccaaaatgctcatatacatgtcggccggcctagctagctccgcatagggcatgggcaaaggtcgccgtcgtagagctgagagctaggataatttcggctaggttttgttccgcgtacagcagcagccatacactaccggccttttcctagctactccctccgtcagagaatttggttagatgtgacatatcttattacaataaatttgatagagaattcttgtttagatttattgtattaaaatataacacattcaattaaaattttttatatttagggatggagtgagtagctcgctgatccatcgatcgttttcccgtcgtgggcatcgcgatcgatcgatcgatcggtcacacacgacgcgcgcggcgcgacacatcacatgcggggcatgcggcgccaacgcctgttgccaccgctcgctcggtcgcgcgacgtacgcttgcaaaatgtccagtgtttttacgg

SEQ ID NO: 23109 - DNA, 10669 bp, Oryza sativa
  unsure (1)..(10669): unsure at all n locations
tttatgccctgaaaatgatcacaacccatgattttattaggttttggaactccaaggtgttggatactaatggcaactgtatttcctagtcagtcactacattttataaaccacatgttgtgggtataatttcagattttattaacttttgcggcagcaaggagctgccgatgtagcgtcctggtttgtaacctgtagctgtcatttgccagtgtgttcctgtgtggtccagttgcatgggatcatgttggttggctttcgttgcaacatgtagcttataactcttttcccaagcttaataaaattcgtccggcatacgctggcccgacgagatgcaattaaattttggtcaatctatcaagtaggcgacatatgactactgctcctacctaaggtcggaagctaacagcttcctttttaaggaataaggaagacaaatattgtagctaactagtaaacaacggtttgggaaggactggattttgcctaattagagagaaatcctacctaatcaaacaggcttgtctgcaattatggttgatttgcataaaagaaaagcagaaaaaagtgctatttgtggttagtacttcgtcaatttcgattgcacaaatggttttgttcttcaagatttccatctgagttaaactgtggcataggttagaaaaacaaaattgcctgaataggtccagcaaccggcccaaatgacttacaagagcacagctatgctttttctgaagctttggatgacagtacaaactattgagcattgacccaagggtataatccttcaggtcatataacaccaaacactcagaactactgtaaatatgaatgaattttgtaacatctctcttgtttttgttagttgaaggcttgaaatgtcttatctgattctatcacttaagctaaagcagaaattgtgcatatgattcctctgtttctgacttgatcttagtttagatgttttctctctaagttgaatgtagtacctactatgcatgcttatcgtggtttattttcaaactttcttcagagttgagaacaaaggatacaggtccccacatccatgcgagcttaaatgggtcgaccaaaaaaacttctgccaatgggtaacataatgtgcacaagccacttatatttcaagtgcagaagtttttttttgttgttgttgttttggactgacatgtttggcattcgtctgtttcctctactgcagccttcgggatcaatcaaatgccaactcgggggtagaatcttcgggcaatgataatcccagttgcaccaactcgagcaccggtgtgcctcccaccaataacgaggttaatgatcctaaagctgatgccgcagatggtgattctgtggagaatggcacacgattgaattcagaagaacctgcgcaggtagacccaaaaccagcctacgttcggcgaggacggaaaagggtggtccgaggcacgagaggaagagcaaagtagaagagcatctactgcacccacaattgtttgtataccactaatattaacggcccaaatgggtggtatgataatgatacctaggttaactagagttagcattgatcggtggattttatcgtgcacccactctttgtacccatgttgtattattgtaggcgtcatactgactacgtttcacgatttggatgtgattactaggactggtagatgcctccttttttcttctcagtgtaaaacttatgagtagtttgtgcagatggaagaacaaatggtttgtttgtagtattgttgtagcagtaaatggctagccatctaggtgactagagatgtactacttcagtatcatgcagcgctggacgctgaggattctcgacatgtaaccagtatttcgtactacggatattctattcattgtgtggtaaatgaactgcggctacggtttgcattttgtaacgttaatgtttgttggttcaaggtcaggcagcacgaccatggttcaccttttcgagcgagcgccggatcccaaccttaggcagcatgacagtttttgctgaattttgataaaaatctttgtgtcacatttactgtttcgaatctgaattcttgaaaaccatttgaaaattaacttgaaatctactgtcggttatcattgaaaacgtgaacctggggcacgaccaccgccatcacgggcactgtttgcccatactaaatcatctccttagatgtgtctaaccgctgacgcgagccatgttgataggagagaggcctcacccgtcgcgttcgtttgctatcttgttctgtacatggccacttgtatggctcaaaagctccgctacgttttgtgcctagccattccctctttaactccgttcatggcattttgcaatcccccattgacatctcgaaatggagcagacagtggaaacgacggctcgtcgacgtaccggggctctagcacaaaagatatgcatgcatcggatccatcccattgcgtcgcgtcgtcacatctcatcatccatctctctgggcgccgtaccagaaattgtagcctggtgactgaaggaagacaggagtgctactagtagtactatccaaagaagctagaagacgagagcccgacccaacttcacatcatgaaccaaatcaggaggccttatcctgaaagattcttggtccccttcccctgtttgcaaacacatcgcgatcccagggagatgtcctggctagctgcatgcacactctgcaatgctcgtccattaccttgttccattgacacctactaattgccaacgcaatgtgcctaacgagacggcacagaagtagctagcacaaggttttttatatactatacgtctatactctagtaatttaagttttaagttacactgcggttgttggccggctaggcttttgctaattaagcagatcagggctggacgatctctatggagccgtagaacgtgagctcctggatcatctcctcgacgtactcgtcgccgtcgtcgacgcccatcgccgccgccgccgcagcagcatcgtcgttgtcctggccagcgacggcgccctgttgcgcctgcgctgatgaccccgcgccgcagcatttctccagccgcgcgcgcagggtcggggagaggcagctgcgggcgttgccgccgctgctgctgagagggaagttggtgcgcgccgctgggccgctcatcagcctcgccgcctcgtcgtacgccctcgccgcgtcctccgccgtcccgtacgtccccagccatatcctcgtcttcctgcacacacacacacacaaacgtcgtacaaacacacggtacatgcatatgtaccagtcagaacacacatcgtcagcgtagtacacgtacatctccgtatgatgcatgttagttcatggcagaaaaagggagattgaatgatgatcgtacaggagagggtggcggatctcggcgacccaggagccccagtgcctctgcctgacacctttgtacttcgtcatcctttggcacacgcacgcacaatgccggcctcgatcgatcgatcactttgcaggtatcaggtgctgcacctgcaggtacgctttatatactgtgccagaggacgggagggctgcaagagatagcaaggttttggacggctggatgggatggatgctgccgctatacttctcgggatgatatacgcaccaacaccatggccacgtgagactcatctcacgtacaaacagtcaaacatcaacgaggaggattacttggttcttgcagataggagagtattaaggaggtagcactcaccgcctcaccggacaccgggggataattggggttgcccccacgcgcgcgcgcacgcaatctatagatagattttggtgcgtgcgcgcttgagaaatcgggtagtacgtgctgctgttcgacgaggccgaacggtccgcgtgggtgggtgcagaggaacgtgtcggcggggaatggaggccacgttgcgtctgcagcagtttaacctgtgtgcgtaggcagcgtagcttcgcaagggcgatgggattgaccgttttgtttcactgtcgaacggggtaacgacctgaaatttgatttgggatctgtttagaaagttcaaatgctaaaatgtagttgattagtagctattttccggcttcggattttcagtatatnttntacattctatagctatagatttttagaaaccaagtaagaacctcaactgttttggggagttagaggttctagtgaaaattgcagccgctagaaactctcntaaataggatctcgatggtgctacatgcctcctgttttagtgaagtgcatgtaaagtggctctttttttttacataaatcatgatgtatagcgcatatgtgtttttataatctaagcattgtaccctatatttttttaaccatttgatccaacagaattactaaaaaaacatcggctagtttttccctctaaaacatttgaatttctgaccgtcggattacctcgagatttgtgcgggtaaagaataaaaaacattcgctagcacatgtgggatcaaagagtcaagcctgtgacatgcttcgtgaacaccggtccttctagcctaggccacacacgtgtttttacctagtagttatatgttagttatctataattacacttcaattatattatagttatatttgaaaaggtttcacccaaataattgtcgaaaatgttatatagttactcccttaatccaatatggtcctagtacttccatccctttataaaccttaaggactccgctccctctctgtctcttgcccgccctctcatacataatctatgtaccactaccaacattcatggcctaattttgccgacaccctctcaagagtaaagacccactgactaccgtgcttccctacctgctcccctcctgcgatcgtccattgcgttcctcattcaattggctaccaccacttgatttgccactgtcgactttctctttattggcaaacctctctcatgttgttgtcttctcccttcccaacagccaccacgggctttcccctccctagcaaacctcatgcaccattgtcatccctttctccaatgcctaccatttgagatccaccaccacaatcttccacttatgtggcaaacacaccccccccttaccattttcaccactcaagtggccacaatatctagatccaccactgtgggcatacttcccttctgtcacacaccttgagcactatcgtcttaccccttagccaatgcctaccattgccaaatccaccaccaccatcttccatttcccttggaaaacctcctaactttcatttcccccctcttaagtgcctatcatgaacatattgccacaatcggctttcctcgggaaccatcacattcctttgccaacacatcactgttatatttgccacgaccttctacattctactttcttagcaaacaaccttgtgcatttttgtcacgnncccagaaattncccgaatagaactccaangcagaatgtgcattaaaatccccgtccaggaccggccggggtacacaaacgataatgttgacattcagatccacgtcttacagacatcataaaagtcttacataaatgcagcggaaaaaggaagacaacaggagctaagccttgattagaactgcagcgggaacaccactccacaggcaccctcgatggcacggatgaagcctactcctcggagaaacctccatctgacacatacccgaactctggggttgggaaaaaaaatagagcaagactgagtactacccactgtactcagcaagtcataccggaataggggtatgatgcagggaattatcaaaggagagctagagtggttcatttgcataaagcgagcatttataaacagaagttgaaagatttaaaccgttgtaataattaattattattaactatccactgtccaacgctatcccacgttgcgacaggcccaaccatccacctaaactatccaaattcaaaagattacactagggtgagactaatcacggtgaatctggttgaccgcccataaccgcgggcacggctactggaatagttttactctgatcagaggtgtacaactatacccacaagacacagccccacgacacgtttccgtgcgccgacatgccaccacgacataccggaaagaggccgtaacaggacccttcgcataaccccttctaactaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaataggattctccccattgtgcactagttgaactaagcatggctaagcaatccctagtccaatctctagtcatgttataaccccaagctgacaaagggacatggtacaacaatagcatggctatgacaataggtaaacaccccatagtaacattataaaacaatgcaatatttgaaggaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgagacttgaatgggcttaaacggagctcggatgaattagatatgaattttagaagattcactgtgtttattactataacaaaaagtccttaaatcatttattgcgtaataaatcccagggctggcgtcagcacggggggggggggggggaggaggctcggttccgacatgcagggcccaccggtcagcggctcgggagagggaggaaaggggcgccggcgagcgggcccactcggcagcgactcaagggggggggacggttcaccgtggaccgggaccacgcgggtggtccaccgccggtccacgggaccgacggcccagatcgcccccggggttgatcggacgggcggcggcgacccggctcggcttggctcaaggccggcccgccggccacggcgatggcgacggcgcgcgcgtgcgaacgcgttgccggcgacggcaaccggcggcggaggcgacggcgcaaaggcgacgcgaaggcggcggcgctaagcggcggctaggaaggagagggaggggaatagatgggagaggaagcctcaccgagggtggccggcgcggaggaagaccacggggaacggcgacggcaagccacgggaggacgacggcaaccggcggacgggcttcggggtgccctaaggaagggagagagagagagattagagagagggagatgaaccacggcgaccggtattcatggcggtagaggttgaactcaccggagcgcgagggaatgcgaattccggcgacgaaactcgacggggaaggggcggccagggtggagcttagcctcgcgaacccgacggcggcgacggcgcggtgcggcggcgagcctagcggcggctagcggcggccggagtgacgggaaaggcggcggctggtggatgcacggtgcgggagtgatggagagctcgggagagttcggcgaaatggggaaaaagagagagggggtggcgtcggagcttaaatagggagagaggaggccggacgtggccgggagaggcgggaatcgccggccaacgtggggaagtgggggaggagagagaggcgggattcgaaaatcgaatcccggccatctcgggcgcgggcgcgggcgggagagagaggggagtgggcgcgagggacgcggcgcacgcgcgggcgtggccgacgtggcccggaggaggcggaggcatgggcgcagcggcgcggcgcgaggtgggagacgggtccgacaggtgggccccacctgtcggtgaccccgggagagaggagggggcgcgggctgagctggggcgtggcctccggccggcccagcaaggcgcgaggagagaggagaggaagtgggccggcggcccactaagggaaaaggaaaaagaaaaaaaagaaaaaggaagaaaggaatttccagggatttaaatattgcttgtgctcaattttaattggtcaaaattatttctagggctctgaaaattccactaaaaatcctgttagtgaacttcgacatgtagaactcaagaaaaattccacatgtcagattcgattattatttgtattacttccttagggttttctcttgatttgcaccggcattttcttagggtcatttataaattaaattttaggcttgggaggagaacttcggggtgtgacaattttcctcctctcaggtggttgcagcttctagatccatcaccgtcatcttctactttctcatcgaacctccgacacataaccgtcttccacctctccaacaactatattgttgccaaatttatctaaccactaagaattccctaacgttgaatccccacctcctccccatctccaccataacctcttttctcatgatatccctcaaaaccaaggaaatatcactaatcctccttgcagcctcaccatactagcttgaaacaaatcgagtatcgtcgcggatgcaatcaccatgttacgagagaagatgaaaatgttatcaatgcacggatctttatgtttatctaataaataggagtagttgcatgtggttgatgaagaaagatgatgcctacaagttagtgaattccttttatagaaaactatcatatatggaaatgaatttcaagatctaaagggcatgtgattttatttcttatgaaatattgtaggacagttcccttcaggggacgacatacttaaagacccacgcccaatgcactctctgccaacgccacatatccaatgccctcctcctcctcctcgtgtcttccccatcctcctcctattcctagcccatatgccagccaaaaatggctcgccactcctcctcctgcccttcgctggccctagctcatcttcctactctctacttcctgttgtggctccatgttcctgacgtagccccccgcttcccatcggtgaggtacctggtacctaggtacggacacggcgagagagggggtgtggtttcatggatttggtcgaggatctggaggtggaggtactatcaaccccaccgtcgtatggatgtggagatggtggtggtggaagttgggattcctgatggccatgggtggcgatcaagttctcggagcccatggggacgggatgtggtgttctcccccacgatgatggtagacaagggcctcaccccttccttcttcgaaatgaccatatctggagctttgattggctatcaatgtggtggtatagccatcatgctccttgccaacccgttttgctgcttgtcagtgttgtgtgcaggtatgtcgtatgacacattattcttggttagcacccatgagtatcaagtatgatacccacatgtatcaggcttagcaccagtgggtctggtacctgcatatatgaggtatggaacttaggtactagccggtacccaaaggtgctaggtacgatacctacgggtatcaggtttgctacccttggtatctagggatgaaaaacggagcggatagtttccgtccgctccagataaaaacgaatacggatacatctcggatcggataattctcggatagttcggatacggatacgaatacggatattttctatcggatacgaatacgaatatggtatcaagatttccgtcggatacagataataattcggatatccggtgaacagtgctattcggatatccgcagaagccacaagacatacccaatttctttataactctatgaccttcaatatacctttttagattttaatagtagttcatctcttaacactagtccacattattaatattatttaaaattttaaaaatatttataaataatactacattttatataaaatgagctaattatatatgttgatatttgtttctattagaagttaaattggttttcgtgttccgagaaaaatttgtttccgtattcgtgtccaatcatattcgattcttattcgtattcaagatagtccgtatttgtttccgtattcgagctatccgtattcgtttctgtatccggcaaaaaatataaaaacgaatatggtatgagcattatccgtccgtatccgctccgttttcatccctattggtatctagtataaaggtgtagagagctgggcgcattatccccacctgactagttggcgagccaccggccattggcgcctcctctcgcttctccctttctttcctcaattccttcatcctattgacggcgttgcccagttgttgctgcagccagcgatggtggccttgctcaaggcatcaggctgggattgattgga

SEQ ID NO: 23110 - DNA, 3195 bp, Oryza sativa
catgctatccacttgtcgatcagtttgactgtatgtgccgttcccgtaaagcagttgtggcttaggctgtgtttagttcctgaaaaaggttaaaagtttgagaaaagttactagtttgaaaaagaaagttgggggtttatatgtgtagcaaagttttggatgtgatgtgatgtgatggaaagttgaaaagttaagggttaactaaacacggccttaatccggcaaccaattaataacacgcgtgaatgtcgtagtacggtacatagatgctgtggtcgatcgagaatcacatcttgtcgatgtcgccgttggacaggggcacagccctgatgggcctgaatgcccccctgattcaatgcttcatcgtagccacgtctcagggtgaacagggtacgtatgcacattgacgtaggtccagcctgtggatcggcaatgcttcatcgtcgtcagagttcaatcggccaggcagccagaggcaggggaacgtggtgtcgcgcggctcgtccgtctccggtctccgcgcctatgttgtccggcgttcgggggaggagtagggtcgccgccacgttcatcttgttgttagtttcctcatctcgatcagtcgatcgcggctgcgattctaccgatcgatgtcaaattgtcaatcatggtgcattgcggtgcagtgcatcgcgcgtccgcgtcaggattctgcagtgctgggtccgcagcagagatacgctccggcggccggtgctcgatcggtcggctccctaacccaccaccgcgtcctactatggctacagaatgcaatgtccgttgtttgtttgctgcttccatgtcaaatgcagtacgcggtgcaggaagaaacggacagcaaaaaccgtcgatcgatggaagaaggctacttgtgtttggaaactcccaacaccatgatcgatcgccgagcagcgagagattgcaattgaaattgaccgaccgatcggtattcggtcaggttcgttcggtgaggccaaattaaaagcggacgtacatgggactgcggggcggcaacactcgtatcatatatatgccgctttccacgtacgctttcgaggaatagcgacggcacgacgggctgctgctgccgctgcgtttctctgtacgtgcccatactccctccgtcaaaaaaaaacaaaccctgatttccgtgtctaacatttaaccgtccgtcttatttaaaaaaattaaaaagataagtcacgcataaaatattaatcatgttttatcatctaacaacaatgaaaatacgaattataaaaaaaattatataagacggacagtcaaagttggacacgaaaactcaatatttgtcttttttttttttgggacggaggacgaatgttgtatcggtcggtcggctggtctgacatttctttctcatctcacaaagtcaagagtctcaggtcatcctcctgcgtcagggagcgtcctcccccgattgttgtgtagccaactgcatttgtacacatcgatcgatatcctagcatctgccgagctgcagccatgcaatcgtcaacatcactgatcttattatgatactagtattatctatccctaagctagcggtgtgtgcgacatcatcgtccattatctgaccaggttggcatgcaggttcccatttccaaaccatcttaccgtctgttactagattttactaccagacagaattttttttcctttgaaaaatagtagatttacagtttgtgcccagaatgttttgttagcatggtaaaagagataggagtaccagtgagcagcaagcaggtcgacagttaaagcggtactccctccgtcccaaaatataaatatttttagcataatggcaagttaaacattattaactttaactattaataaaaaaaataaaaaaatcaatcatgtaaaattaatgttactagatttatcattgaacaaactatcataatatacaactctttttatttaaagcatcttacttttatagatattgttagtcaaagtagcatcttggagaccgcgtcagagtccaaaaattcttatattttgggatggatggagtacctcttttcaacttactctctccctcttttttcttaagcacgttttttgaattactatactctgtgtgggttttaaaaaatatatatagaaaaattgattttaaaaatcatattaacctatcttttaagtttattttagctaatgcttaattaatcatgtactaataatttttttacacgtcggaaggtaaagtttccaatctctactttcaaacgcagccttatagatgtatcgaaaatgcagtggaaaccatgggaatacaattgttagagggtactttcgtcttcgggttcatgtacggtgggaaacggtcggaaatgatatcatgtttatcaaacgattcacggctgagttgaaattttcatatttatcaatttaattaatagtggtgatttgatgcttcaatttcaaattttatatactatttgaattggaacagtccagaaaaggacatcacctttacagaaaggggcccttacagaaacaatatatgctccgctgatgggaattttagtcaccattttcatttgcgtgcagcaaagggaaattgctatgtatatgatccaacggttcgacttatgttcgattgaatttaatcaacagttacaaacgactgcaatacacatgaacatactctttttgaatgatctatgatcgtatgcctctagttgtacatgagttgtacaactgagtcatatgtacatgagttaggaacagacgtggcttcgtggcccagctcgaagaggcccgttggtgaaatggcctcttccatgatcttcacaaaatttcggcctttcagtcgtcagccgaagccagcaaggccgcaaagcctgttccgcgaaaaccgcagaattttcgggcccagcctgttgaaagcgctccacggtccgtcggtcccggttggaggcctggaagtgggttactgggcttgtgatgaggcctggaagtgctccaactgggctttctgggcttggcgctcagtaatgaggccgtggcccacagagagacgaggccaccactactattttgattttccatgggttttagtactttcagcaaattactgttcttttcatctaaacaaaaatgaaactatacgtgttttcttcttcttgatggaaatatatactccct

SEQ ID NO: 23111 - DNA, 8560 bp, Oryza sativa
  unsure (1)..(8560): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgctcaagagagggatgtgccccgtcatcgcctctcacggcccgaccgaccgcctcgccatcgtcgccttctctggcgccgccaagcgcctcctgccgctgcgccggatgacgcgccagattgtcgaccgcctccgccgcccagggccaggaacagccgcaggccgtctgcattagcgacgcgctgcgcaaggccaccaaggtgcttgaggaccgccgcgaccgcaacccgtcgccaccgtcatgctcctctctgacacgcagcagcagcaggatgcgaggaagcccggcgcggtccggcgcccgccagccgcccctccggacacgcgagtcacgcacgtcttgtgcggccacgggcagcaggcggcagcccttggcggcggtggcgacggctcggcggtgagtgtctccctgggcgagaagtacgcggaggatattcgatttgtttgtatgatcctatcaatccgtaaggattcagtggctcatcttcatcaaccatctcttgtgcttctgcagcaaatgttaaccccaacagttaggaatcaaagaaattgaatggcaaagcgattttagttctcatatgtggagtaataatgaagaaagatacatacttatcgatgatttgtgtaggtcataaacaaccattagccgtctctgcaggattgccgccatgaagacaaacatagaacacatgccaaacatgacagtgatagggaatgtctcgtcatcgtcgtcgccttcttcctctggcttcttggccaacggcggcgatggccggtcgcattgtcttattcgttggtttcttgccaaccggaggcgatggtcgcctcgtcgtcttcctcgggtttcttggcgaatggctgcgagggagatcgtcgtttgatcttgtcaatggttggatgcagcgggcagggaggagatcgtggaggcggcagtggaccaggtgaaggtgctggaggacacggtggccgtgctggagcctggctggaggcgtagtggcgtacctggaggtgcagccgtgcaggttggcggcaccgccgccgccgccgaggtgtccgtgtcgtaccgggaggcggggagagagaaggaagataggagggtgagaatgacatgcaggacccacgtgggtcccaccatctttagtttcttttaactgacacgtggacgtccagtttttattatttttgggatcgaattgtcacgtaagcgccacgtcagatgtacaccgagtcaaattagccatgtaggtgccacgtcagccaaaaccgatatcaaaaccgccgagggacctcgtttgcccggttttcgtaagttgggggacgggtcgtatccggttttgcggttcagggacgaaaatcagactgggcgacaaatagagggatctaaagtgaacttattccaaaattaggatagccaactctaatgagagatcctaaattcaaaatgtcacactcccaccaaattaggtctttccttagatcttgtctgggccgtagcaatttgattgtgaatattattcagagccaaattaggcccatcataaattagagaaccgatccaaattgggccatgctaattggaaggaggactggacgacctgcctaaccggcccatgcattcattcatgatcaactactaattagctgatgcgcatcttcagagtgacagtcccagattaaagctaacacagcaaacatccagctagatatgctttcatctcaattagttcttgtaatccactagcttcttgctaaacgttctagtgaaagatgtaattgtgttttcatatcaataaaacgcgccaaatggcttccctaaaaaaaaatcatccagcaaatcatttcaattcgctcccattcaggcccaacaaccccacgtcccggctttactgacactacgctaaatccagcaaagttcatggacgaacatgcatgttccggcgatcaaccggctcataatctcagcggtttccgcacctgccactgttgcagcaacaggcaaccacagctgccgttgccgcaacagtacgcgtagttagagacgcagcgtgctcgcatgttaggcgtcacgtgaagcagcggccttagatcgagccaagcacgcgaaagttggcccaaatggcgtctagaattggattttttttcattttcaattttatttttttaatatttacagaaatattataccatctaaaatatttacacaaatgcaatttttgccgtactaaaaatgcatttttctagttttttttcaacttgtctgtccctcacgtcaccctgccgccctacttctgtaaatattttcgcggtacaatatttctgtaaatattaaaaaataaaaatgaaaaaaattctctagaattgagcctacgtacgtgctgtagagtttagttggcgatgatgagataatacctggtcggccgacgtacgtacctgacggcctgaaacgctggatcgatcgaacctgtgtttagcttctcttcttctgtaatcagaggataagagcgataaaggcaataacaagctgagaaataaatgcaacttgttcagacttcagaacttgattgattataacttagtacttcatccactctaaaatatgaaaaattttaggttgtttagtaaatacttttttgaaaggaatcagcacgagattgtgctatttcattagatataggcgtaaaaaaatacaacccctaggggcaaaaaaaaaagagctgtacaaaattacataagcgctatgattaagttggtaggaattctccaagtcgccttgcgcctgccattatccaggttcttgcctcttcctttatttttgctataagattgggggccgccgtttccttgtgctcgaagatcctttggttctgtttagtaaatactaaggttaagtcaaaataatatttccttttagtaactgctgttaatttaaatacttgaaaatccttatattttgaaacaacataacgatattctaagtacctcttcacaggcaggcctgcaacatgcgtcacgcagactttgatgattgatgcatcatgcatcacgtgctcatggtggcagaaggggtcggcaacgtagcttgctgttcttttcgctatgatgacgccaatggagctacgaagtaggaaatacattggtatttcagtatttcagtaaccagttccacgagcagcaatagctagctaccaccgcccgaaccacctgtttggcagaaaattgaacactcgcatgagctcagcaaaaggcctaccttctggttcgatcttctcccgccacgttctgcacttgtgcagtcaacaagcaaccgatccagcttcgggggcctctacaaatacagctcctccatagacttcacttacctcgcaaatcacaagcaacatcaccacagatcgatcgagacagctactgacatcaacgtgaaaaagggaagaagaactaaccatgtccatgcaggagatgctccgcattggagacgacgacggccggagcgatgctctggaacgcgagctcaaggagaagctgaggttgcgcggcgatgcctcaccggcgaaatgcaccaggcaggagcagcggtggcggtctgatcatggcatcgtcgacgcccgcgagaggttcgtgcaggcgtacggccgcctcagggacgatctcgtcggcgacgactcgtgcgagctcaccgacgaagccaggcgctggcttgctcaggtatactgtatatacattattcacttgtaacggggaaactgaagctaatattttatataatttcattgttgaagaaagtgaagttaatcttctatatagtttcagtgctaaaagttttgattccttcttatctttattttctttgggcagatgatcgactacaatgtacctggaggtgaggaggcatcttctaaagcattgcaagtctgaacatctctgatctgaaaattggacaagtgttaaaaaaatatagtgcacactttacattcagagagtgcaagtgaatctagctgagtttcggttttgaaaaaaaaaaaaagagaaaaaaccttttacaagtgtctcaactctcaagtcacaaaattttcaatgcaatcttctgtttctctaaaggaaagttgaaccgagggctgtcagtgatagacagttacctgctgttgaaacaaggaagtgaggttactgaagatgacttcttccttgcttgtgtgcttggttggtgtgtagaatgggtaatgttgctcaatccatctgctcatcatccttttattcctgaatctgctcatgccgatactaacaggtttcaattatctttggttctatcaaaaatgcatgtagtttcaagcatgtgcactactacttgatgacatcatggacgattcacataccaggagagatcagatttgctggtaccggcgacctgaggttcttcaacccatcttcacatgatactctgattctcttaataagctgtaacaaaacaggccacttagttcttccacctatatttctgttacaggttggcctcaggggtataaacgatggtatcatactaaaatgtcacatcttgataatgataaaaaagtatttcagagaaaagccttactttcttgatatcttagaaatatggagcgaggtcagcaaacatctgaattactactgaaacatcaattatcataatttctgatggtggttgatactgtttagaatggatattttgttcagatagctctgcagacttctctggggcagatgcttgatcttattagcacacatactggagcagatgatcttgcaaaatacagtattgaagggtacataatctagatccatctacctctccctctcttttatttaatatttgatttgcttatgataatattgggatgttgctcgtattcaataactatcttttctcttgtcatgtagctaccgtcgcattgttaagtacaagacagcgtactactccttttaccttcctgtaagtctggaagaccgaaactcagatgcagtcctacttttcacttgtcataacgtcatgtatctgaatataggctgtagaactgtacaagttcttcaagttcacgatatcatatgaatcagataaatagaggggtttctttgcggcaaactcttgaaaaaaggtgcaggaaaaacatgttgaggaagaatgaagtaggctatcctaaattctgatcatacctgtcctcagttgctacatgaatctttttcagacagaaattacgttcttcagatgataattgtggcgtgcagtacattggttggtaatctatgtatcttcaattagtgcattatgatgttcacattttcctctacaactataggtggcaatgctttgcttttatctggcgcaaaacttgaagacttcagtggtctaaaggatatacttattgaaatgggcatatattttcagatacaggtatatggcatgcttttttttctttaatgaaaccctaaagtcaattttacctttactttgccttttcaggatgactacttggactgttttgctgaccctaacaccataggcaaggtaaggacaaagatcaaaatagttttcagcaactaagagaacaactgacagctgacattattctacattgaagattggaactgacatcgaagatcataagtgttcctggttaatagtacaggctcttggtcatgctgacaacaatcaaatagaagtactacatgtaagttaccatcttgttctatctgaaaaagtatggacatgaacagaaataataacctcctgcgcaattcacagaggaactatggcaagaaggattcaagttctgtttccgaagtaaagaggacttacgcggcgcttgatttgaaagtatgcccgtgatgttaccttttctttagctcatttcacattgcttgctgtagtaatgtagatatgggccattgatttggctgactgtgagttctgtcctccccaggatatcttctccgagttcgaacgtcgatgctacaaccacctggtcacctctatcgaagctcagaaggatcatgcagcacgggagatcctgatatcatttctgaagaaaattcatcaaaggaagaagtagttaataagttataacaattatgacctgtatgagcttatggtaacatttaaaaatgatcgaaatctatctccccataagttataataacactatctccggtttcaaacgtatgacgatgttactttttaattcgtttgagtttaagcaaaaaaaatcaatgggtgtcacatacatttaaaaacggagggagtttcaagttaccaacggccatattcattgcaacattcgtaaatcagattaaaggaaaaaaagatcaatacaatgcttgggttcccaatgactttgcttcttacatttctctagtacgattggtcggatccaattgatcaatatttacgaatggtctagcagcaatgatttgtgcacatgaatccaatcacatatccttaggccatgtttagatcccacccttaaacgtttgaacacctgtatgaagtattaaatataggcttaaaaaataactaattgcacagattgcgactaatttgcgagacgaatcttttaagtctaattgctccatgatctgacaatgtggtgctatagtaaacttttgctaatgacggattaattagtcttaataaattcgtctcgcagtttacagacagaatctgtaatttgttagtctacgtgtaatacttcaaatgtgtgtccgtatatcctatgtgacccgctaaaactttttacccctggatctaaacacagccttagtaacacggggattttctccgagacttaaatcggattcgccatattttctcgatgaatttaaactggattttctccgagacggaaggatcagcagatcatacctttgccagctttctcgttcactgggataggagatggccagccgcagccgaagcccaaaagcgccatggattctctcttcgagcacatccgccgctccgcccttgcgtcgcctagcacccggaagtacagcaccgtagcaagccaaagccaggtaagaactgtacccatctccgtacgaatgccatgatcgcatcagaattcagaacacaccatcacctcatctgtttatcgctgatgtctgaaacctgcactgcagcagtgtgtttttgttgaatggcgattttatcaagtgatgagacgcaccatcgcattcgacggtgtacctggaatgtagaagcaacaggacagcgatttattcctcttattctgggattatctcacacttcaagcacaaatttctctgagaaaaatttgtttatctacattttattacagggagggaaagataattggagatttgctgagaagcagcgatggcggaatttgggtatttgctcaaagcttcagacaggtattacagagacaaatagatttaaattacattgctttgagagataacactaaacaatgtctgaagaaaaatcttttgagtgatgcctgatagtcacagcaatttttcacacaattccctgtttctaaatcaagggctagcagagatcgatagttatctgctgttgaaatatggaatcaggattacagtagatgatttatttggtcccttgcatcttcttgtatggtgtttagactggggggtagccatgctcaaatcatctgctcacagtcacttttcagtaattttgttcccttctttttcatccataccaattgcaatatcatgcgaatctatctattatatactaaaagtccattaaacttcctacaaacgctcctaaaccgccacgtgcccccctacaaacgctcctacgccgccacgtggcactctaataaattagaagaattaagcaaagcatctagccgttggttttcatttaatctggtggacccactatttttaaacgttagatatagcataaaaaatatcaattagatttattattatctttaaaaatccacacatgccctgtacgtgtacgtgcatgtacgttacatattttgtacgtgggccccactcccccttttcttttttctttttcactaacacatgagaaaaaacaaaattcatattccagcccatatggttcggagtatgtacttgcatgtagggcctcacgtccccacttttcttgtctttttcctttttttcactcacatgagataaaaaccacgttaatatttcaacccatagttgtacaaatataagttattttgagttcgtattgtactatacgcacgtcatcgaaatattcataaaatatctaaataaatgaataatatacattatataatctatctatctattatatactaaaagtccattaaactttctataaacactctcaaacca

SEQ ID NO: 23112 - DNA, 2156 bp, Oryza sativa
tatcttgctctcgtatttttcatttgtggccatacaacacgatatgtatatgaatggcctgtatgatatttaactagcaatagtttattatttactcgagaaaaaaatgattcaaaagtcgtaagtacttaattcatctcctactcaaagtttgtgaatggttttttaagatacattaagaaaaatagaacccttaaataatcataaaatgacattatccgagctttagtttgcccttaatctatgagacaaaatttttgaacaacaataatcttatctttcaataatataagtgcccacgcatgcgcgcgggccaccttcctagttgacttaattcacacacgagagatcaaattttctggcagtgaagtcctgatgttcttcagcagagcatacctatccattttcagtttcagatggagcatgtttttttcccctaaatacgctctattaatggaacctaaaatctataatggtggtggtgattggcagaactgcgactgacatgtgggccatggtataagtataagttatgagtgtttgacatgtcttcgctgtgcccctgcggcttagaggttcgcgcacaattgcttctggcctgcgaacaattcctggatttctgacatccgcggcgccctcaatgtcccaatcatctcccagtttctccttgtttaggatgcggtgcttcacattcagctttcgccgggtgtcggtgatcgtcttgtttagcgctggacgagtgaccaatgctactcggtgcgttcggcgtaccaggcgctcttctatggccagcactcttttgcatgtgctgatcttctctggcacgcgaagggtcctggtaaatgcaaattatttctctggtttgcatttcagcagcgttgttggacggctgatcacctccagaagcgtggcatcgattcagcagcgctgtcggacggctgatctcctccataagcgtggcatcgatagccactcggcttgccccttttgcgctcaggagcttgagacggcgaaccacatcctcttcgattgtgtgttcgcttgttaggtctggttatgggtgttgtcccctcctggctgggctgccctctccccgccccccctggtggcactggctccaggactggtggccatcttctagggcctgtttacctgaacgcctccgtaccggcttcgactccctgatccacctggtctcttggcaactgtggaaggaacggaactctagggtttttgactctgcactctcttcggtctcagtggttttagagtccatcctttcggaaggccggctatggtcgttagcgggcgttgcttcctttggggatttgttgggagtgtagcgtgactctgtcccctcccactgattgaagtagcattacccgtcgtacgtgtttttctttttcttccttgctttttgtctttgttttcttccacctctaggcataagctagtctggctgattgcgttgtgtaacaaaactcttttcttctaatatattgacgtgaattctttttgtgcgttcgtgaaaaagtgtttggctagttttttctgtatttttgtggagtagctgtacgtagtcttactcttttgctagtcttgcattactctataggacacagttctttaattctctattgatttgcttcttgctatcttgacttaaaaaactcacaaactttttagggttttattgtaatttaaaatgagataggcaaaacactttattgacgattacatattttataatcacatcaaaaggcatcttgttatcacgattggagtcatcagtctgtactgaaaactaatatgatattttacttttttttaagtcgaataagccaatattttttcaagagtaaagtccatcatcggtccctaaacttgtaccgctgtgtcatcccggtccctaaactcgcaaatcgaccgttcaggtcctcaaacttgttcgattgtgtcatcccggtccctaaacttacagatcactcgtttaggtcctccaacttgttcagttgtgtcaccccggtccctaaataagacggtctaaaaactttatatcaaaaaataattcataactttttcatgtaaactctaatgaagacaaactttatatcaaaattgtagccctagacgcgacctacaactttgtagttgaa

SEQ ID NO: 23113 - DNA, 8253 bp, Oryza sativa
  unsure (1)..(8253): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggataggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgtcgtttgagaagcactcacctagttgtttttagaaaagagttcaaataaaatcaattgcaaaaacaacagcctttcttcgaagcctgcattaaacacttatttcccatggcttgctgagtactcccgtactcacccttgctctatataaatatccccccctcagttgctgaagaagatgaagcggattctgttgatgaggagttcttccaggagcaagccggctacgatgagttttagggtttcggcctagttcctaagtcacgcctgtgttgattggtccaagtcctggcttccgtttcccttttgtaatgcagttgtgagctcgggatctgtccgcagcccaacatgactgtacctctactctataataaagagacctctgttgctgtgatattctgtcttcctgtgataccagcactatttcctgggactggtatcgattaacaggttaatttagagcgtcacgggctagttccggtcggtactagttcggggcgtgacagattttaagtttttgattgcaaaatttgaccactcgtcttattcaaattttttttacaaatataaaagacgaaaagttgtgtttaaagtattatagataataaagtaagtcacaaaaaaataaataataattttaaaaatttttgaataaaatgagtagtcaaacgttgcagacaaaaatatcttttttaattaaggctgtgtttagttcatgaaaaaaaattaaaagtttggagaaaaagttaaaagtttatgtgtgtaggaaaattttggatgtgatatgatggaaagttgaaaattgagggtaaactaaacacggcctaacagtaaaaaatgcatccaataattaaactgatcatatatacataaatacaactgagacaagaagtaatactcaactggacaacctcaaggagctctgattttttcacaatctatctcatattataatgtacataatggcaacatattagtagcaagcaacacgtacagtggccgagttaactcccgtgacgtcagaacccaccaccaccacccccgccgccgccgccgccgccgcagccgccaccgctgaatccgctgcttgccccatggtcaccggagtagtggtgcccgccgccgccgccatggtctccgccatggtggtgccagcctcctccaccatggtctccgccatgcccgtggtgatggtggtgcccgccgccgccgtggtccccgccatgcccgtggccatggtggtggtgtccgccgccattgtctccgccatgtccgtggccatggtggtgatgcccgccgtgagcatccgagctagcagcgaaaatgcacaaatcacaacaagagagatggaattaagcactgatagcacacgtgttaactcgttcttacctaggctggtcgccgccgccgccatcaccgccatcgccgccgccgtccggcccgtcgccaccaccatcgcctccgtcgccgccgccaccatccccgtcttccctgcggcggcggcgcttatctttcttccttcttgggctgtctttaggcccgtcggcacagccgaacaccgcgatcgccacgacggctaaggccgcggcaaagccgaagccgatgaggatccaaccggcagcaggagcagtagggacggcgccgaagccattgcccgcagtaacagctaacgccctcaccattgttaccgagcaagaagtgtctagctagctagcactgtgttcttgcagcagcagcagcaagcgagaatggaagatggataagtagcacacaagcttaaagtgcttctgttaattaggtgcaggaaaaattaagcacgcatcttatgaagtctcgacgcgttgtttctaaaaggatagcgaatggattttccaaactttgctgagaaattgtgttcgatcagtagtgccccagaggatatcgtcaaaaaagtgtgaaatgagctaaggtcaagccttcaatgttgacgaagagtttgcgatgataaaaacggaaagtccgcagctagacgacttctaattcagagtgtgtttagttcacattaaaattgaaagtttggttgaaattggaacgatgtgatgaaaaaattgaaaatttgtgtatgtaagaaagtttcgatgtgatggaaaagttggaagtttgttaaaaaaaattggatcggtctgaggctgcatacgcgttcagaagttgcacagaaactggctcatcttgacccatgggcacagttatcgccgccggcggcgagctatccgtgtgattacgccgaaactcacccgccaccgaccacgcccacagatgataattcaccgaggagattggacggtgagtcatcgcgatgaggcccaggccaaatgacccagggggatccacggcctggcaagtttttcctcgatatatgggccgaaataggcccactctatcggcctactccatcacataaagcccaccaaatgagacggcgatatgtttgaaaaaaattgcaccgaatgtctctcaacttgtcatcgagttaaaaaatcgttccccaaccgcaaagccagatatatgatatccttcaactttcaaaaccatttactttagatccttaggtggttttgaccccggtttgtccgacgtggcggctgagttagcgtaaggatccacgtgggtcccacatattagggtgaccacgtcaccacccaatctttttttcccctcttctctcctatcctcctctctctctctctctctccgacctctctgcgtaggttggccgtcgggtggggaggaggttggcggggctaggcgggagaggagggcgtcgacgacagtggtgacagcgacgatgctggagaagagaggaggccggcggggtgaggagggagagaaggtccggcggcggtggcaacgatgcaggagcaggccattgcgccgggtggggaaccggctggccgatctcctctccgtcgcccttccccgcgcgcatcggtgacttcgctaccgccaccgtatcatccctcggccctcctctccaccgcgctcctcccttgccagctgccgaccgcggtgggtagggagccggccagtcgatctcctctccgctgctcctttcccgttggccgtgccgaccctcttccccgtcgccggccctccaatccgccgctccgcctgtgccaccgtgcatcaccgcctcaccccgacgacgacgtgtgaccacagcaatggcgccgcacggcacgtagagggggaggaggagggcaggcagacgaccgccgcataataaagaaaaagaatgaaatgaatatcaggccagtccaacaatatttttataatgagtgtctaggttgattatttttctatattatggtatttataagggtagaatggtcatttgattattgttcttgcatgtgaggatgaaatggcatacccacgtgacgttttttttttgtttaaaggactaatgttatgctagatgataaattttaaacatttgtttgtgtgtttcttatcttggtcttatcacttttataatgtttgggtgtgtttaattctatttgaactacactttttgttcgagtgttagattgtaataattggttgtaactctgttgagtaaagaccgggatgttaactattctattattaaaaaaaattattgaaacgtcaagcactaaactaatcctgaaacttcatggattggctattcaccctaacaaaaataaatgagctgccgcacacaaagtacagactaatggtcatgtcgtgatgtatgccacctatatatcccaagttttaagtgagcgtgcaggtcagaagaaaatattagatatgggagaaaccctaaataatctaatgtattatgttgtattgacactgtaatgataggtatatatagagagagtacatatgaggtagatacaagttagaatatacttatctttaggactcccttttatcagtacaattcgtatttaaactctttatctccacctgtacacaactatagctactacggccacggcaatggcgccgcacggcacgcagagaaggagaaggagggtaggcagacaaccgatccgtgcaacggtagccatcggcggcgccacccgtcgcatcggctatcctgtccactgcgctcctcccctgccagccgccaaccacgctggccctcctccctgccgcgtcgaggacgccgccgccatcaacgcctagggggaaaatgagagaggaagggagagaagagggaaaaaagagagagggtggtgatgtggtcaccctgacatgtagagtctacttgggtcccacgctgattcagccgttatgtcagataaaaccggagtcaaaaccacctaaggacctaaagtgaatggttttataagctgagggatgtcatatccctggttttgtggttggggacgattttgtaactcgatgacaagttgagggaccttcggtgtactctaatgataggtatatatagagaaagtgcatatgaatatatgatgtagatacaagttagaatatacttatctttaggactcccttttatcagtacaattcgtatttaaactctttatctccacctgtacacaactatagctactaacacccacctccgccgccgcagccaccgccgccgccacaaccgccaccgcccccatggtcaccggagaagtggtgcccaccgccgccatggtctccaccatggtggtgccagcctccaccatgatctccgccgtgctcgtggtgcccgccgccgtcaccaccaccatcgcccccgtctggaccgtcgtcaccgccgccgtcatcgtcccggcggcggcggcgcttgtccttcttcctttttggtttctgtttaggtcgatcggcacagccgaacacggcgatcgccacgacggctacggccgcggcgaagccgaaggcgacgaggacccagccggcggctggagcagtagtaggcacggcggcgaagccattgcccgcagtaacagctaacgctctcaccattgctacgtgagcaggaataatcggctaataaccttttcttcttgcagctgcagataattaacgtactctcaccattgttaagtacagcacaagctcttgtgttacgtgcagaattggagagagagagacattgtaagattcaacgcggttttctgagtcgtagagaggaattggaggagttgtacagactcttccttgaggaaatgtcgtaagcgtgtgaaatgagatcatatcagcctgaattgctgacgagtttgctactatatataaacagtggaatagtcaataagtacatctggcagctatacgacttttcattcaaccccccagatcagatcatcaaatgtctgttcacagaagttgcacagaaactgggtcgagctcatcttgaccggcggcgagctttctgtgccattacggcgaaacgcaccggcgccaccgaccacgccaacagatgattcaccgaggaggctagtcccagaacggcgaggccgtgccatgcggcccagcccaaataacccatggcaatcacgtccgcaactgaaggaatctgtaatagcaggtgatccattaaatctgagccacacagcctgatcgaacggctgatagagatcctgggggttgggagttttagactccgaccccctcgaacacccaaaatcaccgctctgtccaatttaccagccgctgacagttcgcgaggagcagctgatcaattaatctgagccgtacagttcgatcgagcggctggtagagacccatgggggttcggagttttgaaccccgcgcgacccccattcgcagccggaaatccaccactgcgcgtctgcgcctcatcgtagctctgccgagatcttggctgcgtcttctcccttctcctgcctcatcgagctccatatggccgcactccatccgtccagcgcctgcaattctgaatttcagatttagaaaccgtgcttcacatcgctctgcaaaggagacttaattcctgaagccgattaagaaaccgatgattcagaaagagaagaagacacagcaatgcttgggagtttcaccattgtttttcagacgaaccgaacgagatgaaaatgaagtatcatcttgttgcttgctgatctttttacagcgagatgatacgtggagtttcagtaaaatattcctggtctgtccctgatagtcagataagagcttaacaaccaaatctttaatatgaagatgctccttgggtatttgcatgctagctgtttgcagcacgcaggagaggaggaccagcgtagcaagactatgcgctattgcatccatcgtctacggcataacaattgtctggacattgctgctggatacctctttgtacctcttaaactgtaaaatttctttggaagacttagcgcgaaagtctattctgatcactagatacaaacaaattaacttgaaaaaaaaatatgttggcgtacaacaattgcatgctcgtaggagcttagcgccgtaaataatcattgtttttcaactagaaattacgtaaaagagatactgtaagctgcttaagccaagatgaaaatggaagaggcgaatttgatcgtgagtcaattaaactgtactgttattactcactatcactgccatagtagtgccatgcataatgaataatccataccacgaatcttgtcttgatcaactggatccgtcaattaacctccgtctactctccacctcctcctccgtctgcgcctccaccgccgtctgcgccgcccccgcaaccgtctgcgccgccaccatcgccaccgtcatcgccgccgccgccgccaccgccgccatcaccacctccatccccgccggcgccccagcaacaacaacaggtggacctccgggatctgttcttgcggtcggcgtatccacaaaggagaatgaccacaatcgctagcacgaacacgacaatgcctgcagccgaagcagcagcagcattggacgtcgcgttgggcacgagaagatgttgctcgctagccatttgtatgatctcttcgatcttcttcgtctaattggttgatgattagggataaaattaaattaagctgcaagctagctcgatcgagtggtaattatatagagaggccttccggcgcattaattatgttttctccgactttgcactctagactggtgctagcgtgtagcgccttgcagatgtgtgctggatcgatcgatcactggagacgacgtctacgactttgccaatcgatcccaatggaaaattggaatgcattggtaggatagaacatgggccagtgtggatgctgctgaccttgacttaatttaatcaagctcagcctgtatttgtatactgtctacgttgaccatgagaggggcagagatcagcttcacatgtatacgcccgacggcctgacattgtttcagcccaactttaacgggccggacgttccttgccttttcagcccaactatacgggccgcatggcccatatgagaatatactggactattatgcgtacgtcgccttcctgcggcccagttttagtggtttgatgattaagatccggaataagttcactttgtaaccctgaaaaagtaatcgaaatctaatccgtgaccctaaaccacaaaaccggatatctagacccccaactcttaaaatcggtgcaatttgactccctcaacagttttgaagggtggttttgctaacgtgacg

SEQ ID NO: 23114 - DNA, 2792 bp, Oryza sativa
atcctcccccccccccccccccccccggcgcgtcttctctctatctctcttcatcgcataatttagctgtagctccgcttgttgatccgtagctggcggatctgcttcctctatcctccccatcggaattgttcgtaccgtcgcggaggcgctgttgcattctactgataccaagattacaactacagcaagatcggatgagagagctagctgctgcctaattagtttcgagatcaatgagagttgctagctggacagggtggttacgtacgtaattatatatagggttagatcgtacgtggtgtgtacgtgcagaactgaagagtatgttataatgtcaaattccatttgctatcacagagagtataaattttatccgtcaggtttgtgcttcgcgcttacggaaccagccggccgtaattaaagtactgttagcttctctctttttttttctttacacgaaactttatcatgtactagagaatagatagattcactgtacaatgctgcaaaagtatacagtaatactccgtattttaattagatcgctggagacgatttcgcaattcacggattgatccaagtcgacggatggggaaaatgtcaggaaagtggttcgcgctttgcttgtcacaccatttcggcccaaccaggcaaccacgcgcgtgggccgtgccaccaggggagcgaacgtacgggccggcccgcgcgtggccgctgggctgacgaagcgcatcgatataggaaagatcgagttcctccctttaatagcaaaaccgggtataacgtatctcttatcatttaaaatcagtgtattgaaagcagttttggcttacgtggtactaaagttttcatctaaaaatgttcagattggagaccacatagccttgcaaaaacattataaagcaagaaattgtgtactacttctacttgattaggacttttgcctctactgaccaaggtttttgtttcttcgcgaggaggcgcagtagaataactggagaagcatcacaaatctgtatatacagcttgctcttttttgttcttttgcaaaatcttgatttacattatctacacttagatcatggttaaagctggactactggagttgagaacaaaggtaatcttgtcatggatatttatattttgcattagaacagaggcaatcttaccatttgggtgaaaaaaaagtgaatatacattttctaaatttatatttatatacatgtttgtggggggaattatgaaaatatacatgtttataaatgcagacgtgaaaatattacgcggcataatattgaacagattgaatccggttttaacaattgaggaattctctatatttgattttgcggttgaagaatacgaattaaaatgtgtctatatatgaggcatgtaaaatgaactttttttctggaaacaaatactgtcgttggacaaaacaaaggttgccgcacgtggatggcaatcacgtccacaccgcaagagccgtgggaaatcgtttcaaatgaagagctgtcatagatagacaatcatctgtgagactgtgatggctcttgatcctaatatatctcttacggtagatttaagcacccgtcacagatataattatttgtaacaactctctaagagagccatcattgataactctttttttttcatttttgttacatcaaataagttgatcatgcataatatccaaagacaaacccgttatgaaatgatcttacctcatcattttttatgcagtttgcaggcataaatggcatcctctactatactcctgaaatacttgagcaagttggtgttggaggttttttctcgaagtttgatcttaattagttcttctacatctatacttttaagtgccatcgcaaccttagtgatgattccttgtattggtgttgctgtgccgttcgtagatacgaaaggaagaaatttagtattctaatatttataattactttctccgtttcacaatgtaagttattctagcatttcccatctagacattcattaacatcaatatgaatgtgggaaatgctaaaatgacttacattgtgaaacggagagagtactacttattgtcattatttaattaaaaagttaaagaaagtacaaaatggtaatttttctccctcgcttcatgcatgcaggcatattctccttggcacgatacccattctgctattatccctagctattatgcttgttgctaatattatgaatatgagcactgatttacatgctatcacctcagcattatgcgtaatcgtttatcaatgtgtttttgttatgggatttggccctattccaaatattttgtgtgctgaaattttccgtatagtccctcctcattcacaagatccatggatacccccggagcaccctcttcaatttttttcaccatgaatgataaactaaaggtccctaaatagttggaggttgaagaaactgtataattgagcccccccccccccccaaaaaaaaaaattctgttcatggatccgaccatgatgcttggtaatatgtagcctagcattttggatttgtgataccatcgtcacatacacttttcctgtgttgatgaatgcgattggtcttgcgggtgtttttgggatctttgctactgtttgtgcactagctaactatttgtatatttcaaggtgccagaaactaaaggtatatacctcttgaggttctgtcggagtgttttgcttctaccaacatctcatccaaagatgattcgaaagaagataagtaatactccctccgtatttaatgtatgacgc

SEQ ID NO: 23115 - DNA, 5489 bp, Oryza sativa
  unsure (1)..(5489): unsure at all n locations
tttgtcagaaactatatcattcctactcaaccacagagcctaacaaatggcagatgctccaacaagtatgagtttactcatcttcttgtgaacccctaaaagccaaccatctaacatattagatatggaactagagaggtttaaaccaataaaaaactgtactactctccaaacaaattttgcaaaatgacagtcaagaaaagatgttatacggtttgcaatttgccatggcttggagccttggagctgactgacgaacggttgacatgtcacgctcaaagcctctccccccataattgtcccatccgatgcgaacacactcacacaaacagggagagccgcttgctgcattcattggcgtgcggacagatcgccgcccagcaatcagcggcaggccaccaaatagacagccacaacacctatcaacttatgggagaattcagccgtggaagaagccggcagcagcagcagtagtagtaggtcgatttggtttgaagagccaaacaatgcccacgagatatggctatgctgatgagctgctgaggcagtgatgtgtagactgtagatcctatttaatatagtttaagattgtaaaaacagttggttagtagtcattttctgaaaaatctgatttctattttttttccattttgtaactatagctattaaaatccaaaaaaaaactagactaatttaaaagaatttttaattttgatagaagttgtagaagctcccaaacagtcgaagtagctatggtgataatactctcttctcccattttaagtggtagttgtaaatttctgtgtttaactttaatcggctatcttatttaatttttttttatgattagtatttttgttgttgctagataataaaacatagtagtactttatatataacttatttcttaattttttttataaaatttttaaataaaataaatgatcaaatgaattatgaaaactcgtgactgcatttaaattaggacgcgcgaacaaagcattggcgtttgcttccgttggcggctgggacccaactgtcccgcgccgggagcacacgcgtataaaggacggtaggagtggaggcctcgccgggctcgcagttcgcatcgcgctgttccctcctcggctcctcgcgcaggagcactggcacggacagtgacatcgtcttcccttcacctcctcgtccttccctctcgtggcatcgcatcgcatcgtgtcctctgcgactgcgagagtgcgtgtgtgcagcgcgcgctcgtcgagacagacagcagcagcagttgctctttaatgccggtgccttgctgaacagagcaaggtctctccaatggccttgaggcattcaatgcgcccgtaatccatctcttgaacggccgtgtgtgtgttcttggcgtgttggtgtgcgtggattgggtgggtgaggaggatgaactatctcaggagccggagcctcaagcggctcctgtctctcggtcgccggagcaacaattccgatgagtccaatgacgagtgcgtcttcgtcgtcgaccagccgccgccgtcgaacaagcctacttggaggtgcttctcgtatgaggaggtcaacaaggccaccaatggcttccaccgaggtacagtagatatatattcttgttggtttctttggggatttggcattgagaacatggcgccatgacagacaatatggtggggagaggcgggtacggcgaggtgtaccgcggcgtgctggaggacgggagcgccgtcgcggtgaagcggctgtcgccggcggcggcggcggacgagaagaaggagaaggacttcttgacggagctcggcacggtggggcatgtccggcaccccaacgtcacggcgctgctcggctgctgcgtcgaccggggactccacctcatcttcgagttctccgcccgcggctccgtctccgccaacctccacgacgagaggctgccggtgatgccgtggcggcggcgccacgggatcgccgtcggcaccgcgagggggctccggtacctccacaagggttgcgcgcgccggatcatacaccgcgacatcaaggcgtccaacgtcctcctcaccgccgactacgagccccaggttcttcctcctcctctacctctcctctgctcgctatctgttcgtccggttgctcaccgagaaagaattgaattcgcctcagatttcggacttcggcctcgcccggtggctgccgtcggagtggacgcaccacgccatcgcgcccatcgagggcaccttcgggtgagcacacatacgttctccatggaccatggccatggcagtaaaaacagggagacgagacgacgctgagccgacgacattgatgtgcaggtgcttggcgccggagtacttcacgcacggcatcgtggacgagaagacggacgtgttcgccttcggcgtcttcctcctcgagctcatctccgggaggaagccggtggacggctcccacaagagcctcctcgcctgggtacgtacgtagcacattcatacgccatcgccgccgtcgcgtcgcgcatcgcacaacacgcgcacggcggcgcgcttgtggcggccaggtgttcggccagggacattgacattggtgccgtggcgcgtgcatatgcaggcgaagccgtacctgaacgactgcgtggcgcaggggctcgtggacccgcgcctcggcgacggcggctacgacggcgcgcagctcaggcggctcatgttcgtcgcgtcgctctgcgtccggcccgccgcggcgtggcggcctaccatgacacaggtaagaagaaaaggaaaaagaaagcaaacatttttttttctgcaactgcacttgctgttccatctaggagtagactaaattgacaacaatttagaatccataaataaatgtgagagaaaaagcatccggattgaactgtccatgttaacaagtacagtaaaattgacactgaacaataattgaatttcattattttcctaccaaggtactccactctagtactagtactacaagaaatggaccattcatcattgtgaagggtttctttgctgacatcagctccgaaatggcatggtagcttgggattagttggcgacctaatcgttctagagtgtgcaaaacacttagcttaggaatgttagagtaggtctgactctgatctgacagtctgtgtagcattgcaatgcatgggccaccaaacaaaatctctcaacatcacccaaagaggacaagagctaggaaagctttaattcctttgtggtgtggtgtgctaattgggttgctgcttgacccagcaactcaaataaatatggcattgcaatttgcaaccactgcaatcttcttcagtagattgttaattacataggggaaacttgatggtttcttatggtggcagagtctagttgattttcgttggagtttgcgtatccacatacacattggttgtcaatcttgttcaggtaggttgttaattatatagaggaaacttgataatttcttttggagcatagtctggttgattttcgttggagtttgcatatccacatacacattcgctataaacggtttgtatatggcattatggtaggttcaacagctctatcaaaccatacaacgacatgaaaaatctcaacagaaatcaggagaaccggtatacaggaataattgttaacggctggtggataaattgatgaggggatctagtctaagggacatcattgtattatatggattatcaagcaagttctctaataacactggtctaaaagaagttcactaatagtactcaagtcatactctgtagatgacctcattacttttttcatggctggtgctaggtagctatctcactcaagtataattctcctatctgaagttatattttatacagcataatctgtatatgcttggtctaatcagacatccgggtgccctaatgcaatggcaatgtatgatgctaatgtgattgtcctactgctactagtctaatccatatcatccacttgcctcctatggttgttaaatactgccacattgtgttgtgtcagttgtgacagccactcctttggtttttattttatcttgctagcatctagcaagccagttggcgagtaacattgcaccaaacttgattgcgtataccttgtcttggtctgtcatagtgtggtgagatcccatttttaatgtgaaactaattgaatctctttcagtaggattccacagtgtgtgggatgataatgtttgtttatgtactacaatacagaaacagaggtatcagttatgtatgaggatatcatacatgaaagaataagttgaacctaaggaaggtagcttgaacacatcaatgcatatcatcaatattgacttctttgttttttccccccaaacagaccctaaagcttgatttactcttcaccttttcgtttcgtttttactacgtaaggcccacatattgttgtgttccaatacttgaaagtttcaataattcttgggtattttccaaaaggtacacactataaaataatttcaaaaactcaagcaacaaaaccgaatttttagacagtaaataaaagatggtaagtatcttgtagttctcaagttcttagtattcaaagtgcaattttactttttccagaccaaaggatagtctgatgaagcaaggggaaaaagaactctaaatattgttttttagatggaaaatataacagcattatcatttcaaagaatgtataacttcttttatggacatattgtattcgcaatctttcgtaatagatggtatttacaagtcaccaacagttgcaaccagaattactcttttagtttagaccttcaagacttaaagcaaacaaggggaaagcttacccattcttactagaccaagtagttgcacaaagccacagagtaatcttacaattttacttgacttgagaagaagacaagagtttggcctcatctaaaatgtggccggtttcttgattttagaagggacattggatgctctgtagcctcctaccttctccattatccttttcttccccccattgattcacgagaagcccagagccaggtgaagtgggggacacaggacagctcaagaacataaatcttgggacaaacgtacaaaacatgccaccccaatgtgcacatagaaaacttggtcacctctaatcaagatttaatcatgcactactttattagtattgcattgcaccatactaccattggcacacaagctacctactgtgaacagttactttggttttaacttccaaatgccttggaaggtggacatatacatacattcagactntcagtgtcaataccatgttttcagaaatcacaactaaatttagcactttcagcaaataggttagcaagcagggttatgcagtttgttaacaagctattgcttacaactgaccgacgatatctagttgaatntgttatgagaacaatcttgattttctgagcaacaaacttgatttttcaat

SEQ ID NO: 23116 - DNA, 2298 bp, Oryza sativa
ctgccacttaataaatttgcaactgtgttgtacttaactggctcggttcacatggggaaatggcaggtcctggagttattggagtccggcgagatatctcaagatcaatggctgatgcccgaggaggaggaggaagacgagttttgggatttcgacgatctcgacgacttcgaggacgacgacgacgacgatgatgacaactatgataacgacgatgaatcggattctccctcgatatcgtcgtcagcgtgcagcatccacgccaatgattagccccaaaatatttgagtctgtcagtcttgacagagtgccccaattggttttggtttttaggggatactatgatcgatgggattatattagtgtacataaaccacctagacaatagtaaattcagaaaagaaaaaaaaactgttcaggcccatggttttgatcatcatttcatgtctccattagcaagaatctccttgttaaaacccatactactaactccatcagctgatctgttcatctgacagtgatggttcagacggtttctgtcaaaccgtgctagatgaacagactgacacaagtttgtcatgatgccatgcccttggcttagctttctcccaaccaactggaactgttgttggtttacagtttcctgtggatggattggattggattggagacgagctgattagggacatgatagtcctttcagttaattgtttagctagcaaccagcacatgccaggcaccggcaggtgggcttcggtttggaatccgttggttagctcgatcaggtctcaagtgcagttgggcgaccctgcttagctgctgctgctttatttgttcgtccttcctgttcagctagatgtcgatcgatcaatgaagtaaccaagaagtcattgagcaaagttcagattggatcatgcagttctgtcaacgcaagaagtcagtcacgtttcattggactcactaaaaatggctaaaaatcaaaataaaaatatggaatgttagtctgaatgtctggagctcaaattggaaaaggagttgaagaattgaactgtatcatctactgccgattaagctgaatcactgtgcttggcagagatcaacagtatacgcattgacattcatggacctgaagaaatgtcgccgatccatcgatcgatcgatctaccagtggccgtatttgtacgtgaccaccaccggtccatgcaagatgcaccacaatgatagatgcaaacctctgaccaccactcatcgacatatggttggttcgttgtcatctcctgcttgccagatctacaaattgctgctacaactcgtcctagtttggaactgtagctacgagcctacgaggatggacgagatgcttggtgcccattggctcactcactcacacaggtccaagctagctactagagctgtagttaagctcaatggcccaatgtcattagtgctactgacagtgtgagctgcaacatctgtaattagcaggaccagcttatcccaaacagtagcaatgcagtgtcatacagtattgattcctgtgagcactgtgtaccattcatagggcttgtggtacacttgtgctagctagtatgcactgacaaatcctgatgatttccatgcgagttgaacccagcacatggagctttttgttcaggttaccgattgatcgagcagctaagacctcgagcattatgagatcgataagcatagcaatcgatcccgtgatcatacatgcagatgatgcagtggcgtgcgtgacactataggtacgttgttgctgaagccgaacatgcgatgctgcgtgcccgtggcgcaatgatccaaaagattacaggcttgcacgatcgaccaactgtttttcatgcaagatgttcagagagacagatagtgatatgtgtgttgttgtgtagatgcatgggcctcggctagaaatgctatttcataccgctacctcgtagctaccacggagagctatcgatcgaatgctagtttgtagtaggggtttgagaaatgatttgtcaattgcaatttggtaggggacaggtgccagatcagtgatggttgttgatcagtagtgtccgtcagaaaagatatgtgggtttcgatcttcagtttttttaatgatttaacgactaatagaacttttctacgagactacaaattaaatatgttcttatagttcttctggataccaaagcaaacaatattatcagggatagggaagaaattagcacgttctgttcgtttttttatctgaacctgaatgcatggcgacgaactgaacaattaagctcaaag

SEQ ID NO: 23117 - DNA, 3034 bp, Oryza sativa
gtcaacttttgtcacgctttgtggctaccaatttattcattattttctttttgtctatcaaaatttgctaaaccttagttgtagtaaagtgtggctgacaacctaatacatcgtaagatgctagccaaaaagttcaaagatgcaaatgataaagatgaagtactgaactgggctaaacacaagttcagataaggcccgatttgtggtacttaccaagtgggccaactacacaagaaattgggccgtcctccccggcccaatcgacccaataggtaggtactgcttccatgtattgggggaagcagagagatccccgaaatcaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccaccatcaacaagcaggtcaggccccccaatccttccctcctcgctgtttattttggacctcatgatctgaccacgctttagtgttgctccaatctaggtcgttatctgctttccctgcctgaaattgtatagctaggaacactaaatcataataataattagtagtgccacggcgccgtctgctcaaaagttgtgcgggaggaagtatttgtggttaaatattgttagtgccacggtgctgtctgctcaaatgttgtacgcgagaaagtatttgtggtaaaattttgcagtgctgctaatttggtgttcattgtgtcacccttagattggttcgcaccatgctattgatcataatgtttctgaggtctcagtttttgctaacacattgatgactgatttggtatgtttgttgtgatatttgatcctagggataaaaactacagggtataatatttggaagttttagttgatattttagcactttgaactggtggtatttactgtttgtgcacatactgcattgtataatctgtttcatagcatttgttgtaggatttggtagtccccatactgtgtatcacagccatcttcttctaggatttagtcatcttagaattgttttgtgtccatctgatcatacataatctttggggtggctgaaatgctaagggggatcttgattttttttccttattctatactttcatgttctattcaaaattcattacctcgtgatcattgagctccgaaaatgagaataaatcgatgcaatttgctatataaagttacctaacatgcatatattcatttggataggctggaaggttggagaatgtggttggctggtatcactcacaccctggttatggatgctggttatcaggcattgatgtgtctactcagatgcttaatcagcaatttcaagagcccttcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacaggtaactaacttatacgtctatttttttcctcccttgcccaacaaatgatctaattctgttctaattgtgttttgtgcagtactatgctctggatataacttatttcaaatcatccctggattctcatctccttgatctactttggaataagtactgggtcaatacgttatcttcatcacctctcctgggcaacagggattatgttgctggccagatatttgatttaggtaagaaatttcttttatgaatatttacccaaaaagaagtacacatctatttttgttttaccatgagaccagataaagttataaaccaatttgtgctatgcagctgataaactagagcaagctgagggtcaactggcacacagtcgatatggcatgcttatgccatcgcaacgaaagaaagaggtcatattctttaccatctgctgttcttcgtcactttcaataatttgtggtggtattgtatgcttgcaacttgcaacctatgagataaatgccaactatatttgaaaaattccatctgctgttctttgtcactttcaataatttgtggtggtattgtatgcttgcaacttgcaacctatgagataaatgccaactagatttgaaaaattgaacataaagacatttagttatgtaaatattgaattagtgacatcatgcatgggtcagtttgttatgtgctagggctttctctcatgagaaatttgggaggaagctatagctgtcatacttccattaggaccattacttctgttatatttggagtactgcaattgtgttgctctgtacttgtgttgataggagatttcaagctgagtacgcagattgatgatagtaaagtaaaatacaagatattaatatgaaagccatctgagtgagactgggaaagtatgatccagattatgttctgttcagagttgcaacttgcaacaaatgggttaaatctatattcgggataatagactaggattgaactagtcaaaacagttctctttcttgcaaatatataaatcaatttgttctttgttattggatatatttgaattatgtgtcctcaacatttggatgtttgacccatatgtctataacacacatatttttggatttcttaagaattattgcctattctgctc

SEQ ID NO: 23118 - DNA, 13860 bp, Oryza sativa
cactgggtgcctagttgtttcatgactaaaagctgtgtccagcataactacccgattcaaaatgcgttagctgcgctttatcgtcaaatcataactgatatgtaatcatgagttgccttctgaatctttcggctgccattgtgaaggtgcgtggtctacgttaagataaccaattaccttggcccaacttaccatgttctctcaacaatgaatggtcccaacgtcgctaggcacagtgtatgttgatttggatgatctttctggtatttatcctccgattttggtttctatatttccagttcattcactgtgtcaggtgctacgggtacagccgtacagcattgttgctttcaattaacgtcagaatttgtcttatgattattgtagggcctcgttaacttggtcggtcaaataattcgttcccacttcgaagaagaaaccaaagaccttatcaattaaggacaagtatattactttcaactcacgacttcgtgggatcttccactttgacatgaatatcttcaagtggagaaatataaacatttcattttgacacgttagcagcagtacccagagatgctactttactttgtttaacaatatagtaaaatatagtaatacgttttaaataaaaagagttacatattatgatagtttgtttaatgataaattctagtaacatcaatatgggtgggtctagtcgtcaaacgtttgcattccacgaacgtttaataggtttcgtcgttattcgttctaatgactcgtttaagctcgtatatggtagttagagaccaaccaatcacttttccctactatcaaatcgattttatttcttgaaaaaaaaatccggtgatgcttagattttttatttgtactgaaatttatacatgcaaaatataattcataatatgaagttccattaaaaaagctataaaaatgactataaagaaaaaaaaaagtaatttgaaaaaaacagaatgcaaaaacaaaaaaatgatacatatcgcttcgggagaatcaacgtaaaaaaataacgggaaattgaaaagattcacgtaaaaaggagaaaaaaggaaattaagaacagaaaaacgtagcgacacaacctctcacgcatcgccacgtatcttcgatcctccccagcctgacccgttcacgaggatgagcggaagcgaacgttcgctcattagtcatccttcatcaattttacataattaatcttttttaattttttttactattaatagtcaaagttgaaaatgtttgacttccaaaaaaaaagaaaatgcttatattttgggacggagggagtaatcattagacacaaaggaaattattttaaaaaagttaaacgtaatattaaaaatccttcgaaactcactctaagaaatttcaaaagaatttaagagactcatcccttctttccaaaggaacacatgaattctttccatatagtaatctaatcattcaatattcccccaaaatttggtactttcaaagaagctctacatgcataaaatttggtacttttaaagaagctctacatgcatagccttactggtggctatagccttgaacgatcaatacggtgctatgtatcatcaacatacaataagacctaacatagcattattgtgagttttagacgggttccactgaagtgtattagcttgcccaatatgtatatggctagaggggtattacggtagaccatgaacctcataggattagctactgggagagagagagagtaccaccatcatggaaaagaagaattttatagcctttaagaaaatatcctaaggtagtttacactataaaatatggtgcctctgttagcttttcaaggatggaaaaattgcccatttccgaataagtataatgtgcatggcctaacaagaaaaacaattcaagtcttcaacacggcagacgcaattgatgcccccaacgtcgccaacgagactcacgactgctgcatttgctgctagctcatgagtggcgtagagatgatgttctatcgtgtccaacgagatgagcttatgaacaaccgtgctcatgctcggccgcctgctaggctcaccgtccacgcacgaaaccgccagctccagcaacccggctgcctgcacatggttgaagtcaccgcgcagccgcgcgtccacgagctcctccagccacgccggcagctcgccgtcgtcgcacttcagcttctccttgagccacacggccagtcgctggacattccatgccccgtcggccgtcgccgcagccgctacccagtcgcacaccctctgccccctgaccagctcgaggagcacgacgccgaagctgtacacgtcggctttgccgttgatcgagcgaccaactgtccagcactctggcgtaatgtagcccctggtcccctgcacccgcgacagcgccatgtggctgccggcgtcgcggctcagcagcttgacgaggccgaagtccgtcaccttgggctcgaagtcgccgtcgagcaggatgttctccggcttcacgtcgcagtgcacgatccactccaggcactcgtggtggaggtacgccagcgccttcgcgacgcccacggcgatcttgtacctcgaccgccatggtaacaccaccacaccggagctctcgccgtcgtcgcagaagagggccttgtcgagcgagccgttctcgacgaactcggagacgaggaggcggtgcgggtgctccgagcagaagccccatatcctgacgaggttcatgtggttgatccgcccgatgacgctcagctccgaccggaacacctcgtcggcctgcgtcatctcgtccagccgcttcacggcgatgctccggccatcctcaagaacacccttgtacacggatcccgtcccgcccttagcaatctcgtctctgaatccgcacgtcgcgtctgatagctcgtcgtaggtgaacctccggaaatggctaaacaccaagctgtacccttcatcaccgacccgtcctgccgccacggagtcagctcgaaagacaaacaggtaacccacgacgacaaaaatggcctccacgacgaacacaaccgcgaggaagctgtagaagtagatgaagtttatcgtgttgcgcctgccatgaaggtacgagctgctgaccgtagcgtcccgttcgtccatggtgcaggtgtggccatcgaagtgcagcaaggacgggttcaggttcttggcacccgtagggaacttgaggtagatggtttggtacggaatgctcataacccggccgttccagagagagatcttggggtagcactcaccggtgccctgccggtaaccgaacgcctcgcagcggcagtcgacgaggcagagacgccggcacgtgtcaaacgagatcccggcggtgtagttgaggtcgaagccccagtagtcggtgtgccgcatctcggcgaacgcgacgtcctcgccgcacctgacgtcgaacgtgcgccggcatcccttgctccagtcgctcgcgtcgtgaggcacatagccgtcggggcaggagcacgtcgggccttggctgtacgtgcatatgccgtagcggccgcacaaaccgtgcacgtcgcactgcctctggaccgcgacccacgtgacgtgccagcgcccggcggcggcgtcgaggctgtagaggcggaggttgccgtcgtagtcgagcgtgagccgcctcatgacgcctccgtcgcccatgtcggaggcgttgaactgcagctggtcgctcgccgtgaagacgccgcggcggtcgaagctgccgtggcggctgctgttgaacgccgtccggttgttgtcccaccacttcttgaaggggtccggccagtagttgctgctgatctccggtccgtcgtacatcaggttgaggatgttgctgctgtcgaagtagaacttgtagtagccggagtacggggagcccctcgcctcggcggacacgagctgcctgtaccgcgtcacgggctgctccggcaggagcgtgtccgtgggccagtcgaagctctgccacagccggttgccggcggcgtcggagacgacgaggttgccggtgtcgaggagctgggcgcggtcggccggcgtgccgctggtgttggtgctccacacgacgcggccgtcgtagtcctgcagcaccagcgagccgtccttgcggagctcggcgcgcgagccgacgccgttcacgggggtgtcgcggttggccgtccacgcgacggtggcgtcggcggacgcggtgaaccagacggcgagcgtgtaggcgttggtcgccaccttgtagaagccgcacgagaagttgccgctcggcgacacgaggacgctgtcggcggcgtcctccacggcgatggagccgccgcgccacagaacgctgcggcgatcgccctcgcccgccgaaagagcaacgcaacacagggaggtgagtacgatcaagtgcaagccatggactcgattcatcgtgtatcctaaccccacagggctggaggcgtgagttccaacttccaacttaaaaactggtttaaaaggggaaagaatgtggctagcctgctgacagtgacatttcccaattgagatagtgtgtaccgtcatttatttaaccattaatcttcactgtcactgccggcaagtgaacatgcttcttggtactcccactggatggaggtagctccttggtacttgaccggtggattagtgcagttagagcaagtataataatgagctataagcttactatgagtttaggtggaggagagatagtgaaaaattaagggtgttggctttcatgcaagagctaacttatcacaaattccaagacaaatacattaaatgtataagtgagggatagctagagagaagagaaaacaattatagccaaccttataactaatccattatatatgttgactttaagatatgctaataataagaagtgagctatactattatttttgctcttagcagcctcagcctgcagccagaacagtctggcagtcaagcaccccggtgaaagtagttgtactcaaaagagctaaacatcgttagtactacagactaattgacagcccaaaggccgccggcaacgcagatgggcaattacttgatgctgtggggaatgactttcacatattggtatatcttaccattttttttattttttattactttaagacagcacgtacaaaagcgacaaaaatccatctgcgatgctgtaccaaactactgaaatgggcttgcaaatgtgctattataagggaggggcatatttaccgttagcaagaagccactactattcacggtttgcaatgtgtaaaactttaggccttgtttagttggtgaaatttttttgtttggttgtcgtatcggatacacgaacatacattttaagtattaaatattgtctaacaacaaaataaattacagattccaccaggaaactgtgagatgaatttattaagcctaattaatccgtctttagcaaatgtttactgtagcaacacattattaaatcatggcgcaattaggcttaaaagatttatctcgcaatttacacgtaatatgtgtaattggttctttttgcctatatttaatactccatgtatctttccaaatattcgatgtgacagcgtgaaaatttttgtttgtaagaggtcctgtttagttcccaaaacatcatttttcacctttcacatcgaatgtttggacacatgcatagagtattaaatgtagacgaaagaaaaccaattgcacaaattgcgtgtaaattgtgagacgaatcttttaaacctaattgcgccatgatttgacaatatggtgctacagtaaacatttgctaataatggattaattagtattaataaattcgtcttgcagttttctagcagaataatttgttttgttattagactatgtttaatacttcaaatatgtgtccgtatatccgatgtgacacattgagcaaatttttttttgccaactaaacaaggccttaactctcaaatattttaaaaatatcttgattggacacgagaaataaatgcattgataaatttttcagttacgatattgtgtgaaaagtcaacacatgtcataaatgaaagtataaaataattatttaaaaatgtaaactgcactgtggatccttgctgtgcggttatgtcacgacaattttcattttatctcttcacacctgaacttgactacgctaagcggcatatattctgtttttgtatccatttctcaaatctcaataacatgcaggttagtgagaatgcatttatgcggccatgcgggtgaagggaacatacaggaaatatcttactactgatgttcaatttttgtctgatgtacttgtagaatcatgtgatgattaattttagtgatgaataattttcaaaggtattaagtcaaaagaacaattgtcaaaggtgaatgtttattgaaaatatgttgaatagtgtttccggattatgaatggtgttgttggctctgagaggttggtcagaccggtggtgttggtgcggtttgatcgggtagcctgatggtcagactggcaaatttcgggaaggagtcggttttgggttgtgtacatataagaagaggaatcaaatttggattggaaatcaagtttgagataattggagtgtggagttatatggggttgttgtttccctggtttccctatatgattagaaattctagttctatttggattcatggctaggggaagccatatttcaggtataaataacagaggggttgaggttagaaagatattgactttttaggataaaaagttagggtttgtttagcaactttaattctaattcgtgagttaagagatgagtgctttatatgcactttgtaaacatattgatgtaattataaagttaatataatttcaaaagttttattggtttgtgtttttctggatcccggtggtctaatcggagtacattgcgtggttagatcggtggtggctgcagcggcaagagcatcggcattaagtaggaaggcggtctgaccggaggccagacactgatctaatcggcgggtagacgacggtctgaccggtagtgtaatggtggtttgaccagcgatgatctaattcgaccggtacgtcttgttcagagtctccatcaagtatttgagggaaatcttttacttgtgcaaaaagatttgtttttcaatgtccctaccattcactccctggtaggcatagatgttgttattcactttcgagtatgaataaatcatggccacagttagcctgaatatttgagcattttggttcatgcatcttatttgttgactgttggataacgtactctcttatatcacttaatttctctaacttttcctattgaatttagatagccaaagtaacaccggaaaacaaaaagaaatagtgactacaaaaactatgtttggcaaaattcaaatgaattagggggcatatgtatatttcaaatgaagagtcgtgtcaaacaaatataggaggctttccctgctttaaatggttttcgagctattttcatgaaaactgacaaaaccgctcaagagaagtttttgatcagtgaacggttttgtaaaccctgactgcaacccatctgattaggaacatagttcagcttttcattctctacattagaaggaaataactcataattctattatatacacctacatttatatgaaaagcatataattttaataagtggaaataagtcaaccctaaagagatgtagtttgactaccactatgggtgtatatactgtgtattttctgtagccataaaaccatatcatcctagaactaaatgttgcaacttgcaatagacttatccaaatctttgctcaattcctatccattggaatcaacttatctatatatttactcaatttctacctgcggaatcaacttatctagatcattggcgttgacaattacaactcacactgaaaggattactgattggtaattgtgtaattgttggcaccatagttgggaatcggagagagggaaaaagggttggcaccagtcctctatttttttttctcaatgtaccgagaagaaagggggcttagcaggaataataagatgaatgattgcgatctgtagcccatgtaagaataagaacgaaattttgcaaagacaaatgaaaatcaatgaaagtactaaagggaatggtgaaaaggaaacgcaaaatcaagtgaattacaataaggaaaagataattaaattacaataaggaaacgataattaaaaaatcacttattaattttattcgtcacgcgacgtcaaggcgcatatatattcccactatcctccacgcacgttatagggaaatggagacagaaacacgacgtgtcactatgcaattttagatgcgccaagaaaaaaaagaagatcaaattttggtgacacagccttacaatttcaagatatgcctttgtataggatggcattgacttttcacattacaataataccctagttgaataatgtattaatgcatttttctcatgtctaataagatatttttaacatcatggtagttactcagaaagcgaagcttgccgcactgtaaattaatcgtcaatattaatactttgtttgtactccatccattctataatataagacacaacccatccattccataatataagacacaaccacttttcttagatgttccataatacggagtataaggcatacatgcaagcatgaaattaactatgacatcttctccattaaattattacttttttaaatcctccactctcatgctatctaatcttattggatgcatgcattatatttattaggatgatccaaactacaagatgataataattatttcttagtttttgggttaagggtggttgtaccttatattttggaatggggtgagtaataaataatagccctccaggagtctggtacaccgtacaacaccaaacgataagaaagtgatttcatctcctcgttacgtgcatgtcacctaaatggtcatcaaattttttttaaaaaaaatagcaagatagattaatatgaaatataccactccacaaacattcaagttgaaattcaacatctacaagttgaaacaaaaagaaacaaatatgtaagcgaatgtacgataaccattttaatttgttccttttttgcaacttgtggaaatcgaatttggttttgcatgtttgttgagtgatatatttcatattaatctatgttgtcaattttttttcatattttttaatgactatttagatgacatgcaaataatgagacgatatcccctcgagggatgaaaattcatttcccggcacgatgtttatttctgtggagtaatgactttcacgcttggtttggggtgtggctgctaagaaaattggcatatatgatatattcaatgcaggtgcttccattttgttttcttgtttatgctgggagttgagaaaatcttagtccataatcaactggtcaagtgccgaggaattgcctgggtctcattgactctgttaacttgttccattggcggctgtaataagcctgggacagtgagaattagtaaaagaaatgactgtttaatttgcagctaaacagtatctcaatttcgaaatgtcattgtcaacaaccatgttattttccctttaaatcgttcggagctcacgcatctaaatcctaaaccacctgggttccatgatgagtcgtcgaatccatggcatgtgcttactcgtcctagccaccttcctctcttgcattgctctctcggcgggtgatcaccggagcgttctgtggcgcggcggctccatcgccgtggaggacgccgccgaaaacgtcctcgtgtcgccgagcggcaacttctcgtgcggcttctacaaggtggcgaccaacgcctacacgttcgccgtctggttcaccgcgtccgccgacgccaccgtcgcgtggacggccaaccgcgactcccccgtgaacggcgtcggctcgcgcgccgagctccgcagggacggctcgctggtgctgcaggactacgacggccgcgtcgtgtggagcaccaacaccagcggcacgccggccgaccgcgcccagctcctcgacaccggcaacctcgtcgtcgccgacgccgccgggaaccggctgtggcagagcttcgactggcccacggacacgctccttgccgggcagcccgtcacgcggtacaagcagctggtgtcggcgtcggcgaggggcttgccgtactccggctactacaagttctacttcgacagcagcaacatcctcaacctgatgtacgacgggccggagatcagcagcaactactggccgtcgccgttcaacaagtggtgggacaacaaccggacggcgtacaacagcagccggtacggcagcttcgacaggcgcggcgtcttcacggcgagcgaccagctgcagttcaacgcctccgacatgggcgacgagggcgtcatgcggcggctcacgctcgactacgacggcaacctccgcctctacagcctcgacgccgccgccgggcgctggcacgtcacgtgggtcgccgtcgggaggcagtgctacgtgcacgggctgtgcggcagcaacggcatctgctcgttccgtcccgggccgacgtgctcctgccccgtcggctacgtgcccaacgacgcgagcgactggagcaagggctgccggcgctcgcccgacgtccggtgcggcggcgacgacgtcgtcgacttcgtggagatgccgcacaccgacttctggggcttcgacgtcaactacaccgccggcgtcacgttcgacgcgtgccggcggctctgcctcgacgactgcaactgcaaggcgttcgggtacaggccgggcaccggcaggtgctaccccaagatcgctctctggaacggccggattccgatcaagcccgaccaaaccatctacctcaaagtcgctaggagtgtcaagaaccagatgatcaaccagtcgtcgtcatttctgcacttcgatggacacgcctgcaccgtggacgaacgggacgctagcgtcggcagctcgtacctgcatggcaggagcaacgagataaacttcatctacttctacagcttcctcgcggtcgtgttcgtcgtggaggccattttcgtcgtcgtgggttacctgtttgtcttccgagctgacccggtggcggcaggacgggtccgtgacgacgggtacagcttggtgttcagccatttccggaggttcacctacgacgagctgtcagacgcgacgtgcgggttcagagacgagattgccaagggcgggacgggatccgtgtacaagggcgttcttgaggatggccggagcatcgccgtgaagcggctgggagagctgacgcaagccgacgaggtgttccggtcggagctgagcgtcatcgggcggatcaaccacatgaacctcgtcaggatatggggcttctgctcggagcacccgcaccgcctcctcgtctccgagttcgtcgagaacggctcgctcgacaaggccctcttctgcgacgacggcgagagctccggtgtggtggtgttaccatggcggtcgaggtacaagatcgccgtgggcgtcgcgaaggcgcttgcgtacctccaccacgagtgcctggagtggatcgtgcactgcgacgtgaagccggagaacatcctgctcgacggcgacttcgagcccaaggtgacggacttcggcctcgtcaagctgctgagccgcgacgccggcagccacatggcgctgtcgcgggtgcaggggaccagaggctacattgcgccggagtgctggacggtgggccgcccgatcaccggcaaggccgacgtgtacagcttcggcgtcgtgctcctcgagctgctcagggggcagagggtgtgcgactgggtggcggcggcggacggggcctgggatctccagcggctggccgcgtggctcaaggagaagctgaagcgcgacgacgacgaggaggaggtgtcaacgtggctggaggagctcgtggatgcacggctgcgcggtgatttcaaccatgtgcaggcggccgcgatgctggagctggcagtttgttgcgtggacggtgaaccaaacaggaggccgagcatgaacgccgttgcgcagaagctcctctcgctgcatgatactcgctagagcatcagtgcatcatcatcagccatctgcaccatgcatgagcccagcatgcatcgatcacctttcctggaaggctggaaccccaatgcatgggactgtgtgtgtcataccaaaatgaaaaaaaaaaaacggatttgctataattgtggccacagattttctgtccaatcgcagtcgattttttggccttaggatggcatgtagattcgtgcttatgtgttgtatccgcgcgcgttttacggctcttccacagcttttgcctcgtcaattgactccgtgtgtgttgtttgatgagggacatgctgatttgaccgatggatgagatacgtgtagtaagttacaccataattacatcatatttacactacaattacatatgtaattttaaaacttacatatgtaattttggtatttacatagtaagtacactattttttggtgaatacaatgtaaataaatgctgactattttttgagggaaaaatatggcaccataaatatagctactccccaaaaaaaattgcttagttagactgttcagggtgtgaaactgtgagtgtagtagtgtacattgtcccacaatttatttatttatcaatattcactaattattctcaaaataaattaaaaatattggtgtacttctttatacgacctagtggatggttaagcggataaaatatataaaagcaagtcctacttttgtggattaacggatacggagtatgcaacaatcaggctgatggagtgtttcgtggggaaataggataatgtactgatgtggaagcacatggccccatttcgctgaagggaattcaatttttaaaatactgtatgcatctgcttgtgtgttatatatgtaaagagaggaaacgaagaacggaaaaataatatagagtaagaattttttttttcatttttagtggtctaatagaggctgagggacgaaagcgactataaagccctcaaaatcaatctaaaaagtaaaattggttgtatcttataattcgcgcgccttccacggaaattattggattaattccaaacggatgcaacttgatggcagaaatattggcactaagttgacattagcacactaaaaccaatcgtcgacggttccatttcttttctccaacgaattagcggtgttaactattatatgattgcgattgcgatgcatccagctggctggaataatgcaatgcaaaaattgacaaaacaattatgacaggatctaatcagaattactccctccgtcccacgataacttcatttttggatttttatgtccaacgtttaaattaaccgttcatcccatatgaaaaatttatgaaatttattttgaaaacatagtgacgcataaagtattattcatgttttatcatctaataacaataaaaatattaatcatataaaacttttaaataagacaaagagtcaagcgttgtatccaaaatctgaaaaatggagtcttcgtgggacagagagagtagtaatctaaagcacatttgtttaatacgcaacctagtttagtactaggtcgcactatcttcaggttgatctactagtacatggatgatcgatgctaaaaaaacgactttggttaatcgtgtttgtcaacacgaagaattgatgcacatatgtccaattagatggccacaacgtccaacttaacgagtcactttcgagtatgaattactccctccgtttcaaaatgtttgacaccg

SEQ ID NO: 23119 - DNA, 4632 bp, Oryza sativa
cttaaattttttgaataagacgaatggtcaaacatgtgctaaaaagtcaacggcgtcaaacatttcgaaacggagggagtaatcattgccccatgcggctgagcatgcacatttgagcatgttggtcagctcctcggctcatgaataatccacgcttatattatatgatttgtacggactgctggatacctgcgtatagtgttcacagtttagtggactgggttttgccgagttcatgtaatacatgaaaactagctagaaagtatcaggatggtgaatataatgcctgcatttgatgaaatccgaatctactcgcgtcaaaaaaaaaatccgaatctactctagctagctaggaggtgacacacacacacacatatatatatatatatatacatacatacactccttcaaaaagagggtagtaggttaataaaaatgactaatgatatgttaatgataattttctttaattaaaatctcattacaacgcacagacaatatgctagtcttacaatttactgaagggaagagctagccctgtcaaagtaagcagtgacgaccgagttagatgaaacatgaaaccctcccgttcaacccatttgaatagtaccagagtttgttggagttcaattaacttaattacttaagtcataatcaccttcagataatgtaatgcagaaatttgatttaactgacttcgttgtgaatggatgaatcacctcacgaacccctttcaacgtcgagtcaacaactttccgtacttcattcggaagagaatattttgtaaaatcctactttgcataagtttagacaaatcctataatataaagatatggctaaaaaatgcagtaccctctagggtttttagaaattttcacatcaataaaaaaaagagaaaatgatgggttcaaacttaatgatatagaccgaaagctcaattaatttaacagttgtatacatcaaatttaattctactttaactgtttagctccgtataaaattatgcggataatctcctagtgattgtgtgttaacaaagcacgctcaccatggaacgtgttgcgtatatatgtgtagcggtgtgcagtgtacatataatgtggaaataaaaccgctaggattctaggaagtttgatcgaaatatcgtgcagattgtaacgctttacttaattagttacgtacggcagctaggtcgccgtcgtccaccggagcacgccaaaccacgacgaaatacacaccaatggatcgtactagagcatgccaaactgcccattgccaagtcggattcagattaagtgacatagggtaaacatgtcacgagatgacatagcgtagatttcggtcctccaaaataaatccaatggctgagattcgtccacgtcattacgagttttcgaatttctttgaccaccgcctcggagcccttcttcaacaactatatgtgactttcttttcccccgagtttcgaacccctcgagttgaaccatgtagatctcctcctcctcgttgttgttgcggagaaagaccgtattcacgtctagttaaaatagatgcaagtcccctcggccgctactatatcgagaatcattcggatggttttgagcttgactgcttttacctgaaaccatgcggcactcaattgccgcacacgcaacgcagcgcaattcactcagccgacccacccttgtgggcaaacatgttgtgccgcgcgacgcgataacgatatttttcgccggcccggccgcctccacggtgtgagacgtgaaggcgatacggccgttacggccgttcgcgcgtaaaaatgccgactgagatgtggcggctcccggctcgggacggcgcatgcgcagcatcgaccaccatccgcgacggcccgccgccccgcgagagcgaacaaccacgggttgcgcggcccacgctataaggctacgtacaaggccgcgtgcagggcttggggttgggggatggaattttgggccttttggtggaatgaggggccgatacgttgcgttggggaagcccatcctatctgagagagttggagtttacacccattgggtcttaggcctgcctattagatcagcccaaatacgcccatttcaactcgtattcgatagctagagagacttcctttcccttaaaaaaaaaagtgagttcctttaagatttgagcacttttttttagaacaaagatttgagcactgaatcaataattaagtagtactactccctcaatggcggaggtaggtgtattagctggccggctcgctcccagcacgcaatgcaactctcctcgaccactgtcatgtcatctcatctaggccctatttgtaggccctatttggttctatgggctaatgtttagccctaacattttagcctcaaattagccctcaaggatccaaacaggtggactaattttgtatggggaccatcaagggatgctaatggggttaattttgcgtggggaccatcaaaatttgatatcctgaagtgccaggaagcaagctactgtatcacgctctagtactgaagccgaatataaagccttggctaatgcaactgctgaggtaatgtgggttcgtaaattgctagaagagattggtttgttgcatccaggaccttctcaattatggtgtgataatattaaagctacctatttgtcagcaaatcctgtgtttcatgctagaacaaaacacatagaagtggattaccattttgtcagagaacaggtggtgcagaaaatgttggaatttcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacagctaatggggttaattttgtgtggggaccataaaaaagcagctctctctctctcctctctttctactctctctccaccttttaaccttgaattagcacatggatccaaacataccaccttagcctaatgtttagcctaccaattcatgactaaacattagctctcaaaattagccctgggctaatcttccaaacagggccctagtacgccggatcgccgactaacgaacaggttgccgtcccttgtttaaataaacaaacaaatatttcttccccgttttaaaatataagaaaccgaatgtgatttactataataaacaggttgccgttccttgtttaaataaataaactgtgatattttttaatattataaatctaaaccgatcagacctaagatcggatgggatattttctagtagtataccgattcttaatagtaggaaatggcttatccgttttcggtttagtccctccttcccagtaccaaatgcggcctctgctgtgcatcggtgcatgtgccttatcgagttcttcggaaacttctgtgtgttgcgagttactacttgtttcaaaatagcactattttagaaagagaaagtaaagtctaacacattcacggctaagccggcaaaattctcaattcatgttaaggacctctcaatgattgagataatttgaagaggcatttcatttggcttctacctcttatatgattcaggcagcaatccccgaaaagtaatatgattcaggcagcacacaacgatttagacaatacgcattccaaatcatatttatatattttcacgatgtaatcatgcattacaaataatcgtgcgaataaacaaataagagcaaatagttagagaagctgacagcctgcctaaccactatagtaaccaaatacgaacacgagcagataagcaacaactcgtcacgcgtcaaccgccgcagccgccgccgcagccaccgcccccgcacccgccgccgccgcacccgcctccgccggagtcaacggccgaggcgatgatggcgccggtggcgagccccgcggcggcgccgacggcgagcccggctcctgggccgaacccgctgcggccaggcctcccggcgttcgccgccgggtacgcgtaccccgcggggggcggctgcgccgggtagccgtacgcgccggcgggaggcggcggcgggtacccctggccgtagtagtagacgtcgttcctgttcttccgccgctgcctcttggccccgtccgcgcagccgaacgcggcgacggctgccacggccaccgttgcggcgacggccaagatcaccaccgcggccgggctgagggaggcggcggcgcctcttccaacgccggcgtgaagggcatggagagccactcccgctctcaccatggcttgcgcgcccgataagagaagagatggagcgaatgaatatgaatgcgtgtttaaaagagagatgagggtccacggatttggcatgattggctccttttggtcaaagtctaccatatttgattattgaggagtactactactgtatttttttttaggagagtagtatactataactaatatcctcagatatgt

SEQ ID NO: 23120 - DNA, 15428 bp, Oryza sativa
  unsure (1)..(15428): unsure at all n locations
gaatatttagtattcaaataagtaaaacgactcgtacaacttgagaacatcgtgccctccagcatctctcaacgtcaggaaatttctgagcctgactggatgtggatgaatgtctctcccatgcaattgcagctaagcccaagcggttgataattactacctcctatagatgacgccgttaactttttctcacatgtttgaccattcgtcttattcaaaaattttatataaatgtataagatataaatgacacttaaagtactatgagtgataaaacaactcataacaaaataaattacaattacgtaaagtttttaaataagacgaatggttaaacatgtgagaaaaggtcaatgtcatcatttattaaaaaacggagggagtatatataaggaacgcgttagggagggagctcaggaggatatgcgaatagataacaaaagtcaatagcttcaagcagttgttgggatggagtcatggagattaattttctcggaccacttccagttgctcatagctaggttcgttcgttgactttgtgaaatttttaccttcttcctgtgcactctgagaggcagggtttaactttccaatttcaaagtaaaaactgctcctcggttttgccaaaatccgatcgaaaatcggtaaaaaccgatgactttcaattaacaccatacgaaaactgactaataccaatccttttcacaaaagtcgaccggttttcgcgaaattccagcggtattgcgaatcctgctagtgagaggcaatggagccgccattgcagacgaagatggagcaggcaagcaagatacgagggaaaacaaaaagattattctctccatacttttcgagcaccaaattccaccctacttactcccaattctgcacacatcaaccatgttactctccatgctttggcataatatgctcccggccggtcatctttccatgttgcatcgacgtcatactcactcgaacgatgtcgacactggctcttggagaaaggaacgacatatcacatatgtctatgatattctatcccttcatcaaaccaacaggtatacaagattatcactagctagcactgcaccatggctagagcccaatttcgctctcagctagcttggattgtctgatggcgacggaagatatttttttgccatgctcaagagatctagtcggccgatgatcaaaacgatgaaagccaccaaggcacaaaactcgatcatcatggctgtcaaaatatgcctgacgcactcgctggcatatgcatctcatccaggattagatagttgtttcagatatgattgcacaatatcctttaaatccagtcgatatgttatagcgattctgaatgacctctaccgtacttgttgtgcatgcactgaaagaactgaaactaaaatatgcaagcatgaaaaaatcgcaatcatgaaaggatcaagcatcaagtcacacaaatctgaaactgaaactaatttcgaagcgagagagattgagggagagaaaagagaagctggagaagccataataccacttgcaggtgggtctcaaaagggtttttatttttatttttgtatatagggccacatagatgccatgtcagcattaattgaccccattaactcgccacgtgagataaaaccgttattcaaactgctcaggaactggttttgatggttagaggatgctctgtagggatgcaaatgaacctccacctatagttgaaggaagtgaagtggacttttcccattcgaaatcagtgttgggccagttattgggttttaaagcaggccttagaaattgtttcggacgaaaaaaggctacccgattcggtcaaccttaaaaaactgcaactccggttctctatggcatatgctttccaaagatcgacaaagcccatcacaattcgcacgagaaacataagaagtcagctgaaaagcatcagttgagttggaccagtccagcagagataatatagtataacgaatctgaataatagtagttttttcctactaatatattgacgtgcaatccttttacgcgttcgaaaaaaaaagaataatagtagtttatgttttatcctaattctagattgtatttttttttgggaacggatggtgtaaacctgaagattcaacggattcacagaggatgttccaatcacagctttttagtctcgacgttcgagcagacgccgcctgaagcatccgtaggcgatttggtgattggcgagagctccgactttcgccaaagattcagcgtttgttattgttagtcaagaacggctgcgcggtgcgcgcgtacgtgtgcttttcctgatccactaattctcaggccatagctgcagacagtcagacatcctctgatcctctccatccagagaggcaaaacggggcctcttatcattttggatcctccatgagatgagctcaatgatttagctgcgaaaaacagctcgtcgacatgcagtaagaatgaagaacatcaagctcaaggaagttatctagattctactagacaagtaagccttttttttttctctgtgcccagttgatctcttcttcatttggttttcatagttcagttgtgttgtgatcttcttctgtgttcctcagctgcaaaccaagttctactggttgttcttctccttttcagtggaatcagaccaagccttttacgtgttcttgaaaaacatcgttctgagtcttgtagacaccataaacaaacacagttgacatgtgttcctgtcatgcaggccacaagtgattcttttgagttctgagatgattttgttcatgcatgaagtcctttctgaagtttattatggtgaactaaatatattttctgtaatccttaaatttaagcacgtggtgtagttccatctgttggcacatttgtaaacttaattcgtatttttttttgtcttcacgccggccgccgggcggctaaatccgtacaaagaataatcgcccacactcacccacacacacacccaaaagaaaaaaaaaaggctccaaaacaaagcagagttgttagttgttcctttcttttctatgaggaaatcaaaagcaaactaactgtgctcagctcagattaattctgaattaatcaaactaatggtggaactggtgaaatgtgaatagtacaaactatcaatgttaccttacaatcaagatatattactgctaattaaaatgtgcaatgatatctctgatttttatgcttgtctgatctatgcaatgacgtactagtacgcaaactccagagtaaagacaagctcaattagagaacgaatgtgagcatgtctactgctgttgccataagtaagtaccaagattaattagtactatcaccatggcaaaataaaagaccaagattttgcttatctaactgttcgtctcacctcactggtttcttcagtatcgtcagtctcggcaaccgcggctgcagtagtgatgctcgctctgatcaagcgatgccgccgctacaggaggaagatgaagaagaagatgctagctaggatcgcccacgaggcgaccgaacagcaccgcgagatggaagcccgcgacgcggcggacagcgtgatgatcgagatcggccccgtggagaagttcctcaacgagatcctcagcgagaagccgatgcgcttcacctccgagcagctggcggcgtgcaccgggaactactcgtcggagctcggctccggcgggttcggcgtggtctacaggggggagctgcccaaaggcctgcaggtcgccgtgaaggtgctcaaggtgtccatgaacaagaaggtccaggaggcgttcatggcggagatcggcaccatcgggaggacgtaccacgtccacctcgtcaggctctacggcttctgcttcgacgccgacaccaaggcgctggtctacgagttcttggagaacggctcgctggagaagtacctctacggcggcggcggcgaggacagggggaagaagctggagtggcggacgctgcacgacatcgccgtcggcacggcgaaggggatcaggtacctccacgaggagtgccagcagcggatcgtgcactacgacatcaagccggcgaatatcctcctcaccgccgacttcaccccgaaggttgccgacttcgggctggcgaggctgggcgagcgggagaacacgcacatgtcgctgacgggcgggcgcggcacgcccgggtacgcggcgccggagctgtggatggcgctaccggcgacggagaagtgcgacgtgtacagcttcgggatggtgctgttcgaggtgctggggcggcggcggaactacgacctcgccgcgcaggcggagagccaggagtggttccccaagtgggtgtgggacaggtacgagcagggggacatggagtgcgtcgtgtccgccgccggcatcggggaagaggacagggcgaaggcggagatgatgtgcaaggtggcgctgtggtgcgtgcagttccagccgtcggcgcggccgaagatgagcagcgtggtgcggatgctggagggggagatggccatcgtcccgccggtgaaccccttccactacgtcatgagcggcggcagcggcagctcgacgctgacgagcagcagcacgaacctgagcagcgggggcaccactacaggaagcagcgaggtggcggtcagccttcctgccaaaaagtccacggacgtcatggttgaatagtctaagtccaagtgaaaatgttgacccttctccctttgtacaacggtaccagcgagacaaagatttcgtacatattttatcgtcataatgttgttgcaattatatttgttaataatgtaattattttttacctctgtttatgagtttactagtaccggattttgaatcactttctaaaaaagaataaaagaaatgtgtgaattttcgtaggaaaaagtctttgcctccctcaaggtaataattctttccctctctatatatttatcgataaattttctccaaaatatttatcagatataagtatagtaaattatgattaattacattataacttgtatgtaattacaatgtacacggtaagttgtgtgttaaaatccctcgttaccatgctatatttttgtaaaatagagattgtgggaccaaatcccctcatgtgcgcacactatgatttttgtcttcctcgcttgcataagacttaaaacagatctaacagtttaaaaatatatgaaagttacacataagatatactgtatttacatgtaagttagtacaatataattacactatgatcacactgtatttacatatgttaaatttcagagagaaaaattgtcaacaaatatatagcaaaatcgatcctcctctacctctgatcctcccaatgacagtcagggcccacatgtctaacccatcttcctcgctacagagtacagactgcagagtcgaattgagtcacaccgaaacgtttaaaaccaaaattagcggaacaaatacggcactataacagtctaacacactaaaatgttgtagacatgcacttatacacatcagtaggtgtacgtctttgaacacaacagccttgctgacaactcacacccgtgctgtgcaaacgtggaagaatcagaaaacgggaattcgtttccgacacgtctacctgccggtacgagccgacgaaccatccgattccgtggtggcggtagtggtggtcggcgacgagccggcggcgctgtacggcgcgaggtgggcgaacgggttgcgcggcgcggcgatgtggtcctccccttccagcatccgcacgacgttgcccatggacggcctgtcctccggcctgtactgcacgcaccacagtgccaccatgcacaccctctccgccttctccctctccctcccgccgcccgccgccgccgccgtcgcgcgcgccagcacggcctccgtctcgccggcctcgaaccggtgccacacccaccgcgggtaccactcctggctgccgtgcccgtgcgcgccggccccggcgccgagctccaggttccgccgcctcccgagcatctcgaacagcagcatcccgtagctgtacacgtcgcacttgtgcgtcacggggagcggcatccacagctccggcgccgcgtaccccggggtgccgcgcgcgccggtgatggtcaggtgggtgtcctccctgtcgcacagcttggcgagcccgaagtcggacaccttgggcgccatcccggcgccgaggagcacgttctccggcttgatgtcgtagtggatgatccgctgcgcgcactcctcgtgcaggtaccgcaccgccttcgccgtcccgacggcgatctcgtggagcttctcgaacccgatcctctccgccgccggcgacggcgacgagtcgaacaggtagcggtccagcgagcccttctccatgtactcgtacacgagcgccttcacgtcggcgtcgaagcagaagccgtagaggcggacgaggttgatgtggtacgtcctcccgatggtgccgacctccgccatgaactgctcctcggcgcgcttcccgagcgtgctgttcagcaccttgacggccaccggcgcgccgctcgggaacacgccgcggtacaccacgccgaacccgccggagccgaccttgtgggcgtagctcttggtgaaggcgcgcagctgccgcgcgctgaaccgcacgggccgctcgttctggaggccctcgatgaagtggctcatgctgcccatctcgacgacgtccgcgtccgcgccgccgattccgccccggctgctgctgctgccgccgccgttggcgatgggcgtgtgatggtcacgactgctactataccacattttgatggcgatcttggcgcacttgtaaatcgcaactatggtcacgactgctactataccagtcgtgatcaccccaactgcgatatgttaatcaaaattttgttactacaagcgacatagatgtagataataggcgatgcatatgagtacatcgatcatacttactgagtgctaaagcaagacttccattggcgatggccatgctgatgaactaccaggaggggttagctacagtgtgcaaggagtgttggctacttggcttatgaagtgtcttcctgccttgtgagttgtgaggatatttttattggttcattttgtttgcagctagctgatttgactgtttctgtgtgccactgtcaactgtgctagtgtgagagaaaacaatgtttctgcactcttcatgcttacgcgatgaacacaaagatttgataaattcaataaactaaaattagaagaaggaatactatgtatcctgtttgattggtgttgactaaactagttccccttcctttctcaccaagtaaactattttaatgattttttaaaagaaccgtataaataccatgaggcttcattttttttaaacacagtacaaacgcagacacttatagaaaaaattacaaagttgtaaccctaggagtaggagcagagccggttctatgcaagaaaaaatagtgagaccatacagtattaccatgtacatatagtcgtgatcacaccaactgcgagatgttaatcaaaattttgttactatgagcgatatagatgtagataataggcgatgcatatgagtacatcgatcatacttactgattgctaaagcaagacttccattggtgagggccatgctgatgaactactaggagtggttaactgcagtgtgcaaggagtgttggcttattaaggcttctggggagataggggagattgagtctcgttttccgtgcgcatgtttttcaaactactaaacgatgtattttttgcaaaaaatttatataagaaagttattttaaaaaatcatattaatccatttttgaaatttaaaatagttaatactcaattaatcatgagctaatggctcaccccgttttgcgtgccttcctaccttgtgagttgtgaggatatttttattggtcattttgtttgcagctagctgatttgactgtttctgtgtgccagtgtcaactgtgcgagtgtgagagaaaacaatgtttctgcactcttcacgcttacgcgatgaacacaaaagaatttgataaagtcaataaactaaaattagaaggggaatactatgtatcttgtttgattggtgttgactaaactacagcttccccctacaactgattatgcttccattttccccttcctttctcaccaagtaaactattttaatgatttttaaacaatggtttgttaaaaccataccaccctatatttacaaaatttgagatatgccatccatatcttaattacatgtaggacctacatgagtcaatgacatgtgggtcagggtgacatatcataaattttgcaaaatttgtatggcatggtttaaattgtccctttaaacaaactgtataagatgtcatgaggtttcatttttttaacatggtacaaacgtagacgttcatagaaaataaccacaaaattgtaaccctaggagcagggccagtcctaaatttttggaggcccaatgtgaaaaaatatagaagccctacaatattagtgtgtgtgtatatagatgtacgaggacaaaattaactttattttattatatggaagtcccgtgagttcacatacgctcgaagtgaccgagatcaacagaacattcatacaccccaactgcgagatgttaatcaaaattacaaaaaaaaattaaagagttaatacaactgtgagcaccatagataagctaattatcgatgaacatataagttgtactccctcctttttttaatagatgacgccgttaactttttctcacatgtttgactattcgtcttattcaaaaaatttacgtaattataatttattttgttatgagttgttttatcactcatagtactttaagtgtgatttatatcttatacatttgcataaaatttttgaataagatgaatggtcaaacatgtgagaaaaagtcaacggcattatctattaaaaaacggaggtagtatggattatacttactgatcgctaaaacaagaattcctggtgacctggtctgaccgccatattgatcagttaggactggatagcttcagtgcaaagagggatggattattggcttgctgtgcctgtgacgtttttttagttcatttaatctgctttcatgcttgtcatttttggacatttatttatcacgtttgtcaacttttacatatatagttcttccaagtgtgcaacgaatggttcattcggagagaaaacaaatagtttctgcacccttcacactcggacgataaataaggggctgcttggttggcggcttggaatgccacgccacggcgtggctcgccacaggagtgtggcggacgtttcgtccgcctcagaaaacactgtagcgtggcgaaaatactgtagctatggcattcaatggctgggatccaaacacacccttaagaatatgagcaagtcaatggaactgaaacttaagagaggaacttagcttggtacgatgatagcgtccgctgcgatgcatggaacagcgtgtattggttctaaaaaaaaaaaagaacagcgtgtatttgtatgtcgacttccattttcctcttcttccctctcagaataaacagttttattgcttcttacatcaccggcaatggcgttgatcaactgaaaagtttaccatgtcaatcagaattcgccctccttgtgaattgaaaattttcaacttgtgtcacaagtggttctgttacatgaacagacagataccgtcataccaagttaccaactcgtatagtgacattttgatgggccgcattcaaagcctcaaccttttgtggggccaagagcccattaatatgctagcaatttctctaggaaacatgtttatttacagtacctgtagtacaagatgacacgttgagtactccctccgttttaaaatgtttgacaccgttgactttttattacgtgtttgaccattcgtcttattcaaaaaatttaagtaattatttattcttttcatatcatttgattcattgttaaatatactttcatgtacacatatagtcttacatatttcacaaattattttgaataagacgaacggtcaaacatgtgctgaaaagtcaacggtgtcaaacattttgaaacggagtaatatttgagtgtctgcactccattaacgttcccgttcaaacatgacatcatacatgcacttgctgtcataaacttgatagactcagccgcttcctttggattgactgataaaattttcaactcctattacttgctgatcctgctggtgttctgtaaaataatattgcactgcgtgttctgcgtacacacgtactctaaagtttgaacgacgtgtaacggcatatgcatatgttaatgatcctaagcagtacgcgtaagcattttttacttggtagtttagagtatgtgccaagtttctgtaaattctccctgcgataccgacccnnnnnnnnnnnnnnnnnnnnnnnnnnnnnnnnacaggtcaaacgaactgcgaaattgttccgtgaacttaactgataattcaagtttcaagtttcaagccaagaaatgaagtacacctctcttgctctaggtaagcatcattcatgtgatcgtctcgtgtgcttgacttggttttttttctcgttttaatttcgtttaatttctaatggaaattttgtgcacacatgtagctgggattatcatcggtggcattgccgccatcctggtcttgaagttcatcatgagatgcgtggaggccaagcacgccgaacgcgcgaggcggcgggaggaggaggcagtgccagtgtcgccgccggcgagcggcacgtacagcagcgtggacgtccgcgtcgagatggggtcggtggaccgcttcctggacgacatcctccgggagaagccggcgcggttcacgccggagaacctccgcgagttcacgggggactacgcggagcggctcggcgccggcggcttcggcgtggtgtaccgcggcaggttccccggcggcgtgcaggtggccgtcaagatcctgcaccgcacgctggaccgccgcgccgaggagcagttcatggcggaggtcgccaccgcggggcgcacctaccacatcaacctcgtccgcctctacggcttctgcttcgacgccaccaccaaggcgctcgtctacgagtacctcgagaacggctcgctcgaccgcgtcctgttcgacgccgccgcggcggccgccctcgagttcgacacgctgcacggcatcgtcgtcggcacggcgcgcggggtgaggtacctgcacgaggagtgccagcaccggatcatccactacgacatcaagccggggaacgtgctgctcgccggcgactacgcgcccaaggtggccgacttcgggctcgccaagctctgcagccgcgacaacacccacctgacgatgaccggcgcgcggggcacgccggggtacgcggcgccggagctgtggctgccgctgccggtgacgcacaagtgcgacgtgtacagcttcggcatgctggtgttcgagatcctcgggcggcggcgcaacctcgacacccagcgcccggcggagagccaggagtggtaccccaggtgggcgtggcagaggttcgaccagggccggttcggcgaggtcatggcggcgtcggggatccggagcaaggacggcgagaaggcggagaggatgtgcaaggtggcgctctggtgcatacagtaccagccggaggcgaggccgtcgatgagcagcgtcgtcaggatgctcgaaggggaggagcagatcgcgcggcccgtcaacccgttcgcgtacatggcgaccatggacgcgatctccagctccagctccggcggcggcggcgtcagcaccgccacctccgcctccgcctccggcgactcggcgcaatcgactcgacatgacatctgccattgacatatgcttgggacaaacgtgcatgtgtacccattttcgtgtagtacatttggatgagctgcttggaactttgaatagtatgtaaactgataggcctcggttagaatttaatatgcttgaaaaattgcagtttaaggaaatttcattcaaaaatttaaaaattttaaatcgcacgtacattttaccatggcgagatccctctgcttttgaactctcaaaatcaaacatcaggtcagctggtggcctggtaatgtaactcgattattattgggccattcggcccagcattaaaatgatgtgaagaacagcccagcccagcacacagaatgcgtcttcgtcgatgggtggcgtacctaacatcgacggcggataaagcgtaatcgacggcgtaaggcggcgggaggggaacattttccagccgccactctccccccgagagaagacattccttcacccacctacccaaacacgccgccggccctgacccaatgcgtgcgggcccaggcctatccactggatcaacgggcccacatttcatcggctacctcacgttgtacatctggaatctggagcttattaccaaaaaacctcgtgtacccaacacgtcagaattgtgacccatacgagtcacagacaactgggccccaatgcctatccggacccaccgcacagatacagttaaatcatcttctgttgatgaaagattagcagcggaaagtcgcatcgaaactgaggcggcgattggattgtatgtgtcactgcaggtgggcccgtgcacgcgaagtacaagggggtgtcccgcttgtcataggatgctgcacacgcacgctcccgcataaagcggtggacttagcagttacagtagttattcccccttcccaaaaatcgcctcagattttctggttcgaaatcctctaccccctcccatggcgtccctcttcagggctcgccgccggcgatcgccggaggacgacggcgagggggaggacggatccgcgtccgggcgggtcacccgccgccgcctgtcgccggaggagggcgcgctgtcgctggccgaggcgtcggcgtcggtggccgcggcgggggcgggggcggagagtagccccgggtggctctccagcatcgtgtccggagcgaggagggtgatctcctcggtgttgttctcctctcccgaggaggccgcctcaggggaggaggaggaggacgacgacgaggaaggtactccttgagcgccgtggagtagccacgctgttcctcatttcagatttctgtttgtcactctctccttgcttgcttcactgaactgtttcgtctacttgaccgcccgagttgtgccgctgcggttacttgcgctgttgggtgctaattacgtcttcgctgcaaagctagggtttcggcttgcttgctctaattagagtagaagtagtggaattttgataattcggggtcagtagcagagagagagtgtgcgctgacggttttttcccttagtagactgtggttgggtaagaattttgcggttttgccacattaggtggaattggggataagcttggtttgactccaattacacagtcctagtgttgtggaattagaatttgaagtttacaatgtggagtgctccggctgctgtattcatcaatcgatgcttcagcagcatcacacttccatttggtatgcttgcgaagataccatcattgattcatcaacacaaaattaaaggcatgtatttggttagctgccaccatcctaaggtttataatgtcctgaaaattatgatacgaggtgcagagggcttaatttagatctggcatggttgttttcagaatcaacctcatttgggaaccacagttacttgcatgaacatcgagttaggatgacatggtgcatattattggaattcagaaaataattgagccatcttttgtcacatatgctagatatttccagaatgtagaatagttgagctatttgttattgacctgttagttctattgtggtttgagaaggtgctcgatctttagctttgtaatggtggacagcacttttaattgaccttagaccattttagagggatgcactgcagactaatcagtgttttgtacttttgcatatgaaggaacagtgtttccaattctgttgagccattttacctttcgtaaactgttcgctcacacaactacattgtgctgcccacattcagatgaactatttttgggatggtttatgagtgcgttcatttgtaatacctgtgcagatgaaacagaagacaatcatggagcaatagtttcatacaatgagtcaaagcttgccattgaggaaatggttatgaaggagacattctcaaggtaactgtaatgctattgttctttacatgtgtgcttagatgtatatttttttccctggacaactgctaacgattaaatttaacagtaaagaaatctagtttatttctcatttacaaaacagttctgataatacaagcataggtgcatatggcctaagttggagctactcttcttttgattttttgtactatgaattctatagggtactatgaattaaaagggtaaaactattcaaatttgagttggagaaggaatcaaagtcatgatattattgcaactggataagatagacactctgtagcagtaggatgaggaaaattgcacttcaaagtactaagcatgcaattctgcctgtggtgtgtgctgccgagatactgagaattttatgttgaatagatccatacatattctacgttttcttaaacagagtaaatttcacagaactgcaattattttgtcagaactatcactttgctacaactttaactgctatatcacaaaaccgcaatcataccaaacaactttatcacaaagcagcaacacccttatgtgtgtatgacatgtgggcctgacttaccagcatgaatattgcatgggtgtgacaggtgggccaaaaacttgtcggacaaataaagttgcagctttctgataaaatcctttattatagttgcagttctctgaaatgcctagctaaaggtgcacatggttgcatgagtattgcatgttacagtaaactgataattttggcaaaatagttgtagttatctgaaatttactctaaataaaatccttataacctattactttccttctcaattattcatgtttatttttatagggatgaatgtgataaaatggtaaagctcatacagtcacgagttacagatgctgcacttcctgaagcacctgagtatggaacgccgaaagaaattccaaccaggaatactgttgttggaaatgatttcacgggagcttggcgttccttgagtcgccacagaaatggcactgaaccagttccattctctagtattggatctggtagcttttctcctggttctcctctccatgcatcgcccgagctattaagcgcagcagttatggaagcaaagaaatggttagaagagaaaaggcagggattaggttcaaagcctgaagaccatg

SEQ ID NO: 23121 - DNA, 2814 bp, Oryza sativa
tattatattcttcatttatttcctttaatttattttcgtaatattttatctcactttcttgatctaatttttccataaactctgaaacactatgtcttctattatctattatatttctatcagatgcttctgtttctaagtcatctgtggttctgggtttgtaatttataaatctaatgctggtatttcctttactattttgataacttatataattttcaggctgactcaaagttttgctttcaattaaatcactaattttccattcttctcctgccctttcttcagaacttatttttaaagggctcatgaaagttattcccttagagtgcatattttcaatcacgtcatttacatttattttgtatttggaggcacttctattagttaatcttcctataaattctatgcttactagcaaatttgttcctttaaattcctcgtatccctttgtttgaaaaccaaaactcattttatctataaattcttttataggcatcattagatctggggctatatatgttatcaacatattctcattcatgtcaccttctaaaaatcctaatgctgctttatctattgtgtcccaccttttatctaacaaagttattaaaactttagctcctattttctttcttgtcatacctttgattcctattatatacataccttggtgaatatatttataccctgagtactttaatccattttcaaattccttggctacaatttttaactaactggctttgttaaaacgcttaactctacttctctagatattctgtataacccattattattctcaaaaaatcccatgcaatatattagttgaggtcttattgccttcagagtatctgtttgatatctttcgagctgtttgtctacttatgcaatatcttcaagctcatctatgtcttcttttttaccttttggtttatcaatacaacttaaagatttatcgtctctgcttgctattcttctaaacaaactcctagataggtccatttttatgaattaatagcttgagacgaggtaattatgcctgttgaagccaaaactatctcttttcctttactagaatttattatttctaataattctttgatataatcactgttttgtaatatcttattctgccttatcttataatcctctagctcttttagcactgaatttaatttattactgacaagcaaatattgttcttcagattgctttcgttctttaaacaaatcttcaatccttcgctctaaatcttcctgctttttatcccaatttatataaaaattatatatcagatcaacaattaaatttaattgactattgttagagtgccaactatggtcttcaatgtgatttaatctacaccttatactcagattatctttggtagtaattatctttccaatattagcttctgaatttgatttctctatgatgactggctctgataccacacttatgcttcggacaaaaaacactgttcaaaaacactatttatatacatatatatataaatatacatatacatatatatatatatacatatatatatacatatatatacatatatatatacatatatatacatatatatatacatatatatatatatatatacatatatatatatatatatatatatatatatattactcggaaattaacggacatgttttttctttgatgtaataaccattgcattttcttcgtcggccaccgtcttccgaaaacacattttgccattctggtagatgtttgcacgccggagatggggagatgtgaagtaatgatttattcttttcatatcatttgattcattgttaaatatactttcatgtacgcatatagccgatttttttaatctaaacacatgcagcccttttattacgtatttgagcacaccatatttataattccatttctaagcatgtacatgtacaggaccacgtcaatccctcgatctaatgcctaacaaaataaatgtaccttttgcaaccttgtttctagcgataacgtccacaagttagaagcctggtaatgtaaactcatttatttgtaaactagtagcaatttcttaggtctattagcttgctatattcagtttatacttaaaaaatgtgtaacaatgatttgtaaaatcaaaataacatattttgaaccatacttaataaatatgtcaaacattaatacaaagtaacaaaactcaattcaatggcctattaatttgttagacattatgttatggaacaacacttggacattatgttatggagcaatgtctgcacttgagcatctcgtctatggattgaaatatgggtttggcgtgcttatatttggaattaaactgatgcatgtgcttacatgtaaaaaatcgggcacatatagttttatatatttcacaaaattttttaaataagacgaacggtcaagcacgtactataaagtcaacggtgtcaaacattttaaaacggaagggagtattatatataagcaattagggaatatagctttactagtaagcgaaacaattcactttgggcctacttgactgtgatgttgttgacttggaacttaattggaagtccttattaacgagagacaaagttacacgtgggctcagacgtgctgtggataaatcgcgccggggagtgtgtgctgtgattagatggagagcggggcggaggaaggcgagaaaggggatcacgttccgggccacacgtgggctcgtaatcccgttctgggccgacaactccaggcccaacacgtttgacggccgcgaaagcatcgaatttttttatttatacatttttt

SEQ ID NO: 23122 - DNA, 720 bp, Oryza sativa
acgaagataccttttcttttacaaagaaattcagcaagcatgaaccaaattgtgagagctagaagctccgcctgcttctccagtgcccgccataccacccgtcaccgccaccgttccaaccccgttccccgtagatggccaaggggaagagaaagagaggaggaggaggaagaagggttggatagaggatgacatgtggacccaacatgttagtgagtcccattgtagtttttgtgtgaatgacaaatgggtcccacatacttttaatttctaatgtcacaaaagtgccacgtcaatgccacgtggggcgaagaccaagtcagcaccgccacgtcagcgaaaccaccctccaagaccgtaagagagtcaaattacgtcgatttaatagtttaggggagtcgtcctacccaatttattttaaggggtataaattagatacggtttattttaagagagtcgaagtggacttttttcttgatatgatctcgtctttgccgtggaccttcatctacccacctatactcataaatcacctgggcttgcaagctactccctccgtccaaaaaaatacaaaccctggtttccgtgcccaatgtttgaccgtccgtcttatttgaaaaaattatgaaaaaaattaaaaagacaagtcacgcataaaatattaatcatgttttatcatctaacaacaatgaaaataccaattataaaaaaatttcatat

SEQ ID NO: 23123 - DNA, 5874 bp, Oryza sativa
tttttttgggatggagagagtacttgatttgatatacctggctcaactcaatcgtgctggatataattttttcccgggcaagttaccttatatttataacgcagtaactattaaaaacacagctatgcataggaaatctactagttagatattttctttcctgcttaatgaagtggcagacctctgcttctttaaaaaaacattttcttttacagaaatatatataaagatcgaaaagtggcatttcaagtcaccaacatactgatgcattgtttgtttggttcattgattagtgaaggcttgcagctgtgcagctgtgcgtgcagggccgacgacgagggtatgcgaagtgagggatcgaacagggtcgctaaaaattaggagccgcaaattttttatattttgatctatgccaacgtgtttcaatttatttaaaattctctcgctctatttttacaaaattttactctttcttatttgttgattttgttagaacaagcttatttttttcagctacaataagtgttcgatggcaatcacgaccaattcaaagagccgatgatatggacgtgtcttctgtgcattaaagattccattcttttttcttaacaaagataaatcactacatcatgatataatatttttctaatatttatcttaaaaatcttccgctacttgtttcttacgtatttttatggacctcaaattatgtttcaccggggccttaaatttctatatacggtcctgtgtactgtgcgtgcaatgctttcagctttcgtgccggtcagacaaacatgaccagggtgtatactggtagtcagacatgaacagttgttactctctccgtcccataatatatcaatctaatatctgatgcgacatttcatagtacaataaatctatataccctcctgtttagattcgttgtactataaaatattctatcaccctcctgttcagattcgttgtactataaaatattctatccggtactagattgctatattatgggatggagaaagtatattggattacagccccaagcggtaacaacagtaggctgtctaaatcgcggcatttcctttcagcaaaaacagggtactacttattatctcggagagacggagacttgaccatcactatcggatcaatgagctctgacgtgctcatgcagcacacaccacagaaaatgcaacagccaaacaacacatgtggccaattctcacacataacgataacatcccaatcacaactttatgataaacgaaagcttccattccatccagttcacggcaaagagattacccggtcagtcaaagatagcagctgcctcctgccgctatccgcactgacctctggagtccacacatccaggcttgcagtgatccgaatgccacagcaaagaagagaagaaatcaggaatggattaagtagcattttttttcagcaaccattcagtagcactttctaaaatacaacctttatcggttgtaaatcataaataaatagtgtaaaataaaatatatcactgtttacagttaatatttccagcttcagcattttaccacctacctacaagagctagctactagctagctgatttggcatcaaaacatgcataagttcactcatcctcctctaagatttcagttagcccagaggagaattggtaagaatccatcataggtgacatggactcatcatcacagaagaatggtcttggaggcatctgcaggccaacaacgccaccttcaagcatctctatgacctcgctcatcgtcggccgatcgtgagacttcatctggatgcaatgtagcccgattatgcacagcttcctctcaagctcatgcatgttagcaacagtagcagcagatatctcaccaacacccacctgttgctctattagccggtcatacacccacgacgggtagtaggcctgacttgagttccctgcatgcatgtctgagttccttcttcctccagccatctccagcagcagcattccaaagctatagacatcggatttgcttgatataacgccaaagctccgagatatcatttcaggagcaatataacctattgttccccttaaggcgttgagcggcacaaaactgttgtcccttgggtacagtttggcgaggccgaaatcagcaacctttggaacaaagttgtcatcaagaaggatgttgtgtggcttgatgtcaaagtgcagtatctgcatatcgcaaccttgatgaagatagttgatccccctagcaatacccaaagctatctcattgagtttgtcccatgagaaacttctcttggatgagaaaatgtacttgtctagagatcctcgtggcatgtactcctacacaagtgccctcctcagttcctctgaacaaaaaccaacaagacgaactccattcacgtggtggatcctaccaatggtggagacctcactgatggactcttcaccgttgcagttggcattttccagcaccttgacagccacattaacataacctgggagaacacctttgtataccgagccgtagcctccttggccaagcttctcaccgaagtgacctgtaattgcagtgaggtcagtgtaggcatacctcgttggtccaagcatcagttgcatacgaagaaacttgtcgactgcatcaattgttatcttatttctccaatacttgtgggcaaggaagatgaatactgctaatggggccaatacgaatctgcacagtactgcataagagcaatttaccataaaacaattatggattaacctagcaagaatgtagtaagacaatacactctgcgtctacaatgaggtataatgtaatgactctaaattaccagcagtccacttcaaaatcagtagggctgtgtgaccaccatgtacgtgtagatgaggttattatgtgatctatctccaagcaggaagcacgaccagaaatagaagtcaatgatagcaatattcgcaatcctttccttgctccctgtacctgtctggctacaagaccatggggtaaagaaatgagtaagacatggctaatcgtatttgagggcttgtttggattggattacagccatcgttaaccttagcaaaatattatgtgggagagtgaaactacattatttgacagattaactcaccggattgacagtgccaggcattctttgaagttccacccactaactgtgaaaggaaatcgaacggcaaatccagtcatcattagctttacaacatcctgatagcttacattctgcagcgccgacgtgctgttcaacttgctgccacccaaaggagtcgtggccaggtacccacaggaaggctcaaggttctgaatataagcagattgttggccagtaaacacgtaaacgaaggatctgctggtgctcaggcaagcgacgggcatgtacatccaactgctgttccttatttcctgcgaacaattgacaaagctagcccaggtaacccctactggaggtgccaattcaatgatgtggtgtgacttggcctggagcctgggatcacgaagaagggggttccagcgaggaagaaggcaactgctacgtgaatccaagaagctggcatcgacgacccacaaggtagaatcaccatagttgatgtcacttacagagtatgtctccttgtcgatctgaattgtagccttgtcgtctgcacaagttagctcgtaggattgaacaccgcactccggcgggtcacctcgccggcggaacgggaacgacacgtcactgagatggccgcatgtgaacggagggcagtcatggcgccgatgatgccgccggccacctgcagcatctggaacgagaaccccaagcacacacaagacataaattactcgcatgacagtagagcaatgcagagcaccatgaatcgcaattgccaggttcaaagaaaagcgcacaggtcagaacaagatggacgaacgacatggttgatattgcaagcgcttccgtgttccagttgaataagcaaaaagaaaaaaaaataatatccgaatacctgagcaatgacgtgtttagctaatcagggctgcctgcccttgactgtgatgctgttgactgagagtctgagacagattcgttcgtttaggatagcttaacagacatgtccatatattctcccttcatcatcacttccgaatacctgaacaagttttgctgcacctcgttggtctgggaagtgggactgaatggtactcttctgtcttcttctgtctcatcaacagcatctcagtcaagatcaggcaatgcagccgctggaagttacaccgaaagcgtgcaattacctgccaccaaacctttaaaaaaagattatcaccagtctctcctttaccaccataaagcttcaccatgtcaacttcacgagttgatttcaacatcaccaaaagaaaaaaaaaagtctcatgtactagctttagatgttatcaaggttattggaatagtagccggaataaatcggtagtgtaaaatcaagggcatgggggagccaaaaatgataaggaataccttttgaagaaatagaacacgtcaaaagtttcattggctctgctcagagcctcagacatcatagcaagcacagcatcaatcgtcaccgagaaaacaggtgaccaaatatttctaaagcacagccctctcatcatccacctccatctcatctccattgaactgcatggacttcaccaaccttcttatcacggtgctcctcctactctctcctctcaaatacgaatccgatgttgccacagcaagtgatgatgaagacttcttcaagacttgttcatcccagcggtgcagcaagcatggaccagagatcaggtacccgttccgtctttcgacacaacctccatcatgcggtgcacctggtatgcaattatcatgctctggacaagacaccatcctggatcaccctgttcttggttcctgcaaagtgaccatgatatattacaggcatgttatcatgaacgccattccacttgtagattccttacctcactgcccacttcagaagctcgtgtcagtaaatcaatcaactgctgtgtacaaacctcatacgtcggaagttgcaagtgtagtaggttgttcaagagattccatagacacaaaccaatatggtatagttggcccaacctcttgccccagcctcgctaacaacgcaagccagttctggtatttggcatatccctatacatacatgtctattcttccattgggctgcacaattgtttccaaagacatcccaatgccctacagttacgataaaaatggtccaaactttgacatctcaatcttcccgaaacagcaaaaagagtcatcagcactggtgagactgtattcacttggtacacaagtaacgttactagtatttgccaacaatgtgaacgtgaaggtcggcgttgtggctttagctctcaaaggaatcaagcattctgccagcatcatagtatgtctctttctcaagtataaattcagtttcattatgatgacttgttttagtttgaattttcacttctctatctattacatctcttatttctcgagtattcagttttcaaactatccaggatatttttcacaaatagtcaaactatctagcaaactgtgaatcagccaaaggctagcttggatgaacattttggttctaggttcacaactgcaatttttctcaaagaaaatttcatcaagagatgataatgtctgatcattatgaaaatcaatatttttttttgtaaaattctcatagaaaaggttataagcaatggcagcacattttagcagatagcaatgatctaaagagcaagctttatttgtattactctagacattggtattaacttagaacactaaattggattcatatgg

SEQ ID NO: 23124 - DNA, 2405 bp, Oryza sativa
gtgttcaatccctaacacgctcacaatttcttcttaaaaaatggttggagggacatctctccctccaaatctcctatttttttagaccttttggtggtaagaccatagtcctgattgttagaaagttgcacccatcgagtaatcaagaatgtaccagtataatttacagcattaacaagttcccacagtgttaacagggtagaaaccagaacatatccatcttacacaacgttggtacgaaagttgtgcacatgcatatttccagcgatgctctgtaagattattgaatcaggtaatttcttcctcctaggcactatagataaaaacgtcttacttctatggttaagacaagaagcctccttatcctatttctatatgacaatgccaaataaacaagccatctaacaatcaggaactaattgtttctaggaaaaattataggtgtttctctcaatttatttcatccataaatcatgtcataactaataatctttcttcatatgtccaggtccgcgtgtcacaatcattgcaggtaagcaactaatttttttcttcattcttcctgaactgctcattctgtagaatcattgccttttctccaagtgcaactagctaaatttctctctttttttactcagcaacatcatctgtgggcacatttatagttctttcattaattgtggccactgcactctacatctccttgaagtcaaggtacaatgaagagatacatttgaaagtcgaaatgtttctgaagacatatggcacatcaaaacccacaaggtacacattctccgaagttaagaagatagcgaggcgattcaaggacaaattgggccatggtgcatttggaactgtatataaaggtgagctaccgaatggagttcctgtggctgttaagatgctagaaaactctgtaggagagggacaagagttcatcaatgaagtcgcaaccattgggcgaattcatcatgcaaacattgtccgcctcctaggcttttgctctgaaggaacacgacgggctttaatatatgaactcatgcccaatgaatcattggagaaatatatattcccacatggttctaatatttcaagagaactcctagtaccagacaaaatgctagatattgcattaggcatagcccgaggaatggagtacctgcaccaagggtgcaatcagcgcattctccattttgacatcaagcctcacaacatactgttggactacagcttcaatccaaagatttcagactttgggcttgccaagctatgtgcaagagatcaaagcattgtcacattgactgcagcaagaggcacaatgggctatattgcaccagaactatattctcggaattttggagcaatttcatataagtcggatgtctacagctttggcatgctggtgttagaaatggtgagtgggaggaggaacacagacccaaccgtcgagagccaaaatgagttctactttcctgagtggatatatgagagagttatcaatgggcaggacctggtgcttaccatggagacaacacaaggagagaaagaaatggtgagacagctagcaattgtagccctatggtgcattcagtggaacccaaaagaccggccctcaatgacaaaggtggtaaacatgttgacggggaggttgcagaatctgcaggtgccccctaagccctttatatcgtctcaaaatcaacttgtgatttagatcatgagaccgcatcgccatggtttggactttggagaccagcaaagcaatggagcttggccagcatttcctataaaatggcatcaccatggttttgtgcctgagtgacagataatccacatatcataaaatagttcttagtgagctgaagcatgcacatatagtgtttaattattaaactaaactgcgcaaccaggtatatgatatatcaccatgtactcatgtaattctgatatccagcaaacatatgccaatggattttatttgcaatataataatagttgatgacaactaaattaccttattccatcgttgctgctagtccacaaatcatccttgctgaacgccacaataaagttgtggtatttgctctccattcccttcaacacaagagatcgatcccgcagcgtgtcatatttactcccagtgctgcattttcttttcaagagtaaaaaaaaaagtgctgcatcatccagaagaggaaaaaaaattaaaaataacaagggaagaaagctaagcaaagggattattaccaatgcagcgaggctcaggatggaaattgactaataatgtgggaaacggaggtggtgtgagggacttgagaagacgataccattgaagacatcgggcttatagattcgaccggatcttgacacggtagcaataacagatggcgtcatggcggcggtatggg

SEQ ID NO: 23125 - DNA, 7908 bp, Oryza sativa
tatttatagtagtatttcatacaccgaaaaaagagtttaagcgtagtaaatatcaattgttggatccatgaatatggaataataacagccattatttatgaacgctaattgctagctagatccatcattgtcatcacagcctagctactggctaattcagctattccatcgtcctcttctgagattgcagtaagctcggaggagtgaaagtaagaatccatgacttgtggaggtggcatgccattgccaatgccatccccatcgcagaaaaatggtctcagaggcacttgcaacgcatccacatccccttcgagcatctctattgcctcgctcatcgtcgggcgatcgtgtgatttcatctgaatgcaccacagcccaacaaggcatagcttcctctccagctcatgcatgtcagcaacattggatatctcatcaacttgttgatctgctatcagttggtcatacacccatgctgggtagtatgccctgcttgcatttgagtttgcatttggatctgcattccttctacctccagccatctcaagcaacaacattccaaagctataaacatcggatttgtcggatataacgccaaagctccgggataccatctcaggagccatataacctactgttccccgtaaagccctatctgacacaaagctcttctcccttgggtacagttttgcgaggccgaaatcagcaacctttgaaacaaagttatcatcaaaaaggatgttgcccggcttgatatcaaagtggaaaatctggattttccaacccctgatgcaggtaggttgatcccttctaccaatgcctagagcaatctcattgagcttgtcccaagagaagcttctctcggatgagaagatatacttgtttagagatcctctaggcatgtattcgtaaaccaatgcccttctcatttcttcggagcagaaccccacaagacgcaccacgttgatgtgatggatcctgcctatggtggcaacttcactgatgaagtcttctccattgcaattggagttgccatccaacatcttgatggcgacatgaacatcacccgggagaaacacacccttgtacacagacccatatcctccttggccttgcgagtaagaaaaatcatcacggccaacggtgcgaacacaaacctgcatagcactgcatacgaaaaggctaatgaattttgcaatgcaatatgtggtgtgaccagcttgatagtgtatactgtagaattgagtggaatgcaaaagttaattaattaccagcaatccacttgacaagacacaaggtgtatagtatgaagagcttatggtaaagagaatgatcaacgccgcggatcatgtcgctaatggaaagacgcatgtcgatgtaatactctctggataagcctatcatgcatccccagaaacggaggtcaatagaaaggatgtcaatgatccggtctttgatgcctactctgggtaatggattgtcatggctatcagctaagctgcaagatcatttattggaaagagttaattaaacgggattggaggagaagagctaaacaaaatcggcccttttcagatgataaagtaaaggtttcgagattataaggaattagagcctcactccggtgctttctacttatagtagaaaataatccgagccgttgatcgtatataatcatagggttgagatctaattctactaccaccactcttagtggtagtagaaacgtggaggggtatatttgtccatagataataattcatgtaagggtattatcgtaaattattattcagtaactctaaaccttcgccattctcaagcgcctgaccccatccatcgtcgacttcgtcgcttgtccatctccctctccgcctccatcatctccagcgcgatcgacatctcctccccctccagcgaccaagggtggcccttctcctcttcgccaagccgctgaaggtccttgcccacggcggacgactagtcctgccatgtagctttgaccaagacagaggagatcgcggggcaattggacggcggacgaagttcgacgggttccggcgaacggcggcgaggtaggaggaatgggcaactgggaatgaacgagtgtagtatggggatgtggtggacggctcggattggccaagaaatgagctatggcagccggcgacgtgcggtggcggagctcgagtgaggcggtggcatttggtcgccgccggtgaccgtacgagcggctaagggacttgggaatgaggtgtttggatgctacatgaatagggactgtgcatcacttcacaagctgccgcggagctaatgcaaatgcttttgcataaacacgacagtataccagggagtttgcagcaaagagtgaatcaagatgttctaagcccccattagtagacattgtcctatgactgaaaaaaaaatcaatttagtggcaattgagggcttagctacccccatatgagcacaagaaaggaatcatgtagcgatgattcagagcgccagaatatgacagaatgcagttagatgtttcgatggtatgaaatataaaacaaatcctgaattacagctctgactgaaatgcaatttacatatgggcaaaactctgatagtgaaaaatctcatttaagcagtttatcagattttttcagtctcactctttcaggagcaaaacaacttgtttactgatccaggagcaggatgacatatttcagttcaaattgcctggactcatctcaccccatcacagttgcacacaaaaaaaatgcacaacacactgacatggtcaacacattgacattactagtagtccatcactattcaccttttcttttttacttaaaccattactgaacaatgaatatattgggacagtcacaagatccaataaacatcagtatctcaaagctcgtcaattagtcaatgaagtattcgacacaccatacaactgaatattacaagcagaatgaactgggcaggccttcttgttgtcacggagccacttcgcgatgttgcaatcctcgtggaagtcatgcccgcaggagagcgtgcggacagtcgccggccaccatcctgagctagcagatcgggcatgccgcatgcatcgttcagcgtccgatccagtgtcctgacgccgccgcgagcacggatgtgctgaaacctctgagcattgcggtctatcaggttcgccggcgacgccttccacggcagcacgcagcgagcgacactgttgcatattctgcatctcatgccgtgctcgcggtcgaggaggtgctcgccgatgcaagccacaagactcgggcacgcacggagggggaccggggatacggcgccggaatgtatcgcatctgcctcccaagtggccgcagcccacacaatcggagcaacacggaatggagatcactacccgccggcggaatggattgaatcctccaaagtgggcgctgccaagaatctcaggtcttgcgcaggggctccggcggaatcggacgcgcgcggaaggccactcgcagcggacagaaggccacgacggcgaaccaggatgccggcgtggaatataggagaggaggagaaacggatagacaggtgagaggtgggaggaggggacgcctgagggtttcgctgcaccgcgccacggcatgccgggaggagtagcgataagcaacgtgcgtcgggcgagatgcagtgcttttcgtcggacctgatgcgatcaagctaagaccgaccgagacagagaaaatagatcctgccaaaattgcccctaatatatattaggagattactaatctaccctttaaaatgaacggtcgagattaattctacttgtagtataatactccaagtagaaagcatcggagcattgctcaaggaattaaggcgctcacctaacagacttgttgaggcattttttgatgagaccaaaccaattaagccaaggtgttggaaatttgacggcaaatccacccctcatggattttacaacctctgcataactagtgtattcgggcagattaacggagttccagccaccgccgataggagtcatggccaagtatccacaagaaggttcgatgtcttcgacagatggtactaaagaaccaaaaaatgggagcatataataaacgaaggacaaagccgtggtcaggcaatccacgggatggtacacgtacaggtatttgctactactgttcgtaattagttcctgcgaacaattgacaaagccaacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagttgatgctactcacatagtatttccctgtgttgatccgaatggtggccttgccatcatcgctgctgcagtctagctcgtacgaccggaagccgcacctgcgactgcgagggtcgcctcgccggcgaaaaggatacgatacgttttggagatggccgcaggagaaaggttggcactgatgccgtcgtccttggacacggacgacgtgatgatcagcatccgctaccacaagtgcgagcacatacaggacggttgacaaagcagctgcttccattgcatttgcataccctgtatatactaatatagtgtaggctaccaagctagctacttgttgctcgctcggccggctcctacttataagtactacgacgtacgctacccggccagggttttcaatttcgaaattcaattttatgccggaggttaccgaaattaccaaaatttcggaaatttctgaccgaaattatttgaaaatttgactgaatttgaataaaatttgaccaaattcacataaaaatgtaaaaaactgaaaatttcgggcgagatttaagcatgccggtgagggcaaaatttctgaccgaaatttcgaaccgaaatttcaaatcctgacgctaccaaggaggggaaaagagaaaattgagtatccgtaaaacgagcttagcatggtttttaattggatattaattgagtatacgtaaaaatagaaattagcgcataattaattgttttaaatttagaaaatagattaacatggtttttaaaaagcaacttttaggtatatatatattttaaaaaaatactccctccatctattttgatagttatatttcatcttggcaggatacataattctacttatcatccatttaaacatgctactagtcattcctcgtaaacaatcgattctttaatatttacatttctcgatgcccatgtagctaattttgtatggaagaatagagagtcgtgcattaaatccgagaaagtcattaagagaatatgttgttggattgaaatatgcctatcaaaaataaatttttcagatttgaaaacatgactatcaaaagtagatggagggagtacaactgttagtagtatgtaaacatgcacatgaaaaaatgagtagttttttcattctttcagctcggccgaacctttgaagttcgaatttatattaggtagatcttatgctataggtcgtatccattacattctacctccatcccaaaatattgctatctagcatgagatttgacctatgtccagattcgttgtctaggatgggtcaaatctcatcctatgtagcaatattttgggacggagtaagtatttgttatttatattaagttgaccttacgcaaccatcgaactcatttgatgaaagaaaaggcagtaaattaagcaccgaactggacggcctcgtccagtccagatcaagtggccagagacaaaactctcggctcgcagtgctgaagcagtaactaaacaggctactcggtagtagaatatactacctttccatttttcttatgatgttgatttttcgtataatgtttgattatttgttttattaaaaaatagtatagatatgtaaaagtttgatgataaaatccagtcataaaaaaataaataatacttagtatatattttttactgaattgaatgcccaaacgttacgtcaaaaactaatggcgtccgctgtaaaaaataaacatacatgcgtgttgcaaacttctgactgtagtactgtacgacaacaaagctcaacttttgactgtacttgtatgacaacaaagctcgcgcgtgaattagcatttctgcgtgcaccaggcctaatttccacacgggaattaacctttactaaccggtttctatgttaatcgctcatgagattgggcatgagtcatgagtggactggagcaagtctacgatgctccaggtcagtcctggccggcaagattttccaaagtacccactccgtttcattttttttagataatggacccactccgtttcatagtttttgacttcttttactggttaaactctaatcaaatttataggaaaatacgataatatttttaatacaaaataaatatattattaaactatattaaatattagttgtaatgaaactaatttggtgttttagaatttagatattgctaaatttttctttaaatttaatcaaacttagaaatgtttgactagaaaaaaaaaagtcaaattgacttataatatgaaaaaaatgacttgtaacatgaaacacggggagaacatacagcgcattgttgcttacaatgaagcgcacagttgcaatatcctgatcccacatatatatatccacacctccacttcatgtacatatatggaatacctacagagtacagactacagttatctcttttttttttcaagggaacatactacagttatcacacacacaattgcttttgcacctagagtcagagatcaatatgagtagcaaattcctcgccatatatctcctgcttgctttcctcagccatggcacctgcagctacatggccaccacagcttcaggctgggatgaccacgacttcttcaggcattgtccaccgtcccggtgcagcaaggatggaccagagatccgtttccctcaccggcttgaatcagcaatacatcatcagcatgccgcgcttcatgcgcgaggctagcatgctctggccaagacaccatcctacatcacccaattctggggccttgcaaggtcacctccatagattacaaggaggccgtcatcaacatcatccatctccttccgtttccatgccctctccagaagctcatggtcgacagtttaccgcctgatgactaccatggctgtaacttatacaggaggattcctgcaaaaatagtaagctgctcaaaagagtttacaccaagtggtacctctccagttccgtacgaacttgaccatctccagaatgctgccgaaaatatcttcggcccaatatcctgccttagcggcacaggacagtacttctcatatttggtgcatgctcagctatacatgtatttgcttccattggattgcaggatcgtctccagaggctccattccaattcctggctcagactcctgcagtggcccaacgttcaaggaaaaagcagaaaaattcatcaactttgctgagacgactgtcagttgggggtcctttcaagatggagttctcgacaactgcatggcgtgtgaacgtcaaaagcaactctgtgcattcagctcacgaaggaatcaaacattctgcacaagccacggcaatcatcatggtactaactatcctaactgcacaaacatgatcgtaccacccagctttgttcctgaactagttttctactcttactatgattcaagcattcagccatacagtactagtgcaccgctctcaatacatatgctcaaaactatttttgcaggctagtagcctactactagaaatcatttagggaactaactagcttcatcaaacatttttgcacaattgccata

SEQ ID NO: 23126 - DNA, 6920 bp, Oryza sativa
gtttcctctagaagtagaaagtagctcgaatatgtaaacaagactgcaagggaacacttgactgggacaagatataatctaagtttttttttatttttttgccaggtcggcgaaaggaagccgaccaaaattcattaagataaaggaataattacagaggtatacacgatataatctaagttttggtttgttacctgatataacaggagctgcagttagatctttggttgctttgataatagattagtagacatgggaggtgatatgtggaagcctttataatttagcccataacccacctcaactcatcctaatcatccttatctggcatgacaaaaatacgagagttagcacacagaactgtcttatgatgatactgcaaaataagatgtaaggaaaatttcactattgcaaatatattcatatgatcatggtgcataaaaatttagagccaaaactctatcctaccccaccagggccatgttcgctgatacattttgttggattgctctgtttttattttcaagatgtaattatccattatctgttaaaaccaccaaccagaacttattatcttcgttcatacttgcaggttagcgtgtgaaagtcatttcaggtactgcagtactcaaacctacctttctattaaaaagagaaaagaaacaatgttatcagtacatataaattcttattgctagcagttctgagtcttctgactcagcattcttctgctaaaaaagacaccacctgctcttacagtacccatcaggcaatcacaatcagttgattactagccacaactttcgatcctaatgcaatgtgctaatttccccttctctgttaattcagctacatcatcggtagccgcatttgttgttttttcgttcatcatggccacagcactctatctttcactgaagtcaaggtatgatgaagaggtacatttgaaggttgaaatgttcctcaggacatatggcacatcgaagcccacaaggtacagtttctctgatgttaagaagataacgagacgcttcaaggaacaattaggtcagggtggatttggaagtgtatacaaaggacgactaccaaacggagtgcctgtggcagttaaaatgatagaacactctacaggaaatggagaagagttcatcaatgaagtagcaacaattggacaaattcatcatataaacattgcccgccttctgggattctgctctgaaggaacacggcacattcttatctatgaattcatgcctaatgaatcattggagaaatgcatattcttgcatgaccctaatacttctcaagaactcctagcaccaaaaaagatgttagatgttgccttaggcattgcccgaggaatggagtatcttcatcaaggatgcaaccaacgcatcctccattttgatatcaagcctaataatatattgcttgactataacttcaatccgaagatttcagactttggtcttgcaaagctgtgtgcaagggaccaaagcattgttaccttgaccaaagcaagaggcacgatgggctacattgcaccagagctatattctaggaactttggggagatatcttacaagtcagatgtatatagttttggcatgcttgtgttagaaatggtgagtggaaggagaaactcagacccgagtattgagaaccaaaatgaggtctactttccagagtggatctatgagaaagtaattactgagcaggactttgtacttagtagggaaatgacagaagaagtagactgaaggttagacagatggccctcgtggcactgtggtgcattcagtggaacccaagaaaccgtcccacaatgacgaaggttgtaaacatgctaactggaaggttgcagaatatagaggtgccccctaagccatttgtttcatatgaaagccatgttgtgccataaatcatagtaatgttatgggagttatacttagttgacgtgctgcatagtaatgctgattaactgtatgaggtatgaatcgtcgctctttattaccatgtaataaaagtaataagaaacacatcagttgatgtgattaccttgttcagttgttgctatgatatatctccatccaaccaccgtgtgcagagtactcctcgttgcactatttcagtaagatgccctcctcgtccgtttcatgggtccataactagtggtttgcaacaaaatcctgcaaggaaattgaattatggcaatttttcccatgcagaactaatataaaatatcgaagcaaagagtattatttttgtctgtttgtccgtgcgaacggccgactagggtaacattcataccctgaattcgtcactgaataaagaagtagattcatatcctaaattactcactgaactaagaagtataataagttaagttggcttggtcacattcctatccatcccattcaaaaagtcagggcccgcctatctatctgatggaaatctcacagcaaacaggatgctgctgggcaagcaatcgaggagctacgaatttgcaatgtgaagagatgaatgggcatggactcgactagtgaataagtacactttaataaaaacttaggaaaaataatcaaaagcagaggaaacgggctacctttatcaatgcaaggagggggcagcgaaccgaacaaccaccggatcaggagacctccccgagttctgtcaatcctgcggctcggcgtggcatcccgcttggggcctggatttgcggctcgggtctcacaaggacgcagggagaaggcgacgcatagcccgggcaacgcgcattgacggcggagcgcaaagcagagacatcgccggggaagcagaggcggctgggagtcggtgggatcgccggcgacggcgaagggttcgtggcaagagagggaggaaaggggattccgtacggtttgcaaccagaaactaagctcggcctagggctagtaatggggccggccctaaagctcctgccgctaatgggcctttatttgcatttgggccaaaaatgacctgcgggaggcctgtcttctttctgctcgtggaaaattccatgtaaatcgaccatttgttttttttttagagaaatgtacctttacccggcctctatatccaacctgatatatgtagcctttttacattagaaatttagctctcaaataacccaatctgaaattcgcttctatagagatttgaactcaggatcttggggtgttactcaggtcacggcaacaactaggctgcattgtgcttatacaaagccaaattttaaattttaaaaacttaactttgaagtagatttcgtggttttttcacgaaagtttattttatagaatttacttttaaatcgctaagaacacgtatataattttttttacctacaaattatttttctaattgctgtaataaatcatacaaataagcatatggaaaagcaaaatatgaatcggaatcgggaatcgctagtcagtcacgtaggaaagaacatagcaacagtgccgaccaacacagaacactagcttagctcgatttttgcatgcattcatacagatgaagcacaggataataaatcgtacaagcccacatatacgcattctacaggaatataggaataggagcatagaaactgcatctgtgtgactgtctacaatcatcacaggcttgagcacaacctgctcacgaaaagacatagacacactatacttgctacgtactccactagctaattcaactcagtgatactctcctcgtctttctcctcggagatggcagccagctccagctcggaggacagatacagcgactccattgccgggatgtagtcatcgtcacagaagaatggcctaggaggaatttgcaaacaatcaacaccaccttcaagcatctctatcacctcgctcatcatcggtcggtcacaagacctcatctggatgcaccacaatccaacgatgcagagcttcttctccaactcatgcatgtcggcggcagcggtgatctcacctgtttcttgtcgggtcagctgacggtacactcgtgatggatagtatgcctggcttgaattctctgcattcggatcagcattccttcttcctccggccatctccaatagtagcatcccgaagctgtaaacgtcggacttgcttgatataacaccaaagctccgagagatcatctcaggggcaatgtaacctactgttcctcgtgcagcgctcaccggcacaaagctcttgtcccttgggtatagccttgcgagaccaaaatctgcaacttttggaacaaagttcttgtctagaaggatgttgtgtggcttgatgtcaaagtgtagaatctgcagatcacacccctgatgcaggtagttgattcctctggctatgcccaacgcgatttcatttagcttatccctggagaaactcttgtcggatgagaagatgtacttgtcaagagaaccccgaggcatgtactcgtagacaagcgctcttctcatttcttcagagcagaaccctaccaggcgcaccacattgacatggtggatccggccaatggtagagacctcactgatgaactcttctccgttgcagttggagttgccatttagcatcttgacggcaacatggatattgcccgggagcaatacgcctttatacacagtcccatagcttccttggcctagcctgtctctgaaatggcttgtgattgcaatgatgtctgtgtagccatacctcattgggctgagcatctcttgcattcggaggaacttctcaactgcatcgattgtgatccttgctttccagtatttgtgggaaaggaaggttaatacaacaagcggcgccaacaggaacctgcatagtactacataaaaacaagtttgtagggttgtttaggattggtttaacctttgaatataataggatcctgaagtacctgcaatccaagtcagaatggacatggctggtcctgttccgtaaattgcaaactcgtatgcaacacgaggcaatttaactggagccattatgcactgccagaaaggcccatacgctaaaaggattgctagaagtcgatttttgatgtatatatcagacgatggcaccattgtttgacgaaatatgctgcaggacaatgccatggtgaaaacggaaataaaattaaggtcctcacaaggttttgttggtacaaatgggatgaaaataccttacctaacggactctgccaggcatgctctaaaatcaaagtgatatgtccctgatgaagaagaaattccaatggcaaaccctttcctcatgtatttcaggacatcagcatagcttaagcttgcattgatagacgctcccctgtcatccagaggtgtcatgcccaggtacccacaagaaggctctaggctctcaacataaacagtttctgactccgagccagtcagcacgtagacgaaggaatggctggtgctcaggcaagcgacgggtttgtacctgacattcctcgttatctccttggaacaattcacaaatgcagcccacctatttgtaaaaggggccagttcaattacttggactccgtcactggtaggggccatggatatgcgctcgtgtggaggttgatgctgccgccgcggaagagggcagctgctgttatgtgaattcagcaagtctgtgtcaacgacgacgaaaaggctccaatggataatgcgagtcacgtagtatgttgcattgttgatgcgaattgtggccttggtgtcgctgcaaaccagctcgtgagatttatagccgcaatcaggtggatcgccgtgccggcggaacggaggggaaacgttcttgagatggccccaggagaagggaggacactgcgctgtctgcgctgcctcctcgggcccgtacatctgcccttcaacttgaaggagagctgcaagcacagacaaggcagttagcgcctgcagggcagtggaagtagaacgacgaaatgcaccagccaccgccatggcagacagccagacacagacagttactgttcgactagctagctctagctgccgcccaagttaccaagttgattagcaaagctagttgacgcgggtgattacctgctaagtactgcactgacctacattcagatgttgactggagtaatccaattcttaatcgcagtacagttttgatttgatctttaacttcttccagtaagtcaaatgcactgacctgtgcattattggtctagacaacctacaatgtcaggctaacttttcttttctgaaaccgaggcaggaaatgcaattaatatttgtaaacaagaaaaatgggctccagaataacagcgcggagctcaaagcgggtacacacgttgtcatgttcttgtctatcaaacagcaagcaaacgattagcgaccataagaacttcagacaaaccgaatatactaacaaactcctgcctaacaaggacacctgtactggttttctctcaatcttaatagatttggccggcgtttcctttgccagcccagcgaaaaatatatagatcataaaaatgtttgtttttagcaccgactgcagaatacaagtgcagactgcccatgatttctactgactgcggattagaacgggaagaatttcaacaggcagaaccgaaagcacatttgcatataaactacttaccccggccggcagtatttccgtagtgtttcaattgactattgctgaagacgacttgactgcagcaagccagcaagttcccattggacttagacaagtccacaacctcagtcttctttatatgatgatatagcttgccaactttacaagagtttatttctgtagaagatacatgtttcatgaggttagttatacaaattagtgagaatagtagtatgactgaagaaaataggacatccctgagttgagacaaggatagtcaaaataaggatcacagtacagctgtcattggcaaaa

SEQ ID NO: 23127 - DNA, 2191 bp, Oryza sativa
  unsure (1)..(2191): unsure at all n locations
gaaaggcatcccaataccctacaattatgatagaaatggtccaaatgaaaatcaatacctcgacatctcaaacttaaaagaaaaggcaaataaagtcatcaactttggtgaaacagcatttacttggcaccttaacaagattaccaatgcttgtcaggggtgtgagtggaatggtcatcactgcggatttagttcacaaaggggccaggcattctgccagcatcaaggtatccttcatctcatatttttttttcacaagggaattctacaagttatttcttctatttattgtattaataattatgttatggaattcataattatcaagctttttttaaacaattcctacaggatttttacctaaaggaagaccttgatgaaaactgtaatcgtcttggaaaagttctaataactagtacgaaaaaatgaaccaaaccagtggaaggacatgccaaattggaccttcctcaataaataaataaataaaccaaactttctctccatctccaggtttttagttatcttgacttgcgtattttagagcactggaattaatgcagatcactctaaccaaggtcatttcatgctaaatactatcatactaatttgggatgccactcttcttactcatcaaaattggacttaccgacttagacccttgggtgctaatacagtagtgctgactgacacaaaactgatctaaccattatgaattagaggttcctaacaaagttatagaaagttgttttcccttatctttgttattactaaactttgatgtaaactatttttttttcttccttccttcaggttcacaagtcatcctcattgcaggtaatgcagatattctgttcttcaaattctcgcctgtcagcaaccaagattttgtgtactcttgttccaataagagttgctttgttcctttttctttttgtttcaaaaagcagatattagctcacaccttgcttatcctaatggaacaaactaatttcatttaattttacacagctacatcctcagcagccacactagttgttcttttgctgatggtgggcacaacaatctatctttcactaaagacaagatataatgaagagatacatttgaaggtcgaaatgtttctcaagacatatggcacatcgaaacccacaaggtatagtttctctgaagttaagaagattacaagnnnnnnnnnnnnnnnnnnnnnnnnnnnngggtatggaaatgtatacaagggtgagctaccaaatggagtgcccgtggcagttaagatgctagaaaattccagaggcgacgggcaggaattcatcaatgaagttgcaaccattggaagaatccaccatgccaatgtgcttcgtcttttgggtttttgctcagaaggaacaagacgcactttaatttatgaattcatgccaaacgactcattggagaaatacatattctcacaaggtcctaacgtgtcacgggaattcctagtgcctgacaagatgctagatatctctttaggcattgcccgaggaatggagtacctacatcaagggtgcaatcaacgcattctacatttcgatatcaagcctcagaacattttgctagattacagcttcaatccaaagatttcagattttggacttgcgaaactgtgtgcaagggatcaaagcattgtcacactgactgcagcaagaggcacaatgggctacattgcaccagaactgtattctcggaactttggggtgatatcttacaagtcagatgtatacagtttcggtatgttggttttagaaatggtgagtggaagaaggaatctggacccaggtattgataaccaacatgaagtttattttctagaatggatttatgagaaagtattcactgggcagaacttattgattggtacggaaatgacacaggatgaaaaatacaaagtgaggaaactggcaattgtggcactatggtgcattcagtggaaccccaaaaacaggccatcaacgacccaggtggttaacatgctaacaggaaggttgcaggatctgcagatcccctcctttaaaccatttgttcccttccaaattcccctttgcaagcgaatctataccataaaaaaatgaagatatcaccacgggtggcacatgtttttttttttgggaatacgcgaggagcgcatttttgtattaagaggaataaaagttattta

SEQ ID NO: 23128 - DNA, 7668 bp, Oryza sativa
ctctgatgtcaagaagataacgagatgcttcaaggaacaattaggtcagggtggatttggaagtgtaaacattgtccgccttctgggattctgctctgaaggaacacgacacattcttatctatgaattcatgcctaatgaatcattggagaaatacatattctttcatgaccctaatacttctcaagaactcctggcaccaaaaaagatgttagatattgccttaggcattgcccgaggaatggagtacctgcatcaaggatgcaaccagcgaatcctccattttgatatcaagcctcataatatcttgctggactataacttcaatctgaagatttcagactttggtcttgcaaagctgtgtgctagggaccaaagcattgttaccttgaccaaagcaagaggcacaatgggctacattgcaccagagctatattctaggaactttggggagatatcttacaagtcagacgtatacagttttggcatgcttgtgttagaaatggttagtggaaggaggaactcagacccaagtattgaggaccagaatgaggtctactttctggagtggatctatgagaaagtaattactgggcaggactttgtacttagtggggaaatgacagaagaagatagactgaaggttagacagatggccctcgtggcactttggtgcattcagtggaacccaagaaaccgtccctcgatgacgaaggttgtaaacatgctaacaggaaggttgcagaatatacaggtgccccctaagccatttgtttcatatgaaagccatgctgtgccataaatcatactagtaatgttatgggagttatgcttagttgacgtgttgaaatagtaatgcctagaaattgcataatatgcaccttgactgcacattgattatctgtatgaggtatgaatcatcgctctttattaccatgtaataaaagaaataagaaacacatcagttgatgtgattaccttgttcagttgttgctatgatatatctccatccaaccaccgtgtgcagagtactcctcgttgcactatttcagtaagatgccctcctcgtccgtttcatgggtccataactagtggtttgcaacaaaatcctgcaaggaaattgaattatggcaatttttcccatgcagaactaatataaaatatcgaagcaaagagtattatttttgtctgtttgtccgtgcgaacggctgactagggtaacattcataccctgaattcgtcactgaataaagaagtagattcatatcctaaattactcactgaactaagaagtataataagttaagttggcttggtcacattcctatccatcccattcaaaaagtcagggcccgcctatctatctgatggaaatctcacatcaaacaggatgctgctgggcaagcaatcgaggagctacgaatttgcaatgtgaagagatgaatgggcatggactcgactagtgaataagtacactttaataaaaacttaggaaaaataatcaaaagcagaggaaacgggctacctttatcaatgcaaggagggggcagcgaaccgaacaaccaccggatcaggagatctccctgagttctgtcaatcctgcggctctggggcctggatttgcggctcgggtcgcacaaggacacagggagaaggcgacgcatagcccgggcaacgcgcattgacggcggagcgcaaagcagagacatcgccggggaagcagaggtggccgggagtcggtgggatcgccggcgacggcgaagggttcgtggcaagagggggaggaaaggggatggaaaaagtacaccgaaggttcctcaacttgtcatcgggatacgaaaacatcctcaaaccgcaaaaccagatatgcgggatctctcaactatacaaaaccggtcacccgaggtccctcggtggttttcatcccggttttgtccgacgtgacggctgagtcagcgtgggacccacgtgggccccacatgtcagcgggccacgtcatcaccctctcctctccctttctcctctctctctctctctcactcttctcgtttgggtaggcagcgggggacaacggcgtcggctggcgactggcgacgcccgccgttgcagaggccgcacgcacggaggtgggccgcgtcgagtgaggagaaagcaagggggccggggagtccggcggcgacctcctcaccggccgcgacgtcgccatcaagtccttccccaaccggcgacatggcggccggcgaggggagcaaggcgtccgcggcggcgaggctgttcttgtccgcggccagcttgacccggcgcaacgacgagccaggcgcgggcgacgagccacatgtggaccgtccacacgccgacgctcttcaccttggcgctggcgccgcctcgtccgttgcggccacggcggactccgagagctccccggccgcgaacctgccggcgaggtcgtggaggtaggccgccttgcgggcagagacgccgatggcgcggaggtcggcggcggagagggcgagcaccgcggcggggttgaccaccgcggcattgggatcggcggcggcggggaggcgcgtgaggaagcgagcgtagatggcggcggcagcggagggagcgagcgtagatcggctgttgctggccatggcgacgtcacggaggcggacgctgctcaaggtcatcgtcctaggcgacagcgggtcagcacactacactagctcatccttggctactgcaggcctagctgtttcatcttagcttgattcgaatcgctctagctatgcttctgtcagcttgatttcatggtgcttgtttgatttttgcctgactcctgacatggattggtttatttggttgtgattttggttttggtgcaggttggggaagatgtccctgatgaaccagtatcctttacctccatagctgcctagctgcatatcatcgagctttgtatcctgcacatctaccatggccaggatgagcttgagaccgagaggccggcggccgcgggaggcctgcggcgacgaccgcctcagcgcactccccggcgacctgctcctcctcgtctccgccgcctctacacccgcacggcacttgccaccggcatgctctccaggagctgggcgcatctgccccacgagctcccggccctcgatttcagggtcagcgacatactccgccgcgctatcaccggtgaccggtgcatcctccgccaccgcggcgtcgtcggcgcgtcaccagtcgccagccgccgccatcgtgtcgcccgtcaccggccgccggcgacgccctcgtcctctcccaccttgccccgccgaaggcagcagcccgccgacgtcctccccagctgccatcccaaacgagaagagcgagagagagaggagaggagagggagatgacgtggcccgctgacatgtggggcccatgtgggttccacgctgactcagccgccacgtcggacaaaaccgggttgaaaaccaccgagggatctcgggtgaccggttttgtataattgagggatcccgcatatctggttttgcggtttgaggatgttttttatcccgatgacaagttgagggaccttcagtgtactttttcctcttacaaaaggattcggcccaagagcttaaccggtcattaccacgagccttcatctagccttctaggaataagttcaccggtggtcctcaacttaacagggagattttttaggtcctttaaccacaaaatcaatacccctaaactcacacaaaccgtgcactcaagatcctatggcagtatatatgggttgtttagcaacgtggcatcctactcagcaaaataaaataaaaaaagtacgtggggcccacattgtcagctgcacattctcttttcttctccttctattctctttcctctcttcgctcttctcttcttcagtaagggaggtcgtcggcgggcggagcggcaatgggcgagcgcgatgcgtgcagcgagcggagagccgacagcggcaagcgagcgtggcagcggtccacgggtggcgggcggagcaatttgggagggagggggaggtggccggcgaccccgtccgagctcgtctgacttacgtgcgagctcgcccccgacgtaactcggtgtgctggggacgacgacaaggaaagggggagagagaggtatcgacggccgacgacagtggaggcgggcgagctcggtgacgggctgctcacgctcgtcgaccaggccccccgctctgtactcgcccaccgctactccgcctgtcgcgctcatggaggaggttgaccagcacgacgacgacgccggtggtgaagatctagagcatgacgagcgccgttgctcttgcccgccgcccatggctagcttcgctcgcccgtaactctattgctgctctcgctcgccgctcttgcttgccgctccgcctgccactctcactcgccgccccacccgccgctcccgccgtcccggcggcctttctccccctctcccgcttcttccccgcgcgccgccgcacccgctccgccgtcggctaccacgcccgcatctgcccgtctgctcctgaatgtgcaactgacatgtgggccccatgtatttttttttatttttttctgactaggatgccacgtcagcgaaactacccatatatattgccatagaacgttgagtgcatggtttgtgtgagtttagggtgcacatttctggttttgtggttaaaagacctcaaaaaatatcgttgttaagttcagggacctcaggtgaacttatatcatcaaaacgcagcgattgtagataccatagatacataaaatagatcaaaaggtgacatcacatctcaaggcatcagcatactgatatactgtttgtttggttcatttgattagtggaggcttgcagctctgtagctgtgccgctgcgcgtgctatgctttcctcctgcggtcagacaaacataaacagggtgtgtacatggaatttgttagtcagacataaatatattggatatttgaattacagctcccagcggtaacaacaggcactactaggctgtccaaatcgtggcatttcttttcagcaaaaacaggtccatataacctcccggagacttgaccatcactatcgggatgaactctggcgtgctcatgcagcagtagcacacacaccagtacaccacataaaatgcaacgaccaacaacacatttggccaatggccacacataacgatggcgtcccaatcacaaagttatgataaacgaaagcttccctctagttcacggcaaagaaacgacccggtcagtcaaggcaagaagctgcctccttccgctagccacactgacctctggagtcaacacctccagcgttgcagtgatccgaatgccacaccaaagcagagaaccaattaggaatgtattgagtagcattttttttcagaacttttttgaacgacttgcacagacagtgtgaaattcaaattgatatagtaggaaaaaattacaaaattacaaccttgggaggtcgtaatcaggaaaaaaacaaagatttccacctcccacgcaccgacagcaccaaacacaaattgggaagaaggctagcaccaaaccggacgctgctaggccaacaaaggaactacagtcgaggtcgcccaaacctatccctaacatctgacattaaacccctactctagccacctctttgggattgagagagaaaaagggtgagacagaaggatggaaccgctctcccccataggccctctgacatggtcaacttgcataagctagggcgctgacacgagaggacatgcatctagagagctagcttgcaccaaaagtctaggaggattcaaccagggttgcctagacgatgtctccagggagaggagcgaataaaacaccgccgccgccgtccatcgagctctcaaaaagagccaagactaggttttcacccaccgaccaccacctgcaaatccacggctgacacaccgatgctccaccaccgtcaaacctttgccgaaatgtgggaccactgcaccgacgccccccgccggctagcctccgcgtgccccacaccacaccgcacccatcggcagctcctcctcatgccgtgccgacctacgtcaccgccggccacgccttcttgcgccgtgctagcctccgaccactcctccaggcgtactagccagccgctgccacgtcggcccatccgctggccatgccggccagatgtagccatcgcccacgcctctcctccgctggccgtgccgaccatatgcagctgtcgtccatgcctcctgatgtgaccatggctactacggatacaaccattgcttacatcatggatgaacaacaggagatcaagttcaagacctccaagtgctggaatccgattcggccacctgctagactgctgacttcaaacggccgccaaatctacatacgacctccgttttcggcccgcgagtacttgatggaaagctcttggagtcctctttccaatgggttcagcctcatctctaaatcccatctcatttggccgcaatcaaagaaacaaggtgttgcgtcacatattataatgtgcttatgggcttgtaacttcatttgtgaccttggcccaagtggggcccatgtggggtgcgccccaatctggtggagcacgaccctaggaccctcttggtcatctctcacccctataagtagctaggtaccccttcagagtttcgagggttttgttagattaaagtttagacattcctacttgcttgcagcgcgcgtgtcagctaaaccatccgtcttcttgttcttcggaactccaactcatcatttgtattcaattcctatttgcaacatcagattgcttttatcttgttcttgcttgtttcttcgatttgcttgtaggaatagagttgatttgcaccggcaagatcaacaacccacggagaggtatatcaatcgctaaggtgcaacacaacgtctcgtacggttgtagtcggatcgtcaacgctcctcccaaatcgtggttatctgaactcaccgaaagatcgggccaacaacatccttgagtatcgagtggaactcagggttcatcacctccccgactagccgtctgcaccccgtccgcagccgcctgtgcctcccgtcgtagtcgccctcgcccgcttcccgctgtcgacatcgttgttgatgaccaaatttggtaaattatgaaccaggttcgacattgggatcgaagcggattcaataaagagattgattctgtcagagatatgggcccgggcgtatgcaaagtgtgggggagttcccttcccatcctcacacgtggctctacagcctggccctgcccccacgccccatgagtcgcaggcgcgaccggggggcctcggggtgccaggtcatgcccctcggggtgcggcgtcaggcccctcgggccctcgcgctgcggcggcccgaggccctcgcccaactgccgcgtggcggggggagcgtgaggagagagaggcatggctgagtataggtgtccaaacgggcggcacggcccggcccggcacgggcacgggtccggcacggcccgtttcggcacggcccgttaggcacggctgatgaaacgggccgtgccgtgccggcccacgtgccgaaccgccggcccaagcacggcccgtggatggccgggccgtgccgtgccggcacgg

SEQ ID NO: 23129 - DNA, 12017 bp, Oryza sativa
  unsure (1)..(12017): unsure at all n locations
ggcacggctactcgggccgtgccggcacggcccgttactgtagcaggccgtgccgggccgtgcctgctacaggttcggccgtgccccgggccgcccgtttggcccggcccgtttggccacctctgtggctgagcagccatcaatgcgcggcgccccaaccgtccctcaccatgtttaatgcggtaaggatgaacgtgcggtgccgcaccactggcccacgtcaaatcgggtgtgaccagtctgtgatcggcctatcgccggtcacgtccgattgacgcgcggtcgtgccctcacgtcgcctttgtctccggcggagtggaggtaggtatgtcccgtcacatcggggcgtcatcggagtcctctccacgtgagaaggacagtcaccagtcatcgcccatttaagagcgaatgatagggctgtcccccgtgtcaggcggggggcggcgctgggtcccacctagagacgcacaactaccttgcttccggttgaaggcacggatggaggtctgatccaggctaggtgggtccccctcccatggaggggtaggtatagacggtgcatgtggtatccccttgaactataaaaggaggaccttgctcaccgggaaaagggacgacactcggaaaaccccgaactccaggaagagaagggaagtaagctcttctaagttggggaacccttgtaatcctcatccataattccacacacaggagtagggtattactgtcacgaccggaaataacctaacgggcgttccttacatacgtgtattattccttgtcccaggaggcaaggtacaccaaaagttgatacaattcagagtttaacaagcggaagcgtaaatagttaattattacatgggcgacgagagcccagcacacagaaaggcaatggaaaacagcggaagactagggcgacgaccacaagcgcctgacggcaggcacgagctagacaccaaagccttcatcatccaggagctcctcttctgggtttgggaaaaattgagcaagactgagtacaaccaccgtactcaacaagacacacccacaagtgcagcatacgccaggacaaggttttagtaacaccattttgtgttactatatgtccaaaaatgtgttacaatgttattcagtaacacatttatgaactgttactatagcctatgttactgtagcgcaatctactgtaacacatctatgcgttgttatatataagaaaaggtgttacaactaggctatagtaacatgtatttaggtgttgccatagaccattgtaacaccattttctaccattaccaacaccgttggtaacatcattttctacttgaagtaacatatttgtaacattttattgtatatattacaacacaattactttttggattggtagtgcatttcacctaaaattactacatttagaaaaaaatactgcatgaagttttatcacttcaaaaatggaagtggcatgaccatatatacgtaataggagaaaataatcacaagtgaagaagtgaaatgatcataatatattgcattgcaataaggaaatttacagaattattgtttacatcttgtaacaaagaaatttataggcatatcttttaaaaagaaaaaaatacacattttagcagcaagctgctagataattgtgcaatacatctattcatatatcatcttcgcaaattccttcgcttctttcttagatcttgaagtgggcattcaactgtcagaattcagccactgatcatctgaatctgcataagaaatttattattagccttcacaattgcattaaataatattgacaatattcttcaacatataaaatgctactatgaccatacataaaacaacatagccatattgtcattttccttaaaatgatgatctgtaaccactttactaaactagttcaaaggcaaaaaaaaaagttgctcacagattcatctagcattaaactgaggccaattgccacctgaaaaatagattaggagtactaatgttcatcaagattatcaatgatcctgtcaccagtataattatctgatagtttcatcctttatatctgatgaaactggggaatttaaattggtttttggacagatcattttattactaagcttcatgttctttctcctctgttctgtcaaccaaaaacaatgtggaactaacctttgataccattgcaaccccagtgtggtagtgtcccattcatcttaaatatattcttgcaaacctgcttcagaggggaaaaaagacgacgtagcatcaaagtatcaaataatgtattgaagcaagaatcattagtatttaagtccatctaaagcaaactatctaacgccatgtttgtggagtattgactgtacacatcatgcttccatgcttcctccaaacgtgcctacacaccacaatagtttcctacacaccacaatagtttcctccatactacagtagaacgggggcccccccctttggtaaggtaatttttnttcctttttttaaaaaaatttgggggttttaaatttttcccaaaaaggcgcccccctaaataaaaagggtgtaatacaagattttggaaaaacacagtgctcaggaaaataattttctgttgaaaatgcaggaaaatagttcgaacggcacatttcttaacattgaaagctacagttgactgagatatacaaatcggatatcagtatccactgctaccaccatatagaagaataaatgattactactcctacaatggcaataatacattgggtagcatatcaaactttggagccacacaccatagaacaaaaagatataatactctatatatgcgctggatatgtcaacagttaacatcaaatatttttgcaacatcatatatttttgcagcaggaacttcccaatatgcatgtgagcatgcacttctgaaagttcttactactcctaccaatgacagtacaacttctatcaatcatctgtgaaggaaaataaaaagtaattatgaccttcttttcctatatagcatttctccaataagttggaaaatacccatagaataattatgactaaccagagaaagctgcagccataattaccttgcaccaagtgatgtgctctgtgagttcttctcctgtggttccatctttacaatctcgtaagcaggcacacatagtgatatagagttgctttgcctcattttctacacttaaagctgcagtgttagtttcttgtatcagaacttcattagacaataatatgtttgatttacttaacaaggcatggaagaaaatagatgacatgcagaatagtaccttaagatttcgttcccaaagtttagacatagcacatcttattttgaacttccatgcacaaaccacaacatgctgatccaaaatattgttcaaagctagtgttttaatcaaacaagttgacatttgtttgcaataagaagtcaacttgtattatattggttttgctcttttggccctctgttgtgagttgtgacctttaagtaatgatcaggcataactggattttatcgaacaaatcggtccatatatactgcctgcttgaaagagtcaacaacttaatccccttgaaaatactggctagctgcataaaaagttgttctgttgatggtgatcacccaatgtgttcatgaaactgaaagcaatcaagcactactaattcacagatttaggtttttttttttatgaatgatcatgttggcataagaattttgcaatttcgcgtgatcagaaaaagtatggagagatgtgaagataacatcaataatctgtctaaggacaaaattatgcttttacggagttggcatgcaacagtacacagtgaagcttttcatcaaacacatgatgtgcatatgtgtgatagagaacaagccatccactcctattaaagaagaatttagtgagacagtacacaaaccacaaaaaggattcctttgggttcttgtgatgtgctcaccatgcgtacacaagaaggatgcagtgatcagatgtgtttggactctccagcaatcagatgtgtctcgatcttgcatcctgcaaatgccaggaagaaagggatgggtgagacaggctagatagatggccagttttggggagagcaagcatgtgcggctgagcaatttactccttctcgccccctcctccgaagccgccggcgtctgtagtccctcgacatcgctcacgcggctcacctgacgagatcgatgccgctccacggacggaaactcccctttctcccctgcccacctgccaccgtaggggctgcgacgagccgactcccctttcttgtcgccgggatctgagtagttgataacacgagattgcagcagccagcagatgggaagcacagacctcggttgctcgggtgatgagtcgtgggatgttgggttcctcctggaaataaggaggtgatggggtagggggcgttgggtcttattatatcgtgaactgaagatgtggagataaattagccggttcgttacaagtgaaattttggcggcagtctctagacggaaagtcgagattggcgggaagtatttttatgtaaattgcgcatgaaaatagcacggtatttctttgtctaaaaactatgagaggccataatttaaaaaagttggtccacttgtaagtattaaattaaggtaattttaattttgtttatatatgtaacatgagatttacttctacattactgtttttgagatggaagtttgatcacaattctttaaccaaatataaatttatagaaatgtaataagtttatgagattaagaaattactttcaaaacaaatgtacatgtatcattgctatatgcacaaacttatcattttcgttgatattatttaaagttataataatttaatagaaacttttctaaaacattatatattttctagatcgaacgtagtaaatggtaaacacatccattaatttaattctatgttatttggctctaccatgctatctcaattagtttatcgtctattggtttatccgagtctgactaccttcataaatagcctgaagtgcaagtccaaacatcttatcactattttacttcctatacttttcacaaccaaccagagccgtctctattagacaccggtccttttaagttagtgttatgtcttcagcgtcctacgtgtaagctagagaagccacgtggctacaaacgtgcgaaacacaaaggtagcattcgatggaagatgattttcacaagttcagtgaagcttgcttgtggttcgcatattttgacttaaatttcattgtcaaagtaccctctcaattctttagaaaattaataaaatttctgccaatatgaagttaattgtgcatcccatacttatggacaagtatcctctacatgccgttgtgcctagagagcgtcgccagccgttgtcattgcagtaaggaataacaagatattatcactctttgcctccttccattctcattcatcatattacataaaaaagatacatatacttttccgtaaaattttattttccgcacattataaataacattgtatatgaaatgtaataggctattatttgttatagaggggaagattttgtttcattaacatggattaaactaatttattgataaggtgagtacaaaattattaaaactttatagaattccaaataaaactactactaatttatttctttataggtccaccctgtcagatttccatcaatctagttctattgtgcctgaaaaagagaaacacataaaactgattttgccgcgggtttgctccaaatttttgtgtttgtacgcttttttcctccctcaatttgccgggttttcttctccactatcggaagcagttatgatcctaatagagaaaacaaaacccatctccttactcctgaacataccgatccaatctctccagtcatcgcagcttctccacagcagatcccggcgcccgccacggccgacgacgtcgtcggtgcggcggtgcctcagccctgtctgctcgtccccagggcaagatcacccgcctcaacgcgcttctccacgccgtcatcgagatcgaggtcaactccgacgcgctccagcagccggcgcgcgccgacaccgagcacgcctctggccacagctactgcgggccgctccacggcgtccccatcctcaaggacaacatcgtgaagcgcgaccggctgaacacgacggccgggtcgttcgcgctgctcggctccgtcgtctgccgtgacgccggcgtgacggccggcctccgcgccgccgctgccgccgccatcatcctcagcaaggcaaaccccgtcccgaacggttggagcgctagacgctggtaacccctatcaccacgctaagctgtcgttttatctccagcatctcgtcttgtatgcaatgtgtttgtgaaattgtccataaagagcctcatgttgtcaattgacgtgatctggtccagccgcgcagcgccagcatgatgcatcatcgtgtcaaacgggtggcggcttacgcaggcgcgcatcccctgtgctttcagtttcagcaccagcagcaaccacctcaccgtgatggattcactggctgaatttgttcctgccaatcaacggcagctaatcatagtaagcacttgttgaatttgtttctgccaatcgatggcagattagttagcactctatttctttatgcacaccacatgttcgatactttgggccagtgcaaatcattggtcttattgtttgaaccgactcaccgctgtatacttctgtggatttaggcagctccagttagctactcacaggaagatcatttttgcatctactagaagctgcagcatggacatgatatatttgcaagatatggtgagcacactatttaataatcccaaacatcatattagtgctggcagtgattgtcatacttttgctcatgccataattgtttggaatgtcagattgcattaggaggtgatgaagtaagtgtttcaaacatgcaaattcatgtcatcatccaccagaactgccccctcgctactttctctaccgtatgtactagtaattattatagttatactctactttaaatttgatttcatgctggaactttcttaggagtaatatgcaacttgtgacctgtttttgctagcattattgttgttttgaatgaaaaattgatggttgcaattggcagatttctgctaacccgtgaatcagtaattaagttatgaatggatgcaaattctgctaaatacatagctatttttattcaggatagagcttcgagctacgacatgaataatactcatgtacatgaatgtacatgttaatacatacattaggataaatataataaagaactgcatgattgggtagtgtgaactagcctagcaaaatgcttgtgtttcctattttgtcctaagaggagttctgatttcagttctgttttttaaatcgtttggtggaaaatctgtcagtttttttataaaaagatatgtggaatgatgtagacactcccagtcttatatacggtcctcatcaaggttgttcaagttgcttaggattttattcattcatccttatgtttttttttgtctaggagcaacatctttgtaccatgatctaagctgtcaacgtagtatgatcagccatctgtggcctttcaattattctaattatgcatgtgacaagattgtcattttttttattcaattcagcgatctccaaggttgcatgtaagctttgtccactagatcatggatccaacacaagcctccacggtgctgttaacctcatctccacatatttagcaaacaaactttgtgtgagttaaagatcagattgtttaaccaaggttcaacaccactattttaacttgtggttattaaatttttaacacacctaaattacctttactttctatttcaacacagggaactatggatttaaatgctagtaaacagccaatgcttttctacagaccatttatgagcatttttggtagaataaaggagttttccgatccaatggccatttaagaattgtgtgaattagtgattattacagcagaagtgcgtggtcattgagtatgtttattaaaattctttgaagtggtggaatttaattacactgccaccacatatttgtcactgttgttgctatggaaagtacaaatattcatctatttgacatcaactgtttattttcaggcccattctttggttgtcaaggtggtaaatacaagtaaaggcttgttttgataacctctcttgcaggatttattttcaatttgttcaaggctgttggtattgcaccgaggaaatttattaccttctttttttttcaccttgaaatgtcatattgataacccaagtaatcatgtcatcaactcatatgtgatatttggagtgccttggagtgtattgctttgaaagcaatttgaatatcaacagagattgtacaatgttgctttctactctgctagtggagggtatttgttaattaagtccattgttgatggatgattatttgatttttgcccatgataatggattaaacttagatcaacatgctatctgcaatatatttatctgactacatatggaaattcttgtatactaaacaatgttatgaagtccaaaataatttacagttgagaactgcacaagtccaagggaactttagtctggtctattatagaaaaatggcaaaagcagaggtgattaaaatgagaggtatgagagaaaataaaagagtattagaaattttaagtaaacaatgcaatggaaagtaaacggttgatgtaaatctccgaacaaacgaatacaatacacatttgagttagtttgctatatggttagcagttttccttttttttttgtatatatatttggagacatgtcgcaaatcagagtaaaaaaacacaaagtaaaattaccacaacctaatatgcgctttccaggtgccactggattgcgatgcttgcgatatactccctccgtttcaaaatgtttgacaccgacttttcagtacgtgtttgaccattcgtcttattcgaaaaatttaagtaattatttattcttttcatatcatttgattcattgttaaatatactttcatgtacacatatagttttacatatttcataaatttttttaataagacgaacggtcaaacatgtgctaaaaagtcaacggtgtcaaacattttgaaacggagggagtacatgtttgagcccagatattattattattctttcaaaaaaaatcttggacaacagttgataatgtgattacgaggttcgctgaattggccactagtttggatggcgcaaacaataagtaaaatcatctacatgcacctagcaacaccaaggcacacttgcctacttggttgatcgagaattgcatataccaaaggtctagagttcaactccctccacaagcagcacttttttaccatatatttgttcgttgtctcagcattcataacattgtgttactataggcgtcagtaacatatatgtaggtgtatatttgttcgttgtctcagcattcataatattgtgttactataggcgtcagtaacatatatgtaggtgttactgtatgcagttcatgtgtaacataactcatatgtgttaccaagaagactgtaacacatagctttgtgttgctattgaactttcttgtaacacatgtcataaagtgttacaaaattatgttacaatatgtaggtcctggcgtagtgtaaatgcaaagaagtacaatggagttatagtatagggggttagggtttgcaataaacagcatttaagaaacacttagttgctcaaagctaaatttaaaacacgatcctataactatttaatattattaaacaaggccgtgaacccacacgaacctgccttaacccaaggtctacgatgattcagaccgaactggcaacccgaccctgggccccagctcgtcccaagccaacccaggccagccattccacattttagttattaagcaggttttaagaattgaaaacactaacttgggtacattgctaggcttgcccataaccgagggcgcggttattcgaataggttttactctgatcagaggtgtacatctttacccacaagacacgtcttcctcacgtgcaaccccgtgccacataccaccgcggcatatggacggaagacatgacatagtttccaacccatcctagccatagacaagagtaccgacccaaccccacctacgaccggaacctccgggacaggtaggcaggactgagcccctagcagcaggacaccagccctgtgccatgacatctcgactaccgggccgcagctcgtgtagccttcatttgtcctagagatgtccatcgacccctgacttcgtccatctccattcgtgtacttttgtttataaccagactgagccacaaactaagccttacccactagacatgtggaagtacggtagtgctttgcaacagaggcccgaagtccggtccttatgtggtcgaggtgctactatcaaaaccatgcaccccaagcccagcgtaaaaccattttgagagttttgaatagagggagaggtgtgcatccaattccacaatagtccaaccattccataaagtccaagagatatgaatgttcccaaagtctaaagttataaaaaccacctaatgttgtcttattaatcagcgaagcatctacctaaattcataccaggggaaccatgagtagagtgcccactagtaggggttttgtttattctagggtgaacaaggtaataataacaatagcaataataaggtcataacaaaggtaaataggcatggctaaataaaacagtgataacgcgggaatttaaataaagtgataatgcaataatttaaatcaaagtaatttcataaagtgggatccaatatgttcaaagaatgatgtgacttgccttgctcgctttcccaaacgtcggcttcaacctccacgaagagcggatctttcgaagctgcagcgtctacacgaccaacggaaaagaaaagggcttttactctaataaactccatataacaagcaagaacaaagcacaaaaatgggttcttgacttcttaagaaaaaattagagacttgaacggtccaattccgagttcaaatggccaagttatggccatttgaagtttatatgctctttaaatgaatatttacgaatttcttcatttaaattttaattaaaaataaaggtttattgcgtcagctgaggggaggggcgcgcggaccgggtccatgggagtggggcccacgcggcagcctctcggtccacggtggaccgggtgcacccgggctcacaccggccggcgccgtgggccccacgcgtcagccgcacccgagggcgcgggcggctgactgccgggccccacgcggtagccgctcggcgcgcccgaagacggccacgtcggcgcggccggcgggagacggcgcgcccgcgcccctatggtcgccggcggcggccataggcacggcggagcggcggccgaagaggggagggaaagggggaaacgaggcggcggtccacggctcacccaaggtcgacggcgacgacggaaaaggcgaccggagcggaggaaggcggcggcgcggctcgggtggacggggacggcggcgctccggtggtcggcgagctcgacgagggggtggacgggacggcggcgatgcggcgaagccggaggaggcgacgccggggcgggagacggtcccggcgagcgagaagaggcggccggaggtcgtcggcgacggaggagagagagagcgacggcgcgagctcgattccggcgaggagaaggcgcggcaaagggtggaaatgggcgaaggaggtgcggggagggtttaaatggggttgggaggggcagagggcggccggggaaggaaggaaaccggccgggaggtccggccgccatcaatggcgccggcgagatttgcccgggcaaatccggccgtttgaatgcgacagaaagagagggggg

SEQ ID NO: 23130 - DNA, 1594 bp, Oryza sativa
gggggagaggagagagggggagggagatgggccgaattcggcccaagagaggaaagggggatttttagggtttttctttttataaaacctttttaactttgtttatttcttaataattattatttgtgctctgaaaattccactaaaatttatttacacattttaggcttttaggaaatatacaaaaatcctccaagccttaattgacttttaactttgcacattttaatttttgaaggctttcacaaggattttaattattctaggcataatttaaagggtatattttagggtcattttgggacgcgacaattacgcttcgtagcggcccgaacctgtataatctcggtgctagtgtgcagttcagtagagtccagggcggatacaccatctccttgagcgagcctcttcccccggccgaactcacaaaggggggtctcacgatctcccgctagagaggatcactcctcgacagattcgaagaacggagtatgcatcggctgcgaaggcatcggctggagtctgcattgactgagatggatcggacagagggtagccgatacagccgatagaggtgatgcagccgattctgatgatgatgactttgaagatgcttctagaattgatcaaggtacttcacgaggattgccgtgatggagataaagctctcggataggcaattgtatctattaattaggatatttcatgtaatttccttagagatatgtttgggcaaaagtatgccgcaaagacttatggtatcttagagtttgttagagataaatatcgtgtccggcaaggacatatcttgtatctagggtataaatagaacccaaacccatataatcaattaacacacgttcaatacaatctcgtgcgcatcagccacccttttacgttttgttttcatctacgacgaagttctcgtctttcggcgtgagctgcactgtttcgatcttcaactagaggtaaacttgtcatgatggcttgcgttctcgggattagtgcttccatctttatgatactctaatattgtttatataattcgtcgagttatcacatatcctatataatctttgacaatattattatctaacctttaatcggccaacatctatcgttgtaaggcagccgattaggtttgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatccccccccttctctctttgtgggcatggtcctccttttatatcttaaaagggggggggggggggaataccccaacaattgtttaaccccccttttcctttttccccccttttttttttttcccccccccaaaaaaaaaaaaactgacttttttcttttatggcggagattggtatggttgccgtccgaatgacacttc

SEQ ID NO: 23131 - DNA, 15196 bp, Oryza sativa
ctttaatcggccaacatctatcgttgtaaggcagccgattaggtttgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttcgggccgctgggaagcgtaataccctactcctgtgttttttggtggatctgtgtaagagcaagttacaaaatatcaaccagccctctcctctcccgggaaaatcccccccccccttctctctttgtgggcatggtcctccttttatatcttaaggggataccacatgtaccctctcctttccaaactggacttttcttctctttatggacggagattggtatggttgccgtccgaatgacacttcgatgggacagcccacacctacttccactcccggcggagacaggcgcaatgtgggatcgtggctgtctgttgctgacgcgaccagtgtcagaccggtcacagatcggtcattcttgtcctctatgcgtcagttcagcgatctgcatgatcacccttctttttatagcatcttgcctgtaatggttgggatgaagcctggtattcatttaaccagggctaacgtgccatctctaagaggtaacacgctagccccggctggagacgtgtgcctagaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgtttgaccagaccgcaataaatgcggttaggtgagccctaccgtgttcacccaacctatgtacatagtgcaaaccccacagggggtcggggcacctcggccctcggggtcggggcaggagcaacccgaccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcaatcatccttctcaagggaagcggccgggcatgacgccactcatgaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgtagatttgtttcgtctggagatatggtaacgtcgcttcggtcagcgagcgtaattaacgcacacacgatacgatctatctcgactgccacaaccgcatatcttccttatgcgccgcaagcgggcgaatgggattagtggaagcgtgggcgcgagaaacgagggagcgagatagcgagtaacgagggagcgagatagtgggcacgagaaacgaggagccgggctcagcgatggcaagggtataaagctatcgaggaaaggacttgctcccttcctttcgccactattcccctttccttcgccgtttgcgcccctaactctctctttgctgcgcctcaccttcgccacacacactcgttctcaaccctctctttctccgacgacatggcacggggctccgctctgctcgacggtagcgtactaccgccttcccgcattgtgagtgagaggcaggctgggctgccgcgccgcttcatgccggaatccgccaccggccgggagatagtgatgctgggcgaggcgcgcccagcgccagattacccggggcggtccatcttcttcctccccttcgcaatggccgggttggttcctcctttttcttctttctttatggatgttctggagttctatgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggcggctgctatttcctgccgcgggggccggtgttgaaccgctacatcccctgcgtcctccgcaaaaagtgggatgactggaagagcgactggttctacacccccctcgccgacgaagcgcatctccgacttccgagccagcccccggtgcaggcctccagctggcgggcgccggtagatctggtgtcacgccctgaagttcccctcccttgctctaaattcataaaataaatcgttcgaagaaattgtttaatttaacctagagagaaaccctaaattaataaacgcaaataataatcggaatcggcatgtggaatttttcttgggttctacatgtcaaaatacgctaacaggatttttagtggaattttcagagccttggaaataattttaaccaattaaaatgagcaaagtgcaatattaaatccctgggaaaatcctttttctttttctttttctttttcctctctttttcctcctttttgtcaaatgggccgtcggcccatttcccttttcctccccctcctctctgctgggccggcgacaggccgaggcccagtccggcggcccaggccgcccgccgcctcctctctcggggtcgccgacaggtggggcccacctgtcgggcccgtctccctcctcccgccgatcccggcgcgccgccgcgcccgcaaccgtcgccgcgcccacgtctccgccttccccggccctcgtcgaccacgcccgcgcgtgcgccgcgtcccccgcgcccacttccctctctctcccgctcgcgcccgcgcccgagatggccgggattcgaaaatcggatcccgcctctctctcctcccccactccccacgtcggccggcgattcccgccgctcccggccacgtccggccccctctccccttatttaagcatcgccggcaccccctctctccttttccccatttcgccgacccctcccgtgctccccatcgtccccgcgccgtgcaaccacccaccgccgcttcttcccgctactccggccgccgctagccgtcgctaggctcgccgccgtcttgcgccgtcgccgccgttcgattcgcgtggccgagatccaccccgtccacccctcctccgtcgaagttcgtcgccggagccctcatcctcttgcgcacgggtgagcaccacctccaccgccgccgtcggccatggtttccgatcgccgtggtccatctccctctctctaacccctcccaaccttttctctaggtcctcccggagatcgttcgcccgtcgccgtcgtcctcccgtcgctcgtcgtcgtcgttcgccgtcgtctccactcgcgccggccaacctcggtgaaaaactccccctcctccccctttccctctcttccgtgtgcgtcgccgtcctccgcgcgcgcatcgtcgtcttcggccgccgccgccgcttttcgcgccgtctgccgtcgccgtccgtgccgccggttgccgtcgccggcgaccgcgcgtgccgccgtcgctcgccatgcttggcctgccggctttgaagccgagccgagcaggccgccttttccccccccccttgtgtcactgccagtagggcccgcgtgccggcgcctctccctcactctcttgagccgccgctcggtggggcccgcttgccagccgcccctctccctccttgagtcactgacccgtgggtcccgcatgtcggcgccgccccaccccttgctgacgtcagccctggggcaatattgcgcaataaattgattaagagtttttctttattagtaaaaacacagataatcttctaaaaatcataactaattcatccgagctccgtttaagtccattcaagtctcagtaaattcataaaaatgtgtagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgttttccgtatgccattgatagctggggtattaaaatgactagatgttggtttaggagatgcttagtcatgcttagttcaactagtgcacaaagggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagtttagcttaatgaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaaggcgtggatctgtatgtcaacaattgtcgtttgtgtaccctggctggtcctggacaggggtttaatacacattcagcttagaaattctggttcgtgaatttctgggcgcgacatctgggggatggctatgtcgccgtcctcgaccgcctcgcgggcctgcgatcccaggggctcaccggggccatggtgtacggcgactacctccgtcgtcggattgcgccgctccagcggcgcgctcgggccgcctgggagtacatcgggcccgaagactatatgcggacccgccagggggtcagatgggattgggcccccgaggatttcaagatactgatccaacgggtgctaaatctcaactccgtggaggcgtccctcatcccccacggtatcctccccctctgcagcgacccagatcgcgtctccatcttgaccattatgacggcggtcggggcctcagaggagcaggctcctaagggccatggcggcgcaggtgggagccgccggggggatcaacctacccccggagggggtcgtgcttctgggccccgcgtcgggggctcggggagcaaccgccctaccgacgcccgggggaagaggaaactgggaggaacacctcccccatctcctccccgagggggcggggcggcacgtgccagcagcaggcgcccggagggggccgcgccaacatcgcagcccgagggggagcgcaagaagaaacggctgcgcaagatgggggagacagaaccatcccagggaaacctaatttcccctccaaggtggtcatttaaccgaccccctcgcaggttcgtcccgctctctttgcgaccgtcttttcttctatcccaaaagcaagttttaccttacctattttgtttgccttctggttttttcttctgcttcagcgatgtcccgtcgcgtccctcccgccatcccaagtccggccaatccgaggccgaagatccggcggccgcagaggaacagaggcgagaatctgaccggcgagaggccgcagatcgccttcgggaagctgaagaggccgcccgggaggccgctcgggttcggcaggcggaggataccgctcgggaggaggccgcccgggctcgccaagctgaagaagccgctcgggaggaggccgcccgggctcgtcaggctgaagaagccactcgggaggaaaccgcccgggctcgccaggctgaggcgatggcgtcttccgaggcggttcacaacaagaccgccggcgcgtcgctcgggcccactccctcgggtgacgctcaggcgacaacctccggggcagcttgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccaccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcgtcgccaccactgcgatgattgaggcgcaggactccctccgccttcaacacgggagctgggaggcggagctaaagaaaaagctcgacgccgcccagggggtcctcgacgccgccgctgcccgagagcagcgagcaacagaggctgaagcggcgtcccggcggcgcgaagaggcccttgaggcccgtgccatggcgctggaagatcatgccggcgccgtggagaccagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccacgacacaacggctggcagacagcctgtccctccgcgaggcagcgcaggaggagcaggcgcgccgcaatctggaatgcttccgcgccgagagagccgcgctggagcagcgggctgctaacctcgaggcgcgagaaaaggagctgggcgcgagggagcgcaacggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaattccgcgctccaccaatctggaaggcctcgccccgcaccttaggaggatggcctgggctgtccaacaactccccgaggaactcgagaagaccatcaagtcatcctcgagggacctcgcccaaggagcggtggaactcgtgttagcgagttaccaggctagggaccccggcttctccccatggatggcgctggaggagttccctcccgggaccgaggacgatgcgcgcgcacgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcacatttgaatgagcccccaggcccccgccaatctccaattttttctttttctttcttcttttcgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccctggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgcagtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagggagtttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcatactctgctatattattggtcgctcgaaagtcaaggcggaccagatatctaaggacgtctcctgtcggggaggtcaacgtgacccccgcaccggcaccctggagggacagagaaccatcgaactgcatcactcagtaggtggtgtgaggtagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgaccgagggggtaagacgtaaccgcagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggacgtatccccggggcgttcttcgttcaagtggcctttcggggcacacttgtcttctgtgccgatgacctcggggtcggaagatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcatagaatgggggtgcacgaaatgaggattgtcttcaccgcgctccacaaccaacgctgcactaactacttggggggtcgccgctaagtaaagtagcaggggctcatttggctccggggcgactagaaccgggggagagctaagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatgagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccagggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcaatggtggccccaggttcttggaaacctaggtcatcatcaccatcatcgacgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaattttttcgagcatgcggttgtgccgcacacccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcaatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcttccccccgcttgggactttggcgtggaggaggtgggggagtacgagctcgacggcgcgggtttggctccccgtcgtcgccgctcacactcggagagaggtcgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtgtgtggaaagatcgcgtaccaggaagaaacgtgagacacggacgatgtatacaggttc

SEQ ID NO: 23132 - DNA, 5755 bp, Oryza sativa
gacccccccccccctcggggaaatcaggaggagggcggacacctcaccctcgggcccgacgtccccgaaggtgccaggccacgtgggcgattccatctgcctcaagcctccgggcgcaatactcccggtcccatatcaccgacaaggttaaatactaatatcgacttagattatatagggtatccaccatcctatgaaatatccaacggcttgattgtctagatactgttattctttccatacttataactgcatcagttaagtttgaccttataagtcgtgattagaatctcaatctctagcctgcttttggttgccgattagggtagtatcggggtttcagccgatcttacctgatttaactcctttatattttatatgcttgattgatatgttaaatccgccctttatattaagatcttgttgcatttaggtatattaaacttcctgtttgatatattttgcttgctttaatatcttaatatagaatggtatcggagttttagccgatacatgctagatctatctgatcggctatgctatgaatgcttataatctccttgttaatatatattttgatctaagtgatttatactatctcggcatggcgaccgatatatcctaatcacttgatttaagtatatatcgacagaagcattatataccattaatatttacagccgatcgaatagatttagttctttctttcctatttatgactgccgatcgattcaaatatgtcatcggctcaaagataaatgatatgtcatcggcgactggccgattggctatcatttatggatttaaccgctatttttttgtctttatttcttgttgattgcaggatcaaatcaactggcacgctcacgaacctaaaggcaagattttggacctgcactgaagttaagcagatcttccaggccagtgtgtgtttttcgcatcaacttctattgtttgtaaataaataaatagcgtacgaaattcatttcactgttgccggcccggcagaaaattcatttcactgtttacaatcgtttctagcttcagcattttacagcctacttacaagctagctagctagctgacttggcttccaagcagacacaagctttagtgctcatcctcctccgagatttcagttagctcagagaagaaatggtaagaatccactgttagtgtgaacgcaaaatatgatcttgcggctaaacctaaagtcggcaaagagatattttgtttagggtgatcgctacagtgatcgatctctcatgaacatccctgatcgggggataaccgccataccctagtgtcggttccccctgtgtgcagtggctataaatagagatcaatacctaagtgttaaaccctaagagatttctctcgctacccgatcaaacaacccactgaaacacagggaagaatcaagacacgattctcttcgtgcttccaaactagaagagaagaaagaagaacaaagacagagagaatgggaactccaggagatcaaggtatgatccaatcccattttaatttgtagttccactttgtgccaaaccgattctatcaaatccaacaatggtatcagagcaccgggttggcctcaaattggaactcaataagtgtttatgttcaaattgttcttcgtgttcatgcccaaatccctctgttaaagttgagttaagcccaaatcatgcaatcccgaaatataagaaatggaattaggccttctagggtttcgggttgaagaaattagaagaaggggaaagcaaaagttcatgcaaatctcagacaaatccccaagaaccgaaaccctagctacagtaagatcccaaatttttccccaaatcatgaaaccctaaccctaaaatcaaggggaaaaaggagcacggcgggcttacttaagggccatggtggccggcggcgaccaccgtgtcgccaccgacgccggaaagaggcgagcgcgcgcccgaggacttggtccccgagcggcctcgcgacccgtcgtgctggcccggctcttcctcttcgcgtgctcgtctcgccgacgccgcctcgctgaggtagccgtcgccgccccgtctcgccgtcgccgccgcggatcttcctcgcgcgagcgaccggcgggtgcttagggcaccgtcgagcaacgctcgacggggatgcgcaccagctatggcggcacgcagccccggcgagcaaggctcggcggcgccacctccaccccgtcgtgcgccgcttcgccgtcgtcatcgtctcgctcaccgtcgccgcgggcgtgagagaaagaggggaggagagaatggggctagggttttcaggggggggggcggccgcgcgccggttttgtcccgcgcgggagcgatcccggccgtccgatgagatggacggctcggatcggctcgtcccgacgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcacaaatttccggaataatgggcaatattgaacaacttaatggaagtaattatgcttcatggaaggagaagctggaaattactctagctctattggatattgattatgccctccataatgatcctccggttgagcctagaccggaaaatgagaattatgagacattaaaaaggatatatgatgaagtaaaggcaaaatgggatatttcaaaccgtaaatgccttatgattatcaagagctccattattgacgcaataagaggagcagtcccagatactcagacagccagagaatatcttgctaaagttgaggaacaatttaaaggctcttctaaggtttatgccaccactcttattaaaagattggtcaatgaaagatacgattttactgaaaatctgagggaacatattatgaagaaatgtcacatggtttctaagcttaaatcaatggaaatggaaatctctgaaggttttcttgtccatttcattatgtcatctctgcctcaggagttttctccatttacgatcaattataatgcaatgaagatcaagtggggcattgatgaattaatagccatgtgtgtacaagaagaagaaaggcttaaggcagaaagagttgaccatgcaaatttatttaagcactccgagaagaaaaagtataagaaatttaagaaggagtatttgaagcctaagcctattcaatttaaagaaaaagggcaatcttcgaatcaatcccagcagaataaatctggaggaaatccctatacagaagaaaagggaaaagaaaaggatgggtgctacttttgtggaaagagtggacaccgccaaaaggactgtattggatttatgagatggctcagtaagaaaggtactgatgttatttcttttgttgatgaatccctaaatattgattatgccaccaattcttggtggattgactcaggagcgacaattcatgttgcaaattccttgcagggattcgctatgaggaggaccctaagaagagggcaaagaagaattagagttgctaatggagttgaaactgaagttgaggccattggagacttcactctcacacttcatactggcttcaaacttcagctgcatgatgttctttatgtaccctctatgaaaaggaacttagtttcagtttcacgtttagataacggtggttactattgtacttttggaaacaatagatgtataattatgcatgataataaagatgttggtctcgccgtttgacgggaacaactttatcaaatctctgtgtgcgatgccacctataatgttgactcctcctcaaatgcaaatgtcaataccaaacgaaaacataacgataatgagacttcttcgaaattatggtagtatcgtttgggccatatttcaagggggggaattgagcgtctcattaaagaaaacatcctttatcctttggacttctcagatgcagatgttgatcactgcattgattgcatcaaaggaaaatattccaagcaaatcaagaaaggtgcaaatcgaagtatgggagttttggaaatcatccacacagacatctgtggtccatttaatgaaaagtcagtcgatggatttgattcattcattacattcaccgacgactactctcgttatggatatatctatccaatcaaagaaagatctgaggcattagacaaatttaaaattttcaaagcagaagttgagaatcaacatgattgaaagatcaaaattgtaaggtctgaccgtggtggtgaatactatggtagacatactacttatggtcaaattcctggaccttttgcgaggttcttacaggaaaatggcattaaggcccagtactcagcaccaggcgaaccccagcaaaatggagtagctgaaaggcgtaatcgcactcttatggatatggtacgaagtatgttaagtcactccactctgccggtaaagttatggatggaagctcttaaaacagctacaacattcttaacagggttcctagtaaatcagtccctaagacaccttttgaattatggactgggaagaaaccaaccctaaattattttcatgtgtggggttgtcctgctgaagcacgagttttcaatccaaatatgggaaaattagacatcagaataatcagttgtcattttatcggttatcctgataagtcaaaggcatatagattctactgcccaaatccggaagggttttttttaaaaaaaaggtttcacttggagaccaagaacacgctgtgttcttggaaaatgacataatcaaggggagtatgacacccagagaagttgttctggaagagaaacgaaattatattccaatgcctataattgaagaacccgttttctcaacacatactcatgttgcaccttcaatagaaagaaataatgatgcaacacctgctgaaactcctgcaactacttctagtagtgtatcaaatgatgagaataatgaggatgctcagcagccccagattgtgatagatgagcaaaataacgaacccgtcagaagatcacaacgagttagaaagtcagcgattccaagtgactatgtcacttacataaatgaagaggtgaataaacctatgggtgaagaggtgaatgagcctatactagataatgatcc

SEQ ID NO: 23133 - DNA, 721 bp, Oryza sativa
tatgaaaggaaaagaacatatgggatgtcatctaaagaaatcgatttatggactaaagcaagcatcaaggcagtggtatctaaagtttgaccaaatcataagacaatttggttttaaagaaaataaaaaggatgactgtatatacactaagtttaaggagagtaagttcatcttcctaatattatatgtcgatgacatactcttagccagtaatgataaaaatatgctactggaaacaaagaaatttctggcctctaagtttgaaatgaaagatctcggtgaagccaattatgtgttgggtatagagatttaccgaggcagatcaaatggtgttttggggctatctcagaaagcatatatagaaaaggtactgaaaaagtataatatgcataattgttcagcctcgcctgctcctataatgaagggtgataagtatggaaaattccaatgtcctaagaatgagtatgaagctgcgcagatgaagtcaatatcatatgcttcagctgtcggaagcataatgtatgcacaagtgtgcactcgccctgatttagcttttgttaccgggatgcttggcagatatcaatctaatccaggtctagaacactggcaattagctaagaagaccttgcgttatcttcaaggcactaaagacctcatgctcacatatagaaagtctgaaaaccttgaagttgttggttattcggactccgatcttgcaggg

SEQ ID NO: 23134 - DNA, 551 bp, Oryza sativa
ccagagcttgaggtattctcggattgcctgaactccaagtgccccgctgatgtctctgatccatgctttattgagcagggcttccgcgggcgtcctgcgtttgcggattcgaacaggaacatgttcgaagatggaaggcgcaatggctggtatacctccctcctgcatccagcaatcctcccagaagaggatacttcttccatcccccagttggcacatgtttgaaagatagcctacttattgctcagtgatcctgagtactagctagcatgcaccttacttgtaaaatgaatagcacatacagaattgtgctcaaagacaatgacttgataattaccttattctgtgttctgtgatagccttgatttatctttatcattcatattatgtagcctcaaacacttggacccctataggctgtacaatgcgtttgaaaattcctttgcatttcattcagtgcatcaataccaggtgggatcgcataatagaagcctgtaaggcaggcgattagctatggcatgttcttccttatttagtactacaatcctaaa

SEQ ID NO: 23135 - DNA, 2110 bp, Oryza sativa
  unsure (1)..(2110): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgttcttggggttcttgttactaagagtggagctgctgattttcaagaacaaccagcttgcgttcctttctcctgtggacatcttgaaggtatcaggtaccctttccgtttacaaggtgatccacttggctgtggtgatgaagcttatgagctagtctgtagagatggcagagctatattcacatcaacacaggaaaatattttgtgaaagacatctcctataacgagtctagattttgggttgtgatgctaatttagacaacagcagttgccctcttccactgtggaataatcttccctacttcaatgacatgggcactaagctgtacacttctgcagttcggtgggctacatttctaaattgctcacgggcgataaacaatggcatgtacatgcctgttgcttgcttgagtgggaatacttcttttgtttatgtcttgactacatcgagctcttactatgttcaaaacatcgagccttcttgtggatacttggctgtgattcctgtggatgatcgtacaaagaatgtaccagactatgcaagctatgcagatgttgtgaaattcatgaggaatggttttcctgtttcgtttcctcgagttgaatccccaagtcattctccagtcatcaaagcctgtgcgagagatacattccagtgagttttagctctgtatctttctcttgcttgtttgatcatcttataaaaaatatatatatcctcttttgcaattctgcagaaactttaaggagcaaatgtatagtaggaacattcaaaactggacttctgccattattgggaccgagctacaatttttaggatgtgtaattaattattactctagtgccacgcaagtttgggttactctcgttctggtatttgccgtagagattgttaagtgcattataggtactccagatatgccttaatctaaactattataattacacccaatttatccatagattcttattcacttcatgttgcagtactatgcaggttcatcttggcgccgttgactgttttgaccttcctcggttacaaataccccggaacaaggatatctatcgacgcagtagagaagtttctccgaatgcagcaagctcatggtccaaagaggtatgcgtacacagaaatcactgcaatcacaggccatttcagggagaagctaggccaggggggctatggttctgtgtacaaaggtttccttcctggcgatggtcatgttgctatcaagatgctgagcaactccatgtgcaatggagaagaattcatcagcgaggtttccaccattagcaggatacaccatgtgaatgtggtgcgccttgttggattttgctcggaggaacttaggagggctcttgtatatgagtacatgccctgtggatctctagacaagtacattttctcacccgagaagagtctatcttgggacaagctcaatgagattgctctaggaattgctagagggatcgactacttgcatcatggttgtgatatgcagatcatgcactttgacatcaagccacacaacatccttctggatagcaacttcactccaaaagtcgccgactttgggctggccaagctatacccaagggacgacagcttggtgccggtgagtgctgcacggggaacgatagggtacatcgctcctgagatgatatctcgaagctttggcaccatttcatgcaaggctgatgtttacagctttgggatgttattgctggacattgctggtggtaggaggaacagggagcagcatacatccaactcagcccatctttattcccaagctttggtgtatg

SEQ ID NO: 23136 - DNA, 10342 bp, Oryza sativa
  unsure (1)..(10342): unsure at all n locations
tttggtgtggatgatcacatctctgagatggatgattgctgcaattcttcatcaaagtcaagtgcaatctcagaggatgactgaagcaaactaggatagcgacttgacattcctgcccacgtatatattcagttcgtgccctgctttttgcctcatctttttgcgggttatttgtttcgctttttttcatctatccctgtatatatcttgctataattttctcctgctctattaatatatacaaggcaaagcttttgccttcctttaaaaaaaatatatattcagttcgtgcttatacaacaggggatgtttcttgactcttgtagaggtaagaggttaatatgaagattagtaggactaagaagaattcctcgttgatattttcaggttgctagatttttcatcagtacacgaccctgattgtactgcataaaaaggaagtaataatataggagttttgattgatggactttgacctgaccagaaatttggtctagtttgaggacatctttgttacaacacatgtgcttccatggaatttgagttctggagactggtggcatgttttgtgtagatttagatgcttttttttagcaggtggatgctactttttagggtgaccagtgaaaacctcaggacgtttaactccttgccacttttaagatgtggcaaatagttaattattccaaaaacgtctgccataattttctacagccacgtaatcccattctgggccacaagcgagtgagaaccccttccggtccaaccaaagcccgtaaagcacaattcatcaggcccataattaaacctgcactatctggggaatgctgggccgttgtgcagttttcatgggcctcaacaatctcccttttcaattcttttcggcccaaagtaatgtgcaggcaccacacgcagcccaccaaaagctcgccatggtactgtggcaggtaaaaactgggcctaagggtttgggccttcatcaggaccgtgcaaacggaattttttttatttatacttttttttattaaaatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattacttaaaaactaataatgcttattcgatactccaaatgattttaaatggaaaagtgataaactacaaagttatagatctcatcaagatctacaacttttatataaagtttatctccatccaatatcgtttgaaatatagatctgagattttttaaaatgtgttttatattttgtaacgaatatttggatatctaaaacatcttaaatgaaaaagttactaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgcccttcttgagggcggcaggcgattagatttgtaaattttcgaaacaaaaaattatttttgtaaatattttaataaaaaaaagtataaataaaaaaaattcgtgcaaacgttggccgagcggcacagtgagcgagtcgctgtcaaactgaaccgccggccatcttctcgcgtgccggcctccgtcgctcgccggagtataaccacagcatctacaaccataatcctccacatgaatagaaaagcagtatctaaggcacgtttttaattctgcctgcccttattgtagccttgaataccattctttggttcgtagcaatctcgctcatcaaacttaagtgcgagcaatactgctcactgacatgtgggccccacagaccctcggggcccacatgtcagtgagcagcagaggatctggattgcttgacgatactagaaaacatccatgttgctccaagaccttgagaaatgatcgacatcacaaaatttggacgtcccaatcacaacgtcgcggcgaaggagacattttggctcccattgtgggcgacatgtcaagcgtccgtgcctcgactacgaaattaattaagaaattcttgatgaccaaaattactggcacatgaaaacgagagtaaattaagaagcaaaacagtcactactcgtaacatggtataggtggttgaccgtaggccgtcgagcttgttcaacatgtagaccatggatacggtcatggcctcttcttatccatcgttcaactcaagcagcaggtagctttggcactatatatacgacgtgaggctttggttttaattattattaagtgaaaacagcatgcggtcagtggttttggcaccatatatagaacatagtgaccactatacatcgggaaaacaaaacaaagttttggtgaatggagagcagcatactactagaacatattgaccattatatatactatgctcaaatttgtactaattggtttgacatagtttttcaattataggtggtgagctttgtaatttaaaggttataattccatgtgtctaaacatggtatgctttcattatttcaacttgaagtgtagcatctactccttctgtcccattttaagtacaaccatggttttccacgcccaactttgatcgtctgtcttatttaaaaatttttgaaaaaaaaaataaaaatataagccacgagtaaagtactattcatattttatcatctcgtaacaacaaaaatactaattataaaaaaaaaattaaataagacggacgataaaaattgagcgtggnnnnnatgattgcacttaaaatgggacggatggaaatagtaaatactaaacaaaaatactaagtagaagactgagaccgagacagtgcatttagagatgctgatgagctgagaaacctgatcagttggacgaggtaaacaagtggtggatatgaggtgaggctgaaatcatgctatgactttagtggctagagtcagccggatcaacctgttaattctgtcaaaaaaaaagaagaagagagagacgtgttaattacagctaaaaaactttctaatccaaaggcaaccgaaccatgaatccatgacacaaatggcggcagtgtctacttgttgcactcaccatctcctacctctactcctcctcgctgccatagtcgccaccaccaccaccaaccacgccgccgccgccgccacgttgaacatcaccaacctatgccccttcaccgtgtggccggccgccgtgccggtgggcggcggcaggcggctcgacccgggcacgtcgtgggcgctcgacgtgcccgccggcgccgccccgggccgcgtgtgggcgcgcacgggctgcaccttcgacgccaccggcgccaacgggacgtgcctgacgggcgactgcggcggcgcgctgtcgtgcacgggctacggcgagccgccgcagacgctcgccgagttctcgctcggccaggccgacggccaggacctcttcgacatctccctcgtcgacggcttcaacgtgcccatggacttcctcccggcgccgccgccggatcagtcaccgccgtgcagcaaggggccacggtgtccggccaacgtcacggcacagtgccccggcgagctcagagctcatggaggctgcaacagcgcgtgcagagtgttcaagcaggacaaatactgctgcactggcaacgggacgaacacctgcgaacccaccacctactcgctgccatttgtgaggatgtgcccggacgcctatagctactccaggaacgatgcatccagcccagggttcacttgcccgtcaggtacaaattaccagatcatcttctgccccccaattgatctcacatcttcatctcctgcatcaattgctgttgctgcaaataacagacaaggaaaaaaggttattgccgggatcatcatagcttctgtaatcggctccacttcagtactcaccatggttatggcttacaccagcatcaagcgaagaacacgacggcgccgggagatacgtgaagaggagcaggagcttgaggagataacccttcaaggaatgccaaggaggttcacatttcagcagctacaggaagcaaccgatcagttcagagataagctcggtgaaggaggatttgggtcggttttcttgggacagattggagacgaaagagttgcggtgaaacgcctggatcgaaatggtcaggggatgagagaattcttggcagaggttcagacgatcggcagcatccaccatatcaatctggtgaggctgattggattctgtgcagagaaatcacagaggctcttggtttatgagcatatgcccaaaggttccttggacaggtggatctatcaccagcaaggtgctgctatttttcctagtgttcctcctctagattggcaaacacgatacaaaattattacccaagtagccaaaggtctctcataccttcatgaggagtgcacaaagagaattgctcacttggatgtaaaaccacaaaatatcctcctggatgacaaattcaatgctaaactctctgattttggactatgcaagctcattgatcgagataagagccaagtgattacaagaatgagaggcacacctggatatttagctcctgaatggctgacatcgcagatcacagaaaaggcagatgtctatagctttggcatagtagtcatggaaatcatcagcggaagaaagaatgttgacacttcccggtctgaacagagcatccatctaattaccttattgcaagaaaaggtgaagagtgatcaagttggtagatttgattgacaaagataataatgacatgcaagtacacgagcaagaagtaatagagatgatgaaatttgcaatgtggtgtttgcagatcgattgcaaaaggaggcctcaaatgtctgaggttgtaaaagcattggaaggcaccataagtatcgaaactaacatagttcatgattttgtcgcagtaaatccagtaagctttggttttactgcagttgtgggctcagctccacctcttgcctcagatctatccggacccaggtgactgacgcaattttgatggtatactagaacatgtgcgcttttgggtcagaaaaaggcatagcatatacgctgttgcattctcagaaaactataatgtgatagcatcataccttcaaatcatttacattttttaatattgcaattttcgttcaagaagaacatctcaatattgtttgattgtttctgttgaacttgccctattagcaaatctgatcctggttcatacatgtgaaaccaatagctcttcttacatatcaaaatggtcatagctctcatggcactttcaaccataattcagtagtactttctcatggcacaaatacaacttttatcgtatgcaaatgaatagcgtaccacaagatcacatttttctcgttccagctttatactctgttattccctaaaaaaaatcactttcaaattacaacaatgcgatgaaacatctgtttacaacaatatgtagcctcagttttacaacctacctaccaccttatctgagaaaaaacaacaaccaacttagtaccttgactttttggcatcaaagcacatgcataagcttcagccatcctcctctgagatttcagttagctcagaggagaaacggtaagaatccaccaacaggggcaggggttcatcatcgcagaagaatggcctggaaggcagctgcagaccatcaacatcaccttcaagcatttctatgacctcactcatcgttggacgatcaggaggcttcacctgaatgcaatgtagaccaacaacacacaacttcctttccagctcatgcatattcaaggtattggtgatctcacccatctcttgttgaatgagttgattatacaccaatgatggataatacacctgggttgagcttgacatgttctgcttagagttctttcgccctccagccatctctaacaaaagcattccaaagctgtaaacatcagatttgctagatatgacaccgaagcttcgagatatcatctcaggagcaatataacctactgttcctcgtgcagcgctaactggcacataattgttgtcccgtgggcatagtttggcgaggccaaaatcggcaacttttgggacgaaattgctatcaagaaggatgttgtgtggcttgatatcaaaatgtagaatctgcatatcacacccttgatgcaagtagtttattcctctagcaatgcccagtgcaatctcattgagcttgtcccaggagaagctcttttcaggtgcgaagatgaacttgtcgagagatccatggggcatgtactcgtacactagtgccctcctcatttcctctgcacaaaaccccaccagacgcacaacattgacatgatggatactaccgatggtggagacctcactgatgaactcttctccgttgcaattgtagttgtctagcatcttgatggcaacgtaaacatcacccgggagtatgacacccttgaatacagaaccgtaaccaccctgacctagcttgtctctgaaatggcttgtcattgcaatgatatctgtgtaggtgtacctcgtcgggccaagcatcaactgcattcgcagaaacttctcaactgcatcgattgtgatccttgttttccagtatctttgtgcaagaaaagtcaatagtgccagtggcgccaacacaaacctgcatatgactgcataaaaacatgtttagatacatgggaatgatgtgcttagagtgatgcagcggcatcaatcacatgtagcataacaacaagtttataaaaagcatgtgtattgtagagtaccatatatccactttactgtccacatgacaaattgtaggacaaatcctgaataaaatattcttttcccatgaagcatctccaccatatagagtggtgtctcaaaataatctgatgtttggctcgttttgccaattatgcatgcccaaaagatcaagtccataaaaacaatgtccgcaatccgatttttgacatgtgcagtagtggagaatggttcttcacgaaaaccactgcaaggccaatgacatggtagaaaaaaagtcttaacaacggtaccaagtatttacttaaaaaacgattatttatgggcaaaattaaactaagataccgaaactcaccgaattgaccggtttaggcactgcttgattagctcaaatgcagtcggatgatctaagacaaaaggaaagcgaacagagaatcccttcctcatcaactcagcaaaatattggtattttttaccactggcaggagtccaactaactggaatcatggccaagtatccgcaagaaggctcaagattttccataagagcgtaatatggtgcgacattcagcacatagacaaatgaagagctcgtgttctggcaatccacatgtatgtacttgttattgttcttcactgcctgcgaacaattgacaaaggtcgcccaccatattccctgaagagtcaattccctggtgtagcttggccctggaatcccccaaatgaaaggacgatgattggagcgaggaaaaaggcagttgctgtttgcattcctgcaggttggcgtccacgacccagaaggacgaatcgttgtagttgatgctagtgacatagtatgttcctgtattgatctggatggtggccttgccactgctacactctagctcatatgatgaaacaccgcacctgtgagggtcgcctctccgccagaaaggatgacttatgtttgagagatggccgcaggagaaaggctggcaccactgctgtccctggacaactcctgcgagaactgcaagtatagcaaagatgagtaaggcttgcattgtaatggtagtagagggggaagctggcagagttgctcagtccacaggctggttatagtagactagcagcttgctgcacctacatatataagaatagtttttttttggctgatacagtttggtcctatgcataagattcatagtaagggaccgaagtcagttcgtcaaagaaaaccttaaattgttatgttgacatggactgcatatcagcataagattcatataaagggacagggtaacaacacagaaggatgttgcacttacgtagcaacacctagttagactaagcctagtcaaatttggacttttacgtggtggcctgctatatatatcaccctggacccccttcattaacgatgagatactttaaccagcccccttgtaaataagcttttttttttggaacgaagcttataaataagctagggttgattattagatacacacacttgcagtatattgattgattaattgcatatgtttccaccttaattccctgtccatctctggccgtttcagtgcacaaagatgagtaaagtcattgcaacaacactcctcctctccgtcatcagccatggcgcctacccggccatgggttcagcttgggaggaggaagacttcgccagaaattgtccaccgtcctggtgcagtgacagtggaccagagatccggttccctcaccagcttgaatccagcaactcatcttcatcatcatcatgcagtgcttcatgcgcgaggctagcatgctctggtccagacaccatcctgcatcacccatttctggggccatgcaaggtaactgccatagattacaagaaagctgttttccagatcatcccgctcgtagactcattgtcttcatacccgcttcagaagctcatcatcgacaatctaccggaaccagattatcattccagtcgctgttcattatacaatgcccagcctgggaaaatagtatgctgttcaaaagtgctcacaccaagtatgtctccgaccaatgactatgatgggaatattgctgatcatgctgtcgtgggcccaatctcctgcctcagtgacccaagccacttctcatatttggggatgcttatgaaacattattcactccattggactgcaaggctgtctctaaaggcattgttccgatatccggtgcagtcaccgctgatggtccaacgttcaagcaactggcagaaagaatcctcaactttgctgagacaactgtaagttggtccgagggaggcattcctgacaattgtgtgcagtgtgaacagcaaggacaacgctgcgcattcagctcacaaaggaatcaaacattctgcatgggccacaaacctcatggtaccatcctaatcagataccaaaacattatatgacagcataagtgcataactcatgttttatttcctcatcatactttccttttaagttcgtgcacttaatttactaatgataatatgatatactactcctttagttcacagacacttccatgagatagctataaataggtattttgcaactcgcactacaaaccatttggctaggtagcttcaccttacaaagagtcatccctagaacttcagaacaagaagtgcattgatgaagcacctttgctgttgttataagtgcatgattacacccaccaataattaaatcttagtgcccacatcctagttagtatatgataaaacgggaactgcagttagatgtttggttgctttgatgaataatcagttcacactgcgagtgatttgtgaaaaaaaatcatgagccataacccttgatccactttattcaccttaaccaacctcaatctggcataacactcaatccccagagatgctttggagaaacagcttctaatgcattgatgaaaggaacaactgtctgttacatatatgttcacataatcacattaacattacatttattcccctaaaacgaaaacttctatcatatctattgctatattgaatcttactatgttttcataagtatatttctgtttcatctgttaaactattaacaatcttactatattgtttggtatttgcaggttcacgtgtcaaagtcattgcaggtactgcagtaattcaaagttcaaacctccgtttttttatcaaaagagaagaaaagaaacagagttatctgccacacgtatttttttcttgttggctgctctaactctacattcttctgtcaaaaagacactacattctcttatacccatcacaatcatttgctcaataggggatagctttctgtcctgatgcaatgtgctaattttctattctgtatctattcagcaacatcatcggtagctgcatttgttgttatttcattggtggtggccactgcaatctatctctccctgaagctaagttataatgaagaggtgcacttgaaggttgaaatgtttctaa

SEQ ID NO: 23137 - DNA, 2774 bp, Oryza sativa
atggcttagtaattttttgggacttatactttatccacatgatgcatagtaatgtaacgcctagatattgcataatatgtactttgatcattccactgtattagccatctgaggtgagttcaccatgtaacacagttaagcagaaaagcatcgcattgaactcaacctgcaacatagtggttcagtcgtggtgattaccttgttcagtcgttgctgtggtgtatctcctactgtactgtactcctagctgcactagtcagtcagatactcccattggccttttcatgggtcagtattctgatggatattttgcaagacaatgctgcaaggaaattgtaaatctagtgttatcaaatggatgcattaaattgggtttgagcacgctttatgtttaaaacaaatgaatagcaaagcaaagggatcaccattaccattgtctatttgtcaatgacaaatgccagtaagaagtttccttttgttgcatattcctcctatccatgcgccattgaaagagccagggcctgaatatgtgagggaaacgtgagaagacaacgctgtagggcagaaaatcaaccatgccatgatactaaagcatgtcgcaaaataaatacctccatcatcaaatgtcagggagggggaagcaatctgccgtggaaaccatcgccgggcgtcgtggtggcgtttctagagatccgcggcggagcgcggggtcggggcagggcgagctcaaccgctggatgcgctcagagccagggcagccacgcgcagtggcgctgggagcctggaagtcgggttgattttggcgccggcaccggcggcgccgccgccgtctgctggagcgccgccgcagcccgcaggtcgatggggaggggggaactgtggggactgggttcaagcccaacacactatcccgttcgggcccaagctcattcaatgttattccgtcctggcccatcacagaggcaaccttgctgaatccggcccacagctagacgtaggccgggcttaagttgacgcagatgagcagtagataaaatgcatacaaagatcgaaagtgagatgaactcaaggcattacgcaaatgggcgcgctgagttcctgtttcaaacccttcaaacataatcagcatgttttctggaagtggccccgacaaaaagaaattgctgagagcgacacatctatcagatatattggagagcaaattgttgcaagatatccaaatcaccacagaattactacaaaaaagttttaacacatcatgccggatagtccacaggtcgccgccggtcagggatcaacaacatcaactaggagatcgtcaccgacctgcactgcaccaggattgcaccatcgtcacctgcaacttttgggcagacaggtatgaaaatcatccataggtagtagaacaagtacggtatctcgtcaaactctcgtatataatttgttgtgacataattggatgatagaaatatacacgaccttaagagagagattccaacaccacacggtaacagttaaggtgaaagaaagagacattttgggcgccacactgttgacggcaggcatggttggcaagtcaaaaagggcgtcatagaacgctgaaaaagatgaggaaagcacgcaaccacgtagtaatcacaggatctatgatatgcttgcaggcaaatcaaaacaattgctaggtcgttgaccgaagaccgttgaacaattcaacacgcagaccatgtgaacttacacaacatactgatcgatctgctgtctccttcttccgctctacaaacggagtcaggcaatcgaatcacaacacaaatggcagcggggagtaccatcagtactagtcgccgcactcaccaccttgtgactctgctgctcctcgttgccgccagcaccaactacgccgccggagccacgctgaacatcaccaaccgatgctccttcaccgtgtggccggccgccgtgccggtgggtggcggcatgcggctcgacccaggcgagtcgtgggcgctcgacgtgcccgccaacagcggcgcagggcgtgtgtgggcgcgcacaggctgctcattcgatgccaatggcaacggatcgtgccagacgggagactgcggcggcgtgctcaagtgcaagaacagcggcaagccacctcagacgctcgctgagttcacggtggaccagaccagcgtacaggatttcttcgacatctccctcaccgacggcttcaacgtgcccatggacttcctccccgtgccggctccggagcagaggcacggagcaccaccgtgcagcaaggggccacgctgcccggccaacatcacgtcgcagtgccccagcgagctcaaggcgcctggaggctgcaacagcgcctgcaatgtgttcaagcaagacaaatactgctgcactggcaccactggcaccaaaacctgcgaacccaccaccttctcactgccattcgtcaggatgtgccctgacgcatatagctacagtttggatgacagctccagcactacattcacttgcccgtcagggacaaactaccagatcatcttctgccctccaactgatctcacgtcttcatctccggttcctcctcctgcacctattgctattgggccttcaggcttggattcctcatccaaaagaggaggaaggcttgttgccactatcgtggtctctgtgatcggctctacttcagtactcaccattatcatcgcttccatcattatcatcaaacgaagaatacgaagacaccaggagatgcaagaagaggaacaagagtt

SEQ ID NO: 23138 - DNA, 3875 bp, Oryza sativa
cttggatcaaagtggtcagggaatgagagaatttatggcagaggttcagacaatcggcagcattcaccatatcaatctagtgaggctgattggcttctgtgcagagaaatcacaaaggcttttggtttatgagcatatgcccaaaggatccttggacaggtggctctatcaccagcaaggttctcctgctcctgctctagattggtggacacgatacaagattattactcaagtagccaagggtctctcttatcttcatgaggagtgcatgatgagaattgctcacttagatgtaaaaccacaaaatatcctcctagacgacaacttcaatgctaaactttctgattttggtctatgcaagcttattgatcgagataagagtcaagtgattaccagaatgagaggcacacctggatatttagctccagaatggctgacatcgcagatcacagaaaaggcagatgtctatagctttggcatagtagtcatggaaatgatcagtgggagaaagaaccttgacacttccaggtctgaacagagtatccatctaattaccttactgcaagaaaaggtgaagggtgatcagttggcagatttgattgacaagcacagcaatgatatgcaagtacaccggcaagaaataattgagatgatgaaactcgcaatgtggtgtttgcagattgattgcaaaagaaggcctcaaatgtctgaggttgtcaaagttttggaaggcaccacaagtattgagactgacatagaccatgacttcgtcgcaacaaatccagtaagctttggtgttgctggaattgtggactccgacccccctgtagcatctaatttatcaggccccaggtgaatgaggtgattgtagtggcatgatatcttgcaatgatttaaattgttggatactgcagaacatattcgatcgacaatagatgagaactccaaagttcattttgttatgctttcctttttagcacgaaactgatcctggttgttatagatgaaccccataccatgctttaatttggtcgtagctcttctagagaaggacaacacgcattggaaacaaattgggaatttgggagactgattcatgcaaattgcatatttctatgcagattttcctactatgacttattagtaaccaggtggcttttagttcctctacaaaggtgattttcagatgcattaaattttcagtattttcctctggcatatagataatagtgatgtaaatatggttcctaagttgagaggtaacaaaattacagccttcaagaaaacccctgaaccaaacggaccctaaaactccacaaaatcaggtcaatgccgcgatggattgaatagtgatggtagcgtgaaaaacaaaatcaagcaggtaatattcagattcaagcagaactagtatgcagttgtggtaatatagagaggcacagtattatttagatgaagaaatcttactctacactagcggtcagaatacacttcgctttgaacaagccaactccacggcagcagatctcgaatagtgatagctcccggaggtgaccctcatcggagcaatccgatttgagatgtggcgtacctgcactcacgcagtggcgcatgggaacagtttcaccgccactctataagatcttcttcggcgggtcgattcagaccatttttccgccgccgccgccacctgcggccggatcaacggcggaggttgccatggtggacgacggagtggagagcgaagaagaggaagaggacgctcccgtacgcgtctcggcccacacgtaatccggcgcggctgcgtccataccggcccagaattagacctctcagttgggctttactgattcggcccacaagcttaggcacactgcatttgaggtgggctattactgtgggccttcattaagcgacgctactccactatcacaacgtacttataactgtcaaaaacacggcgatgagttagacgacgaaacctccaaaaaaaaatagtcagacgacgaaactgttcatcatgtcatagtacgagaaaagctgcctgctttggatgcgaaaaacgataccatttctacaaatttctgcacgcatgcataaaaacatcaaaaggcgacatcgcaagtcatcaacatactgaccacgctgtttgtctggctgatcgattagtcaaaacctaaccagcgcttgttctcatagtaagaatttttatttttttgttttttttttttttgcggggaagaatttttgtttgtttgacactggaactaactgatagtcagatttgcaccattgacaaattggattacagctcccagcgataatcggctgtcctaatcgtcacattttcagcaaaaacagctccatatcttgtaccatcgcccaattttcatacacagtaaatatgaaacggtgacatccccatcacaaatttaggacaaatcaaagatttttcagtcaaaagatgacccagttagtcaaggaaggcagctgcctcctgcccccatgcacacttacaacctccagacaaactccagaatgcagactctcaggttgcagtgatccgaatgccacgacaaagcagagagcaaaaaatttaagtactagcactttcagccataattcagtactactttctcatggtagaaaataattttttgtgataggaaacttaaatcgtataccacaagatcacgttttcttgctcatgctttatactctgttattccctagaacaagataacctccaaatttcaacaatgccaagagcacatatccctcagcgtttgtcaacttactgaccacctttcctatttggcatcaaagcacatgcacaagcttcactcatcctcctctgagatttcagttagttcagaggagaaacggcaagaatccactagcagtggcaggggttcatcatcgcagaagaatggccttgaaggcagctgcagaccaccaacatcaccttcaagcatttctatgacctcactcatcgttggacgatcatgagacttcatttgaatgcaatgtagaccaacaacacacaacttcttttccagctcatgcatattgaaggcattggcaatctcacccatcttttgttgaaccagctgattatacacccaagatggataatatgactggcttgagctcgacatgttctgcttagaattccttcgccctccagccatctccaacagaagcattccaaagctataaacatcagatttgctagatatgataccaaagctccgagatatcatctcaggagcaatataacctactgttcctcgtgcagcgctaactggcataaaactgttatcccgtgggtacagtttggcaaggccaaaatcggcaacttttgggacaaaattgctatcaagaaggatgttgtgcggcttgatatcaaaatgtagaatctgcatatcacacccctgatgtaagtagtttattcctctagcaatgcccaatgcgatctcattgagcttgtcccaagagagactcttgtcaggagagaagatgaacctgtcaagagatccatggggcatgtactcatacacaagtgcactcctcatttcctctgcacaataccccactagacgtactacattgacatgatggatactgccaatggtggatacctcgctgatgaattcttctccattacaattgtagttggatagcattttgatggcaacatggacatcaccaggcagtatcactcccttgaacacggagccatagccaccctggcccaacttgtctctaaaatggcttgtcattgcaatgatgtctgtgtaggcgtaccttgttggaccaagcatcagctgcatttgtaaaaacttctcaactgcgtcgatttttattctagttttcca

SEQ ID NO: 23139 - DNA, 1747 bp, Oryza sativa
ctaggaattttcttgaaatattagaaccatttgagaatatatatttatcaaacgattcattgggcatgaattcatatattaaagcccgtcgtgttccttcagagcaaaatcctaggagacggacgatgtttgcatggtgaattctcccaatggtcgcaacttcattgatgaactcttctccctctcctaaggagttctctagcatcttgactgccacaggaactccatttggtagctcacctttgtagacacttccaaatccaccatggcctaatttattcttgaaccgtcttgttattttcttaacatcggagaaagtgtacctcatgggcttggatgtgccatatgtcttgagaaacatttcaactttcaaatgtatctctttgttgtaccttgactttaaggagatgtagaatgcagtggccacaactaatgaaagaattacaaatgtggctacagatgatgtagctgattgaaaaataagaaagttagttagctgcatttggagatgacataattctgtaatttattttccagatgtgcctttattgtcaagataatcatggcatttcttatttggattagaaaatatatacactctctttgttgaaagttcataaattgggtggcatttaattgaaatttcatgcagaatggacaaaagattgagttatttccttacctgcaacaagagtgacccgcggtcctgcatgtagaaagaaagagaattagtattcccttgatttgtatataaaaaggatgtttttttaaaataaaagtaaaactgattccagatttttatatggcttgctgtatagaattttaaaacttgcatgggtatctatactcctttaaaaagattccaatggtggtggcagtgaattttccacccacctactcctattacaagttttacatattaccctttgaactttttaatattacataacaactaaatctaaatggatagccacatataaaattaatgtggatagcccacattttcctataggggaaatgtggataacatatttcatggaaaatatgatttatttatgttataaaatattgttatatttttccttttatccgcagcaaagcacgggcatttagctagtagtcataaaagggaataggatgggagggaggattcttatcttaaccaaccataaaaagagaaatgctttagtttaaattatttagaaggatggaatatctaatataatgatctcacagatcactgcagtctgcaaagcatgttctggattctactctgttagcacccaaaaaaaaaaggagatttggagggagagacgtccctccaaaaaatttttaagaagaaattgtgagcatactggggattgaacacgggacctcggggttgaaaccacataccccttatcactgcattatcaagtgagatctctactctgttggcaccatataatctctctgctcatagagtcatagtctatatgatactggtacattattgtttcctactgtagtaatattaactttcaacttgtcttataagttattggagttgtcacataaattcaggtccatcaaatggattgtacatatgtttttcttttcttttttttgtttttgctgaaatacagagaacagtgttatatcatactagcataatgtccgtgcattgcaacgggttttttctaattgtctagtatattattattgtgctaattttgctgccatttcgcaaagatgaaaaattccataa

SEQ ID NO: 23140 - DNA, 3541 bp, Oryza sativa
caccactaccatcttttatattagtatagataaacatttatgaatgttaatacttctatgtaacgttgtacagtttgtgaattttcattagtgcaccgtaatctgtgtacaacaaagcactattttgaacagttactttggtttgaagcgaaagaaaaagggaaaattattatttaattattttagacactgtcatctctttgcaggggcttctgttagaacattacggatgtgaacctagagttaaaatgttcatccaagctagcaatcaagtgattcacagtacaccttcacttttgttaaactgtttgattgcaaggtgaaaatattgcatcgagcttgaaatcactgtattagaatatagaagattggataactaacgtactgagaattggaaaaaaaatattgaatgctatttgaaaatgaaacaagtcaccataatgatatggggtttgtgcttcaaaaagagagagaaaaaataccatgacgccgacagaatgcttgaccactttgtgaactgaaaccacagggtcggccttcatattcacatcgttggcaaatactagtaatgttactagagtaccacatgaatactgtctcaccatcgttgatgactctatttgctgtttccttgaagtttgaggtgtcccagtttattctcccttttttatcataactatagggcattgggatgcctttagaaataactgtgcagtccaagggaagaacagacatgtatgtatagggatctgccaaataccagaactggttattatggccgaggcaagatattgggccaactatgtcgtattgatttgcaggtatgggatctcttgaacaaactacaagggtagctccctgcgattgaggaccttgaggtttgtacacagaagttgattggtttttcgacatgagcttctgaagtgggcagtgaggtgaggaatctacaggtgggatgacgttcatggtagcataactgtaacttatctcggttactttgcagggaccaagaactgggtgattgaggatggtgtcctgtccagagcatgacaagtgcatgccgggtgcgccgcatgatggaggttgtgtcgagagccggaaagggaacctgatctctggtccatgcttgctgcacctgtgtgatgagcaagtcttgaagaaatcttcatcatcccatgctgtggcggaagaggattcgtagttgagaagagagagtatgagtactgtgaagagaagttttggcaagtccatggagtgtaatggcgaggaaggcagatgaagagaaggccgtggctatagaaaaaggatcacctattgctatgatctccagtgaggatttatcctgtgtttgtcacgattgctgcgtctgtgagcaggaattccaactgccactgaaacttctgccgtgttgtattgcttagaaaggtatgtgagtatgtgaccttcggagaccgttcgtagattctacaacgtgtatatatttctgctagacgtgtaactacatgtaaaccagtagacgtgtactgcatatccaataaaccagtagacgtgtaactacatgaaactcatttatcttttgttgtcattggaactctcttttgttgtaactggaatcaactcgtgaagctaacttggtagagtaccatatgtatgatgtatccatacaaattgctctgttatacgatagtcgataaggcttgcctggggtagctgagtgactggtgatggtctggatgtaacctgtctacgttaataagtgcctccaagtcaacagcatcacagtcgtgtaggcccacggtgaatattttgtcgggatgactgaaggaggtcatccaatataattaagatggagagaaaaaagtttacaagaaagttgttcatcgacggttaactatcgaggagcccacagtgaatatattgctttagtattactcctacctcactctgtccaaataagttcatctctagcctctctcatgtcgtcttaaaataagttcatctctagccactctcattcatctccttctgcctccagcatggcgatcattattcctggttcgttccatcgctcaaccgccctgcgagtcatctctgtattgtttgtgcttgcagttgtcgtcccagatgcaggtgggcggcatcagcatcatcggcatgactgccttccgttcacctgcggccgtcttagcaacgtgtcgtctcctttccgccggcgaggtgacccatctggatgcggttttacatcctacgagctgacttgcaccgatgacaaggctacgattcagatctacgagggaacgtactctgtgacgggcatcaactacagtgattctaccttctgggttgtcgatgccaacatctcggattcacctaacacacttcctcagaggattgttccaccttatccaactacaaccctgaatactggttgccacaccatccatatcgagctggagcctgcttcaagtaggtggtcagcctttgtgaattgttcgcaggaaataaacaacaatgagaagtacaggcctgtcgcttgcctgaataataccagccgttccttcgtttacgtgctaattggcagcatatactcttgttatattgataatcttgagccttagtgtgggcacctggccattactcctttgcacggcaacgacacaagagtgctagaagagaatccaagctgcgaggatgtcgtcaaaataatgagaggtggattcgctgttcggtttccttacacgattgatgctgcgtactctttcaaggagtgcagggcagagacatttcggtgagcttgcgatatatcctgtggtttcattgattttcttgcattgatcccactagtgacctcgatcgtcttaaattcgttttgcatggtctttgtagacatttccgagaagaaccagcgtctagtgcaggcatcaagtacactatggcagacactgcgacgttcgacattcgttacatggcatgcgtaatccgtgtagctagattacctgcagctgtcaaattgttcgttctactaacaataatcgccatgtggcttctcaagtggattgctggtaaagaaatcgtgtatatatgtacttaaacagatgatccttattgctacattctagttttagattgcctagctttttatcctcaagtttcctgcactgtgagaattgtcttattggtatttccttggagtttggaagatgctcttctctgcacgctgtgctaaactttacatctttttgtgtatattagttgactccaacgcctagttggcaattcatattaaaatgtcatctttttgtttgtcattgccataataatttcgttactcagctttactttttttttagatgaatgaatttcgaaactcagcttcacatggtttaaagtcattattctcttctttaaactgttacagctagcggcattcacaaatgagatttgctccggtccaacaaaaagtaactcgaggtaccggtacttcacggtaccaaaacgttttagatcgttggatctagctgggcatgacgggcattgttag

SEQ ID NO: 23141 - DNA, 1428 bp, Oryza sativa
gaggtctccaccattggtagtatccatcatgttaatgttgtgtcgttggtgggcttttgtgccgaggaaacaaggagagcacttgtgtacgagtacatgcccaatggatctctggagaagtacatcttctcgcctgagaagagtttctcttgggaaaagctcaatgagattgcactgggaattgctagaggaataaactatttgcaccgagggtgtgagatgcaaattctacattttgatatcaagccgcacaacatccttcttgacagcaagttcattccaaaagttgctgattttggccttgccaaactgtacccacaggataatagttttgtgcctgttagtgctgcacgaggaacaataggttatattgctcctgagatgatatcttggagctttggtgtcatatctagcaaatctgacgtgtatagctttggaatgcttctgttggagatggttggagggcgaaggaactctaagcaggatatgtcgagctcaagccaagcgtattatccatcatgggtgtataatcagctggctcaacaagagttgggtgaggtggttactagtgcctttaatatgcatgagctggaaaagaagttgtgtattgttgggctgcattgcattcagatgaattcctatgatcggccgacgatgagtgaggtcatagagatgcttgaaggtgatgttgatggtctgcgattgccttctaggccattcttctgcgatgatgaacctatgccacatctggtggatgttggatttgatagaatcgatttggcacaaagtggaactataaattaaaatgggattggatcataccttgatctcctggagttcccattctctctgtctttgttcttctttcttctcttctagtttggaagcacgaagagaatcgtgtcttgattcttccctgtgtttcagtgggttgtttgatcgggtagcgagagaaatctcttagggtttaacacttaggtattgatctctatttatagccactgcacacagggggaaccgacactagggtatggcggttatcccccgatcagggatgttcatgagagatcgatcactatagcgatcgccctaaacaaaatatctctttgccgactttaggtttagccgcaagatcatattttgcgttcacactaacattctcccccttgatcgtgaggctaaacttataagtccatctttcaataaaatagtataccaagacaaaagattatagtgaccaatataaagcatcaaagaatccagtgactatagcataccattatattttaaaataaacttctttaatcttacgagctctttgaacttattacattaggcttatacaaacttatggactcacttttcaacaaaacagtacatcaagacactagattacagtagccaattaagtactactgaaccaagtga

SEQ ID NO: 23142 - DNA, 560 bp, Oryza sativa
aggtatactttctctgaagtaaagaagatagcaagatgcttcaaggaaaaagtaggccaaggtggatttggaactgtatacaaaggaaagctaccaaatggagtgcctgtggcagtcaagatgctagagaaccctacaggggatggagaagagttcattaatgaagttgcaaccattggaacgatccaccatacaaacattgtccgtctcctaggtttctgctctgaaggaacaagacgtgctcttgtttatgaattgatgcctaacgagtcattggagaaatatatattcttgcgtgatcctaatactcaagagctcctgtcaccagacaagatgctagatattgctttaggcattgcccgaggaatggagtacctgcatcaaggatgcaaccagcgcatcctccactttgatatcaagcctcataatatcttgctggactataacttcagtccaaagatttcggactttggtcttgcaaagctgtgcccaagggaccaaagcattattaccttgagcacagcaagaggcacaatgggatacattgcaccggagctata

SEQ ID NO: 23143 - DNA, 820 bp, Oryza sativa
gcaattcgctgcaggtagagaaaaggaatcaaggggggagccagggagtacacaatacatatacgagtataagacatatctaatggatcccaaatcaactcaccttatcgaatccattaggcactcgttgatactcccggccccatatatgcgcggaaatctaatggcgaatccttccctcatgaactttttgacatcttcatagctcgcattcctaggcactgtcgtgctccaatcacccagaagagtcatggccaggtatccacaagaaggctccaggctttcgatgtaaccagggttgtctgaatcacttgataataacacatagataaaagaatagttggagcttgcgcaagtgacaggcctgtatataccattgtccttcacctcccgtgagcatctaacaaagtaagcatgattatatgcaccaggagccaactcgatctcaatcctgtggcctgagactttgcgcttgtactgatcaagaagatgattccactgcggaagagggcaagtgctaccggctatgttggcgtcgacgacccaaaagcgtctgtagtcgtagttgatttcattcacatggtatgttgcattgtcaatgagaattgtagcattggtatcactgcagaccagctcgtaagatttgctgccgcacccaggtggatcagctgcccgacggaatggagccgatacacccttaagatggccgcaagagaaaagaaggacactgtgatgccttccttcaacatgatccagtacaagactcacaaccacaaataagataccactagctaaagcttgagtattctatagtgtcacc

SEQ ID NO: 23144 - DNA, 3318 bp, Oryza sativa
gcatcctaatagcatttggcatggggattgtcaagtgcatagctggtatgccagagtttatagaaccacatatacaggaatatccaatgagagtgttatatagtccgaaccattacatccatccctaaaagagtgtctttttagcaaaccacccttttagggatggatgtagtagctcctttttcctaattaattgtttcagcctctctcggttactacttactccagtacgttgtatgtattatgcagtgctatgcaggttcgtgttggtgccgctagcgatattgaccttccttgcccacaagtattggaaaacaaggttagcaattgatgcagttgagaagttcctacagatgcagcaggttctgggtccgacgaggtacgcgtacacagatctcactgcagttacaagccatttcagagataagctagggcaaggaggctatggatctgtatataaaggtgtgctactctccggggatgtccatgttgccgtgaagatgttgaatggcgcctccacctacgatggggaagagttcatcagtgaggtatctacaattggtaggatccaccatgttaacgttgtgcgtctagtggggttctgctccgaagaattgagaagggcccttgtttacgaatacatgcctcaaggatctctagataagtacatcttttcatccgaaaaaagtttctcgtgggaccaggttaatgagattgctataggcattggtagggggatcaaccacctgcaccaagggtgtcatatgcagattttgcacgttgacattaagccgcacaacatccttcttgatgataactttgttccaaaggtcgcagattttggcctcgctaaattgtacccgaggaacaaaagttttgtatcagacagggcattacgaggaacagtgggttatatagctccagagatggtgtcgcgaagctttggcgtcatatctagcaagtgtgatgtttatagctttggaatgctgctacttgagatggctggaggaagaagaaacgctgatccaaatacaaatccaaatgcaagtcagtcatactacccatcatgggtgtatgggcagctaacaggtgaacaagttggtgagacatcaggtgctgctgacatgcatgagctgcagaagaagctgtgccttgttggattatggtgtattcagatgaaatcacacgatcggccgacaatgagcgagaccatagagatgctcgaaggggatgtcaatgcgctgcaagtgcctcctaggccattcttttgtgatggggattttatgcctaatgtgatggattcataccttcattcctcagagctgactgccatctcggaggacgatggcgcaattgaattcgctagtaactaggttataatcgaagtgttcatttgctattttgctgtgtggtgatcctgggatgtctttgtctgtttttctgagaacggtgcttggggctgtgtaggaaatctgtaggtctatgaggaaacattgcttggtcctatcctgcacgtgttttgtgcctgtaagacttacggtgcctagctcttgtgaagggtgggatggcacctgacacaatctagatagctggtcaaagtaaaaaagaagaagaagaaaagtgaggccaagaactgagattagctctgctttgttttttttttctctttcttgtctgtaaggtttacatttctattaatggaaataggtgcaagaaagctagatagctgttactatatcagaacattgatcttatatagttttttttaagacctatgttaagctttattaataccacacaataattgtatggtctatatcttcctttgcaacaaactctctcaatacctaaatttagcacctaaagtaaaaataggaaaatacagtcaattttggaaagaatctgggcatgctacgcgaggccggtttgactggtgccatagggtcagtcagaccgcaggggggcggtctgaccggaggtatctagccgctcagatcggtagagttcgactccgagtccgattctcgggttttcttgccaaggcctgagattttagtattaattggtttttacacctaaatgaacgtggaaaaaaccctaggaagtaagtccatccctcctgtaaaatgtaggaggccattgtcgattgaaaaaataatcgatcaatcatcaaaatcaatctattatacgaactctctatattctacatcttctaccttcttgttatctgtcccaactactattctcatacaatcccctaatcgctcaatgtctattgtctctacggctttagaggatgttctagctagcctaccgagcctaggataagccagcatgcattcatcttgatgggggtccctcctgggtgttcgtttggtggtatgtaccaaacggggtgttctattgtccctacggcggtacattttctgggtgctgctgcgagttgcacataatgtgctcaatgtatgaagtcacgattcggtgtcaacattctctacacaatttggtttgccttaggaagattaatagcccacctcaacagcaaaggaagcccaccaggacatagctccagattcttcttaggccttattcggtttggaaaagattgaagatgatttgagggaattaagggggaacaatttcacaccatgatagacgtggatttaaatcatatttggggagcttaagattatgaaaacctgctggttggtaaccagtttttacaactacaaattttcaaaatttggatgacaatctgaaccattggaggagctaaattctgtgagaagctcccaaacaggtcccctccaggaaatgctactgggcgagcgatcgccctcgctcgctcagggcgatcggttcccacccccctccctccacctggtttccctttttggcaacgcattacttttctattttagtaaatttatgcacctaaagtttatacacctcaagtttacacatctaaagtttagagaccaaaagtttatatatctgattcaaatttgaatttgaattcaaatatttttttatatatagtatttctatacatttaaagtttatacacctaaagtttatagacctaaagtttatagatctaaagtttatatattcgattcaaatttaaatttgaattcaaatatcatattcaaatttgaatttgaattcaaatatttttcatatatagtatttctatacatctaaagtttatacacctaaagtttatagatctaaagtttattagtcaaaagtttacatacccgattcaatttgaatttgaattatatccgattcaaatttgaatttgaattcaaatat

SEQ ID NO: 23145 - DNA, 2815 bp, Oryza sativa
ttgagaaccaaaatgagttctactttcctgagtggatatatgagagagtaatcaatgggcaggaactggtgcttaacatggagacaacacaaggggagaaagaaacggttagacagctagccattgtagcgttatggtgcattcagtggaacccaacaaaccggccctcgatgacaaaggtagtaaacatgttaacggggaggttgcagaaactacaggtgccgcctaagcccttcatttcgtctgaaaatcatcttgcgacttagatcatggaaacacaattccatggtttagagatatgtttgatcgatccgtagcttgtatgtatggtgtaagattattcaactatattgtgctatcagacatatggtatatgtattcatgcaattctaatatcccgtggatttgatttgcagtgtgatagttaaaagatgataacttgattaccttattctgtcattgctaccagtgcactaatcctcctcgctgagcacacatttttcgtacccatctcatccccacactgccaatctactaactgtccttgttcttacccatcccatccccacaaaggatcctgcagcgcaggcaactgattatctcatctcatgttcactcctggtattgcataatttagaacagaaaaagaaaaaaaaaaagcagcacgacaaagggaaaaggggttaccatttagcaaggcacgagcatccgcaggaggtctcggagagtgtagaatgcgggaggggattagagaatatgattaaacgtggtatcgggcttgttagagattccaccggtcgctagctgccgcctgcggcgccattgaggaataaccgaagcaatttccatctgcggaatgagcggaggcgactcgcaaaatggcagactgccgcagcaagattaaccgaaactcggcgcgcggggcgtgggaatgtgggatggccggaggacggcggccggatgggtggggctgggcggcggcggaaggcgtagggagaactagtgtgctttatcacaggttgggcccgtccgtctaattcccgtggcccatgaagacgagcttcctgggccgcatccttcatgatcttccgagcccaacaggctcctcacaatctcgttagaaataagttcactggagatccctcaacttaacagcgagattttttgaggtcccttaaccggaaaaccagaaatcttcacccctaaactatacaaaaccgtctaatttgggtcccaagacagtatagatggctggttttgatgacgtggcatcctagtcagcaaaaataataaaataaatatgtgggggcccacatgtcagggggagaaaatgatgtgagccccacatctcttttttcttttcctttctcttctcttctcatggcttgtttggcaacttgagggaaggggattgggagtttacacgagggaattgatggtgagattaagatgtgaatttgatttttcatcccagtctcttgtttggtagaggtggtggaaattgataaggagtttagttggagattaaatcattaatgaaaacggatggctgagatttgtttaggcgaagtaaaggaggaattccctcccaattacctacccctacccaggtattgaaaaggagggagttcattcctcaatcccccatctccatcctaccaaatttctcatgtccctcaaccaaacaaaacagttaatagcctcatccctctaaactcccggtccctcctaaaaactgcctcaaaaccaaacagaccgtcagttctcacgcgcatgcgggcagatggcggccgacggcagagcggcggggaagaagcgggagatggggagaggaggtggacggcgcgaccgcccgcgacggcgggagcagtggccggcgcccgcctctccccatccggagccgcggcaggtgagcgggcaagcggcaacctcgctgtcgccagccaagccgcctccacggcgcggcgcacctcctcggtgcgacaccggcggaggatgcggaggagagcggccggggtggatgcgtgcgccgatgggagcgccgggagagggctcgacggcgagcatgaggattagtagggaagggtcgagcgggatggacgacgacgacgtggggctgtcggcggcaagcagccggagcggcggcggcggagagcggagtcggcggatgaatgaacaacacagctagattgatagaattgttgtcgctttttgtaatttcaagcaatcaataacttcgtgcgtgatggcaaatcataagaacgcaaccatgacagccacatcgatgtatatcatccgcaattcaattcatgaaatactacagagcgtggatgatgcccttacgcggatgaggagagggaagttgcggccagcccagcagttgagcacgtagacggcgccggcctaggcgcgcggcggcctccgacaacttccagtcccgctgccaccggttcccctccacgcgcaggcggtggcgcgcggggagcgccggggcgcccatgccctccacctcggcgcgggcctcgcgccggccgcctctctccccttctctggtgccggccgcctcctctccccctctcccgcttcttccccgtgcaccgcagagcccgcagcgccggcggccgcgcccgcacacccgcctgcgcgtgagaagttgagaagagaagagaaaaagaaaagaaaaaagagatgtagggcccacattattttctctcactgacatatgggccccacatatttattttattatttttgctgactaggatgccacgtcagcgaaactagccatctatactgcttgggacctaaattagac

SEQ ID NO: 23146 - DNA, 822 bp, Oryza sativa
tcccaccgaatacctataagtttaagccaaaacccacataatattagatgaagtccaagaatgcattttagataatttctggtatcaatacaataataagagggaagaaaaaggctatatgctatcaatattaaacagtcttgctgaatatttccatctaatgaatgatataatgccaacatcagaaaataatgaagtaatacagcaaaaacccatatatgttgtttttgacggaaagcttcctggagtgtacatatcttttgaagagatagtagcccaaaaaatagatgcaaaattaatgggtggattgtcatggaaaaaatatatagattttgatgaagctttaactcaggccagaaaaatattaggaataaactactacttggaaccagcagcaaaagaatatatacaaaaatgcaaaaaagccaaaaataagaaagctccagagaacccatattgttcaaatattaagaatgaaggatcatcccaaaaacctacgtataaggaatgcttgactaagggagtagatcctttggatggcgaatatatcgattggaaaataattgaaaaatttgaagaagcatcccccaaattaaaaaagaattgaaagaagaaatacttaaagaattaaagaaagaaatgaatgataaatttgaagaaatgaaaaaagcatatgatgaaaaatttgaagtctccttttctgatgtagatactatggatttaggtggtcatgggcagcctgaccaataaagcaatataatataaattgataataaatatccattctttgggcgtgggaagactatatttgcgaatgaccaa

SEQ ID NO: 23147 - DNA, 10166 bp, Oryza sativa
  unsure (1)..(10166): unsure at all n locations
accctccattccaccaattcttagtagtagtgactttagcctaccttgcatagtatattaagcaaggagttgtgtaataacgctgtgtaaggtaagaacagcttgcttgtacctaccttcgggtttcccgaaagggaaaaccatatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcatctggagaatcggtatccgtagagaagtgttcccttcgggtggaactgcctggggagacgataaactcttagctagaacaagtgtgacttggaatatctttttaagttgcttctaaaaagacagataggtgaggcatacggtgagtaccgagtaggactttacatcatctgaaacaagcttctgaggctgtctaaataggattcgccaccctgcaaagatcctaaagttaaaatatctctcaaagtgaacagtgttttttgatcagtaatttaaacagtaaactgaatagtgtttttgaatagtattcagccgaataaacagtaaactgaatagtattcagccgaataaatattgtacatatatgtatatgtatgtatatatatgtatatatatatatatatgtatgtatatatatatatgtgtatatatatatatgtatatatatatatgtatatatatatacatatatatgtatatatatacatacatatgtatatacatacatacatgtatatatatatatatacatacatatatatacatatatacatacatacatatatatatatatatacatacatacatatatatacatacatacatacatatatacatacatacatatatatatatatatatatatatacatacatacatatatatatacatacatacatatatatatatacatacatacatatatatatatacatacatacatatatatatatacatacatatatatatatatatatatatatatggcgacctctgattcatctttcatctcccgctctgngcctgcaaacggagcctgtttnncacgccctgggggttgttctatcgctcacccggcttaggtcattatgtcttgtgcctgcttgcggttcttgtcccagatgcangtgggcggcggcatcatcagattcagcttcagcctgagtgtgctacgttcacctgtggcgcccatctcacgaacccgttctaccccttccgcctgccacgtgacccgcccgagtgcggcgttgcgtcgtacgagctgacttgcaccgatgacaaggctattattcaggtcgacaacggaacgtaccttgtgaggggaatcaactacaccgatgctaccttcagtgtcgtggacgccaacatgttggattcaagtaacagttgccctcttcctcgctggaatcgcactccttaccgaaggtacggggttgtcgaagactcaagccgcaacatcgtccaagagctgatgccatcttattcgaccataaccgctgcttttgtgacttgttcgcgggaagtaacgaacaatgggatgtacagtcctgtcgcttgcctaagcaacagcagctcattcgtttacgtgctaactggctggttcgctaattatatcaagagtctcgagccttcttgtgggtacctggccatgactcctgtggcgagtgcctggctacatccgaatgcaagctatgcggatgtcgtcaaactaatgagaggtggattcgccattcagtttcctgacacaattaatctgtactccagtttcaaagagtgcatggcagagttacttcagtaagttttcaacatcgatcatttgtgaaatcattacagtactatttctcaatttaactaacatatatatggccttctcttataactgctggatgcatgcatcttaaattcatattgtgtgtactctgcagagacatccgtgacggtgaccaacccaagtctagtgaacgcaaccagtataggattgagctagtttcgttaattgaatatggtatcttgcaatgtgcaactcaaggctctagaccaactagagctgtgatggctatccaattgttcattcgcagaacaccaattgccgtttggactttgaagtgtattgctggtaaattaagaaccccccccccccccaccccaatatgcttaaacaaatgatcctcctataaggcgtcacatcaccaaattaaatcactcctagccaccactggattgtacatgtccaatctcagattatataacttctttgtatccttagctttgctgtacttggtgtcaatggccattgttttggagcttgcaaagacacacttatctgaacgttgtgttgttgtgctttaattttacgactcatactgctcgatattgctcttcccgttaaaatgtccttttgtgtgtgtattgttgccgtagcaatattttccatactctgttttacattattttaagctatatttcccttgttaaaatttttacaaaagcggcaattacttggatataacatgttgctcaaatgctaactggtagctaattaggctagtgtcacagtaacaattaatgtgtgactgaggaattatatatttacaaaatatgcatcactacaactaggtagatgctgcatcaaggcaccaaccatttaaagtttaagcacattcttgttataccaatgaactatctgtaaacttcccttttatgcagtatcctgcaggttcattttgccgcccttagtagtattgacctttctggtgcacaagtattggaagaggaggatgataatcgatgcagtcgagaagtttctccggatgcaactgatgattggtccgacgaggtatgcctacactgaacagggcattttcagggagaagatcggccaaggaggctatggctctgtatataaaggtgttctactcccaggtgatgtccatgtggctgtcaaggtgctgggaaactacaattgtaatggagaagagttcatcagtgaagtctccaccattggcaggattcaccatgtcaatgtggttcgtttagtagggttttgtgcagaggaagtgaggagggcactggtgtacgagcacatgcctaatggatccctcgacaagttcatcttttcacatgacatgagattctcctgggacaagctcaacgagattgcattgggcattgccagaggaataaactatttgcatcaggggtgtgagatgcagattctacattttgatatcaagccgcacaacatccttcttgacagcaatttcgtcccaaaagttgccgattttggcctcgtcaaactgtacccatgccacgggataatagttttgtgcctgttagcgctgcaaggggaacaataggttatattgctcctgagatgatatctcggagctttggtgccatatctagcaaatctgacatgtatagctttggaatgcttctgttggagatggttggagggcgaaggaactctaagcaggatatgtcgagctcaagccaagcgtattatccatcatgggtgtataattagctggttcaacaagagttgggtgaggtggtcactgcctttaatatgcatgagttggaaaagaagttgtgcattgttgggctacattgcattcagatgaagtctcatgatcggccaacaatgagtgaggtcattgagatgcttgaaggtggtgttgatagtctgcaattgccttctaggccattcttctgtgatgacgagcctgtgccacatgtggtgggttcttaccatttatcctcttggctaactgaaatctcggaggaggatgagtgataaagcttgtgtctgcttggaagcaaactcagctaactatttgcttgtaaaacgcagaagctagaaatgattgtaaacagtgaaatggttattgtacactatttatctaaaaaaaatatttacagacgatagaagttgtaggatcgaatcacaagaactaagccaaccagaggggggtgaatggttggtatacccaaaaaccgaaaacttttagcggaaataaaaattaccctcgaaatcgatgaagatcggtctgaccgaagttgccttgccggtctgaccgctaggatgccgccggtctgaccgcctgtacgccgccggtctgaccgccgcttgccgccggtctgaccgccggtagatcgccggttagaccgccgaaacccgataaacacaaatcgaagaactcttaaagtagatgacgactttattacttctctctgtatttacaaagtgcaccaacagcactccttacaaaaatttcgactaaactcgaaaccctaactcaaaactcaactcaattggtctctaaagcgatatcggaaagcctcacgccccccctctatttatacatgaggtaggcagcctaaagccacgaaccaaactcatactaggagtcctaaacaccttaggaaacccactagtacaagaaagaaactttacataaccaatcgtaccaaatttggactccttccaaattcgactccgcatcccatacgcacacaataactccatcgtatgccatatggaaactccatcaactctagcctaagtatcccgcatgatctctgaccaccacggacgtcgtcttatccccaagccgactcccggtccatcaccgcaaatactctcccgagatatcgagtcacctacacatggaacaaacaaagaaaccatattccgaaaccaagctatcttcaacttgactcattagcagcaaacaatagtattacatacgtataatatccatctagaagtcataatcatggaataaactcggatatctaaataaacaacccgaaaccgaaaccgacacagtgtcggctggtcagaccgcgggcagcgccggtctgaccgcgcaatacacgccggtctgaccggctaccaaagcccggtctgaccggacccaaatccagcagtacctgtatattcacctgtgaaaaccaatcatctccaaaaccacttcgtgaataaattccaaataacaaaaccaataatctccaatgcccaatagttcatcacagaataataatcaaaaacacctttgattttacagttgtatcttagaaagtgctacagaatcatttctgaagaaaatgctacttaatccatttctaattttctctgtcatttgctggggcatccggatcactgcaagcctggagtgtggactctggaggtcagtgtggatagcggcaggaggcagtggattgcctttgactgaccggataatttctttgccgtgaactagagggagtatttcgtttatcataatgttgtgactgggatgccatggttaattatgacacatatatgtgtggcccattggccaaatgtgttgttggccggcgcatttctgtggtgtgtgtgctgcatgagcactccagagctcattccgatagtgatggtcaagtctccgagacacggacatatgcttttgctgaaaggaaatgcaacgatttcgatttggacagcctagtgcctgtgtttaccgctgggcatggtaatccgatatatcaatgatgcatggtaatctgatatatcaacttaacatctcatgcatcaatgcatttgcttaaaaaaaaaaaacttcacgcggagctcttgttttgtgtcacagttcgctgtgccgaaagttagacgtgaaacattttgtttctgactcactagcccacattttcatacacttaatttttaagcttaacttcaccatgcttacgggttacaaattgttagtcctactttatataacttgccacatctttaacaaattggagtgaggtaaagttaaccaacaaccaaacagcaaatcacctgaacagagtcgtcagattaggcgcaccactgccgcactgcgttctgtctctacagccttttctgttggtcatctccgggcctaagcctaatattttgggccgagtaaggcccacctaaactgcatcgcagcccactacgggagaactcccccgcacttcccatctgccatggcaacctccgccggtgctccggtagcggccggcggcggcaggatcgctctgaatcgattctccgtccttgaccttatggcgtgccgctgcccgctgcccgacggcgatgccccaccggccaccgcaccacatctcaaaccggtgacggtgagggtcgtcatctcatctgcgcagcggtggccatccgtattcgagatccgcctccgcctccatggagttggattattcgaatcgatggataatccgcaaacacacgccgtccgatcaatgatttggtgggccatttgcatgcctaagatcagctgcagcccggcccactactcgtctctttctcggccacttccttcgatgggccgaaatggaattgagatcaaaggtattgttgggccagaacaggaacgtgttgggcttgtccccactccccatcgttctccccaccatggactccggcaatctgctgctgctgctgcggcggcggcggcgccaaaaatggcctgaatcgacccgacttgcagtgcagcatcattcccatggccttgcgccaccgcgtgtcgcttcccgctgagcgcatccaccggtcgagttcacctcgcctcgaccccacgcttcgccgcaggggatctgtgtctactaaggcctccacctcctcgctcttgttggaccacgccgtccggcgatggaagcggcggcggatctctatcccctccctgacattgctggaggtatttattttcattttattttggcgctttactaaattttgtaacttcacgagctgaactcagtactatatcgatccttgtagattttcagcagtagcatggcagtatggcacggttgattgcctgccctacagatttctcttctcgcatttccttctaatatccaggtcctggctctttcaatggcatggattggaatatgcaagcaacaatcgactacttcttactaactagtgagatctaattaacttttcagtggcaaacagacgatggtaactttgcttttctattcagttttttctaaagataaagtgtgctcaaacccatttcaatgcattcactcgataacacaaagtttacaattaccttgcaggattctcttatgaaatttccaccaggtactgacccatgaaaaggacaataagagtatctgactaactagtggagctaggagtacaatacatcaggagatacatcacagcaactgatgaacagaggtaacagccacaactgaaccacaatgttgtatttctacttaactgcaatacatgttgaagagtgatcccctcagatggctaatccagcggaatcatcaaaataaacacaacgcaatttctaggccttactatatgaaaacatgtggattaactcccaaaaatttattcagtcatggtgttgtgctctccatgatttatggcataggatggctttcatacgaaacaaatggcttagggggcacctgtatgttctgcaaccttccagttatcatgtttacgacctttgtcatcgagggccgatttcttgggttccactgaatacaccatagtgccacaagggccagctgtctcaccatttgtttctcttcttctgtcatttccctactaagtacgaactcctgcccagtaattactttctcatagatccattctgggaagtatacctcattttggttcttaatacttgggtcccagctcctccttccactcaccatttctaacacaagcatgccaaaactataaacatctgacttgtatgatatctccccaaagttcctagaatatagctctggtgcaatgtatcccatcgtgcctcttgctttggtcatggtaacaatgctttggtctctcgggcacagctttgcaagaccaaagtccgaaatctttggactgaagttatagtccagcaagatattatgaggcttgatatcaaagtggaggatgcgctggttgcatccttgatgcaggtactccattcctcgggcaatgcctaaagcaatatctagcatcttgtttggtgacaggagctcttgaggagtattatgatcatgcaagaatatatatttctctagtgactcattaggcataaattcataaataagagcacgccttgttccttcggagcagaagcccaggagatggataatgtttgcatggtggattcttccaatggttgcaacttcagtaataaaatcttctccgtctcctgtagggttctctaacatcttgactgccacaggcactccatttagagcttgcctttgtagacagttccaaatccaccttggcctactttttccttgaagcgtcttgttatcttctttacttgagagaaagtataccttgtgggttttgatgtgccatatgtcctgagaaacatttcaaccttcaagtgtacctcttcattatacctttgcttcagggagagatagagcacagtagccaccaccaatgaaacagcaacaaatgcagctactgatgttgctgagtaaatagaataagaacagcatattgcatcaggacagaaaattatcccatagtgagtggcttatcttgatgggtataaaagaacgcagtgtctttttatcagaagaatgtagttagagcagccatcaacaactattttatctgctacagataactttgtttatttcatttttttcttgtgaataaaaagataggtttgcttaatcctgccttcctccagttggcttatttagccatgtaataacgactattgctcgaacactttgcttctccttcttaatatatccagcagaactcctgctgtcacacacacacacacacacacacacacacacacacacacagaggtttggattgcaatagtacctgcaatgactttgacgcgtgaacctgcaaataccaaagcagacaataagatctatttgatggtttacaggtaaaatggaaatttactcttgaaaaaatgtaaacccagcatagacctacgacattgcagaaaaatatggaccctgtgggatatcatagagttttagttttggggttacaattgtactttgattatgcaaatatatatgtgatagataacttctcctagtgtgtgtatatctgattgtgcaaaagctcagcacagtatcatcaactgcagtcttctgtactcaagacagcagaatcatgattatcatcagaacatgtaagattagttgtgttgtatgcttacttaacttttagattttctaattgtaggagtcttttgttacttaagttacttttgctttcgggtccttttcattagcagtacaatggtgttgtttgtagctgcatatctatgttaagatgtaaatttataatcattgtgtctgattgttgctagttgagcaaacattattctccattggccacttcttttttgagatatctatgagaattgtaaagaatgattaaatagttacagtcacatattcaaatggtttgtactactagtttgcaaaataattttgcaactcatctcctagaagtttcaaaaggtagtactgtatgggtggatcaaatgcaagagcttaactattgtaggaaataaagctatatgtttgtgggtggttattgttagaatggtaccgtgatgcatgcagaatgtttgattcctttgtgagctgaacgcgcagcgttgcccttgctgttcacaccgcgtgcaattgtagggaatacttccgagaagcaaatcaagggtgatctcagcagagttgattatcctttctgccatttgcttgaacgttaaaccagccgtgtatggattggggattggaatgttgccttttgagacgaccatgcagtccaatggaagcgcatacaggtagagccgagtagacaccaaatatgagaagtggcttgtagtgtcccttaggcaggggatcaagcggacaactttatcggcaataacagtgttgtagccgtcgatcatagaagctctacttgttgtgaactcttttgaacaacgcactattctcccaggttcagtgaggtataattgattctgatcgttgacatcagctgatagatttgtggaattgaacttgtgaagcagcatggagaagatgaacccccatcgggatgatctt

SEQ ID NO: 23148 - DNA, 623 bp, Oryza sativa
tatgggaaaatgaacagcaaatccattcctcatggatctgacgatgtctgaaaagcttgcattatgtggcaatggcgagtcccaaccacccaagggaatcatggcaaggtagcgacatgaagtctcaaggtttccgatgattggaaaaacagatggaggcattatccaggaaccaaacacataaacaaacgaagagcttgtgctcaggcaatcaacaggaacgtacacactattattccttactgcctgtgaacaattcacaaagctaacccatgtagctccaggtccagggtcaagggccaggtcccagccgccatgtgatccctggataccccccgaaacgaaaggaagctgatccgagcgaggaagagggcagctgctgtttgtatcttttaggctggcatccacaacccagaagacagaagtagtgtagttgatgctggttacatagtatgtccctgtgttgatcctaatggtagccttgctatctctgcagtctaactcatatgacggaacaccgcatctttgtggatcacctcgccggcggaaaggatgagaaatgttctggagatgtccacaggagaaaggatagcacccttggcgcccctcgacatctcctgcaa

SEQ ID NO: 23149 - DNA, 410 bp, Oryza sativa
ccttatgcttttactcatggagaatccaattgacaggtcgcagggagaggctataatattagaaatacttggggggtaccaggcattcactcaggttgttatatgattacataggatgcaccactatgctaaatagagaatatcccgtgatatggatttcatgggctgctattttttttgttgcatttctgtttttaccccttttcttattctctaaagtgtttctttctagataattatgttgattaacttctcttgataaattctttcaggcctgtggagttctccgtgctatagaacccttaaactcttttctagcatcactttgcaagtttaccatcaataacccaaatgaaggggagaagagaaggtatgccactaggcactagcatcatgtttattagcatatt

SEQ ID NO: 23150 - DNA, 10287 bp, Oryza sativa
  unsure (1)..(10287): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtaaacaagaaccatgtctagtgttagcacatggtacactgtataggctgtaccattggatagcaagaagatgaaaaaaagaacttcacaaaaggtaagatcaagtacaaagtgcttcgactttcctgtacaaaacaacaaaaaaatctgatacgtactcgcagtttggagaggttgtatttgatggttcggattagtataacaaccatcaaagatcccaaagaagtttgatgcataaggcgctcatggtaccaagggacgctcggaagcacctagaataatacataaaagcattaacactttttgaataatataaatatatagtaaatcaacttgcttaccaatttgtgtacactagcattgaaggttgaatcttgactgagtataagaagaactatcaatagcatgtatatctgattggaggtctttcttgatgcattgtagagcatttccaagataggcatcagctgttcacaaaatttacaaaataaattagtaagaggctgagttaaatgtggatttgggtatgctcaagtccataaaaaacatttttacatattagtacatttggggatgaattcaaatttcgtgagttgcagcttgatgatgaaattgtggaattttgaacaagacaattataagctgcctggttgtataaggatttcaacagcttagcgaaaaacgttctaatatttagcaagacagcaatttcagcaagtcaatatacgtaataacttttagcaaatgtaagccattcatagttcgaagctatataacacaatggaagttcccaagtgactattattttttccagcaatttcatgttctgttgtgtatttcaatatggaatctagtccccaaattgcaatgtttcaaacattaaataccaataccatctattcatcacattggaaagaaacagaacttaaaattggagcagttttatgaacccaaaacaaatatgtccagatatgtattgaatgccctcgtgctccaataaatatggttcagaaatattgttattaagctaacataccaaagtatccaggtctgttcgaaccagaacatattcctgaaagtcacagttcccatggaccaaagaatagagcagtagaaccgagctctcatcttttaagcatctgcatggatagcgaatagatggacattatgattgatcttcgttaataatgaaatatcctattctaaataatgaccccccacaaatatgtgaaaagttaagagcagaatgttggtttccatcaacagaagtgcattcttatttcttaaacatcaagccctcaaacataattccatctggagagaactgttaaactcttttcataatacacaaatcatcagtacatttttgtttgcaaggagagaaagagagagagaatttcattgttttaattagaatcacacttggcaaacttctatacatctaacaagtaacagtatgatcataccgctcagcatgatgaagtgtgttacttacgtgccaagagcgtcaaatagcgatgcaaaagacaacctgacaactagcccattttgagcatttccttcaacatcagcacgatcatctgcagcatagttcatttatgtttgttagtgatctatacgagtactgcagtttctttgtacgacaggtgcagttaattccttgcaaatgacaggagcatcttacattgactgtctttggcattgcttaaggccttgtaatatggattatcatgaaaagccggtgcatccttgacattggtatttaaatcgcttgtgtagacattactgcttggaaaggattcgctcatcgtaatgcacttccggtagtggatcagaataagcagaacaagtaaactgttgtctgccaattgacttgatgcgccttcagcgtttgagctcacaaggtagttgaaagtataatatggcagtagtacaaagtttgctgcagtaacaaataagtaaagttaaagattttccataattcaaacatcctctagttctatggtccatgtgtcatacaatatttgcctaactttgccacacttgtgtaaggttaggtatgaaaaaaataggcatggaccaattgttagaaggaaaatgatgggagagagtatccacattaccagcaactgaaccaactcgctgcaaaacaccaggtccaccatcatcagagaaagcagggtgtgaactgtttaaaggaatccgtggtcgttttacaaaatttagcagcaacttttgaactaccgaggacactatggaactgtcctgcagaagaatatgtggcaaggatgcgcattccaaatttagacataaaaagggtccgcaaaaagaccagcaaacataatgcacaagcagctatcagttttacctgaagcatagccgcatcaatgaaaggatgcacatcttttggttcaggagatggtccagaacacaattgagttgacataagtactagcatcaagtttagaagttcatggtgcaggtagcatgactccagacttcatataaaggataaaaacagtgagatgcaaatggcaaaatattaatatatcattgcaaaacacatacacaaaaaagaaatatggaagtcatcgattgatctaccttacatctacactaccaatgtagttcagaacacctctcatcagaaaatattccacgctttgttctgagagatcaggaaaccatgacaaatcaatcgatatatcacagtaattaaaaactgatttagggtattcacagtgttttggaatatatcaggcatgcaagaactagtgcgtttagataatcaattaccagaaggaaaattttccagccccttctcatccttgtcaatttcaagacttagctcttgccaattatcagtctttgcattttcaataatgaatttgagaaatatggatgatatatatgcagcattgatagccttcctatacgccgcgtgagaagactctgccatgcactcttgcaagcaccaaaccaaatggatcaaaatctttgcgagatgctttgtgtggtagttgttctgggctgcataaacacatagcacaggctagtaagcacgagacgattacaaatcaaaacatgatactacaagtaacaatttaccacctatgtcttgatattacagtaagctgaacttaaaaaagaattttactaacacgacagttcatattgttgactacagccatgtcagcaaagtcatatatcacaggtgagcaaccacaaatgcagctcgcaatccacataaatcaattatccaaatcctcccgactacaccaacacaggaaaaatgccgtgaaaaccatgtgaatctagccatatcgcctcgaagcaccgcattaaagtcttaaacccacacccgcgcgcgcacagaaaccacgtgattcacattgcccctcggatcaaagcccgcagagagggggcaaaaaaaaaaaccgccactaaccaagagccaaaaaaaaagaaaagaaaaaaaagaaagagaagaagaaaccgacgcgcgatcagagcaaccgcttagggcagcgcggatctcgagccggggcggaggggggcaacaactcaccgaacgcgtgacacgcctgcaggacgcggtcccgcggccactgctgcgtgaggggcagctcgagcagctgcctccagaactcggaggagatcgggtacgccttcccgccgaccagcgccgcgaacatctgctccgccgccccaggcgacgccgcggcccccgccaccgcgcccagcctcggcgtcgacggcgccgcccccatttggatctgaacgtcggctataccgccaccgcgcccctaggtttcgacgcgggccagcggattcagggattggacgcgagagtgaaaaaaaaagaaaaagaaaagaatgcctccccaactggagtcgagacgaaggaagcgaagaagaagaagaaggttttaaatgggacacgggagcgtggagacttcgggcggaaggaggaagaggatggatgagttcgggggagcgggtgcgagcgcgactaaccggttgggggacttggcgctgtgggtttggattgtggggttttcgtgcaatgacgaatctacccccgaggttcttcctgggcgcgggctggggaggaggggtggtgtggtcttttcgctgggggaatgcggtggtgtcgttgttgttgctgggtcgcctgccgtgccgtcggtggaggaggtggtggtttggtggaggagcattcggggaggggggagacggggtggggtgggcgactcgcgattggtggtgtttagatccagagacttaactttagtccgtgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccaagtcagggggcgaggctgatgatgggtgtcgtttcggccgtgtcgcacttgattgtctctgcttgggagctccccaccggttttttttggccgtgtatcagcatttgggtttgacttcctcggcgttgttaggcgcttttgttttctttcattttaattgagtaagtgtatcgaaatggaaaaaaatgtgatttttgcaggaaacaaaaagtaaaaactgaataaagttggcattggtgaaaaaaaataaaaccattatctctcgagcatttttctatctttgtagcggtgtcagttttatactctttcgttgattttggaaaaataaactaaaattaaatgggtaaaattgaataaagttaatatcggtgaaaatatatagcactataaatatcaaacttttaagagtgtctacctcgaaatctgacttctatgatgttatatagctaatttcacaaagtaatgatgtcatgtagtaaaatttgtctaaaatgaagacattgcgttgttaattactttacaataatacaatataatataaatgcaaacaaaaaatttttattttgcaacgagtttcgcacagttccattacatgaatatcatttggaagggcctatggtacattttaaaaaataaacctataaacaaaatttatttgttgtatgaatagtccacttcaacaactatgaacttttgttcaccatccgtcctatgtgacatctatatcattttcatattcgatctttcatgttgatggtggcatgaaatatgttttgtccttttttggctctatgcagtcatctgttgacaaattggcttttttttaaaggtatatatattctatatccgcccttattttgtaaagttgttaggaaagtactctatttgcatatgtgatttaactgtcgcatatgcaaattcatggaaaaatcacatcagttcatgcacgattttctatattgtttgcaaacaaactttcctagtacatgttttcctaaatgacttatttgtccattttgtgtcttacgagttgtttccaatatatgtagcatggttgaagtatctacggagtatcacctattgacctgtccaaacattgcaatagtgcaaccgtggcatcgttctttaggtggtattggaatctacaagagataaagataaaaatgaagatgaagattaagattaagtgatttacgtaaaacgaggtaataataacgtgtgactaattgggttttaattattacaaacttaaaaaataaattaatctgatattttagaataacttttatatagaaaatttttccatgaaacatatcgtttagcattttaaaaagcgtgccacgactacctaaattttttcccacttgtgtttcataagaaacgaacgggacgttaatctaaagtaaagtgatattgcggcccagtagtttagcctatccaggcccaggaggcagaggctgccggtgaattcaatcgaggccgtcaatctcaaaccgacccacctccgcctccgagccaccgtcctcacgcacgcaccttcacacaccaccgtcgaacggcgcgcgccggagaagattttgccgccaccggcgccttcccctccccggcgaacgacgccgccgccgccaccgccaccgtcgccgccgcgcgtccgggcccctaccatccacccggcggccgtcggccattgtctcaccgtgcgccgcccgaatgcgaggccgccatctcctaagccctctcttatcccctctcgcctacccaaaacccccctcctctcgcctcgctccccgccgcgtcgccagccaccgcaccgtagccccgccgcccgccgcgcgccgcgccccactgtccgagcccgacgtcggcatctccctcttcgcctccgccctcccgggcttccgcggcgccctcaagcagcgctactccgacttcgtcgtccacgaggtcgccctcgacggctccctcgtccgcctcacctccttcgacctccccgacggcgaggtccctcctctcgggctcctgtttctgctctgctttgccattacagctctcctgctctggatttgggagctgtgaagctcgtgacaccggttaatttagcctagcgctgtttgtggatttgcagtgtgtagatgcgaaggaaggcggcatggacgaagcacaggcgctggaatcgttccggctgctctgcggcgacgcggactgtgaggcattgagggggtttctggagagggtttcagagggaggcgacagcgatgtctcaccgatcattctctctgctgatgccgacaagactcatcgctcggtgtgctatcttctctaactgttgttgttttgtaatgaatgagaagctggaagcttgtagtcattggtcctactttttgttaggaagttcatgatttcttcaagaggaacttcgaggccttgcttacagatacagttgagcacagcgatggaatccagaggtgcatcagggtgaggttgaagccggggcgacgcgaacggagggatgttgatgggagggggaggaataggaaaggcacgggaagttcgggctggagagatgacaagccatttgatagtagaggatctataatctggcctgaccatctagggaagttcataaggttatgtcatctgttcagtttcatgcctaactactattgtgcccgatcatctttattctgttcgtgtaagaatgcaaagcactgcaccgttgacttacagtatgtaattcacataccaggtttcatctttacaaggagaacaaggacacccaagaggcactaggaaagataggcaagatgctagggcttcaggtgcatgttgtttgctgtttcattgaagtatttgcagggtgtcctgtttttagtttataaattcattcagctgtttgctaattgattggtgactaaacttcccacagcctcgatcattcgggtttgcaggaacaaaggataaacgcgctgttacaactcaacaggtatccttgtgtagtaatttatgctgtgaagctcatgcatataatgactttctgactttcttttcatgggtttgatgggcaatctgggtgatatttaaaataacaaacttgttatataaagaacatgaggtaatgatttatatggaaagaaattaagagaggttgttggtattggctgttgtcatctcaaggaagaatgggtgctatggtttgaaaataaacagaaagggctatgttttcaacatttcttgcagtcatgatttttctggttctctaacttctgatcaggtcacggttttcaaggtgcaagctagtaggttggttgctcttaacagtaagctcattggcattaaagttggagacttcaggtaagaaagtgcatccctctttcagcatcaatgtaatgtcattgactaaaagcaattgactgcctcagtaatttatttaacctgttctagttatgtgaaggaaggtcttgctcttggtcaactgatggggaaccgatttacaattaccttgaggtgcatgttctccctgttactggtggcattctattataatggtagtatagcagaaatatttttggtgaacttttttgcattctgaaaaatgtatgctgaaaaagggctgtgacacacagacgcaagggtggaatcaaacccagagaatgggaattttgccagttcatagcccatgtagtgatagcgccgcagccttacttagtactaagtactaacccttctattatggctgggtcatggcaaaatcctagctccgcctctgacataatgcaatgtttctactatttgacgattatacaaattataggaatgacctggcatgcttttgttcttctttctttattcttcaactacagaggaaattgataattcatactttttccatttttattatctgccaggagtgttgttacagagtctgaagatgtgattaaggctgctcttgatggattaataacaaatggatttatcaattattatggtctacaagtacaataattcaactcttctctcttttctaaagcaggctcctggatactgcacttgttttgcatttgctgagacacaataaataaataccatgctgataggctatatgaaatcgtggtcatttgctggaacgcaccgaacctgttgcaactattgctctaaaagaaaaaagagggtgtcaaaagcccctgctcttttggaacatacagtgttatctcagcaaatgcaaaccaagtgtggtgtgaaaaggtcaacattgccctgttcactttcctgtggttcaaactattttttgttgtgttatggctagtaaaaaaatcttcgtttgtgtgcttagcgctttggtagtggttcagtgccgaatcaccaagttggtgttgctttgcttagaggagagtggagaaatgctgttcaattgattcttggtccaagggaaggagatatccttgttttctttttctaatatgtttaccagataatatatgtttaaatgtgtgaatttgttcgacttaactttgcggaaaacaatgtgataacataaataaagtgagggagcattttaaggaatatggtgacattggcacggcacttaggaacttccctcgatatctcataacagagagggctatcgtaagtatatttttttcttttactttttgctgtcgatgtaattttttaacattgtcactgccatttccccccctagcgtatttactagatatctgtgccacacctttccaatcttccatcaagtttttggtgaaaccagaaatcgagttgaggtgcctgggaggatctgattggtgccagtgctcttggagtctggatgtgttatacattagatacaagatgtacttatgatgttttgaggaacatacaagttatgtggcatcacagtttaatcatatttattatatgctccagaatgtgaattttagtagatgatgcatgataattacctacataatagaaaaaagttaccagcttatgctgaaagatattataaagaaggcatcgctacagtaatgaatttgtatgttgattttgagctttcacttttctcgctccaaatatattaactaatttatcatgaaggtagctatcctcccttttatcatctcatttaacatttcttattgtcaatcagatttaaagtacattgatgcataacccttaaacttatgttttgttttatttttagcttcagcgcttgaagaagtaccctggcaactatctacaagcactaatggctatacctagaacactgagactgatgtatgttatgttcaatatctgaaattttgtctagagattccaacacctgaaattaatgtaattttccttatttacgacaaatttaggctatacaattctacatattaagttgttctgattattctattcaggtatgtgcatagttaccagagttacttatggaaccatgctgcaagtaatagagttcaaaagtatggtcagtataccttttgctcaatagggaattagggatggcagtttcagactaggagtgattgttcttttctaaataattttttattatttgctttatcgatggtacctgcaatggatatgctcatcagata

SEQ ID NO: 23151 - DNA, 311 bp, Oryza sativa
tcttatgcaggagagaagtaatcaaatgttataaaggaggagtatgtatggtttgagaactaacctcaacaggagcatcctttggcattttagaacgttgtctccaaaaacagtgagtacagccatctcaagagtctcatcagcagtaacagagtcaaccgaaggaacatctgacgacagcacacttccacaagatccaacaagaaaggtttcatacacatctgcaacctccttccagaaacgagctctagaaaatttatatgaactcatgccgcttttacaatcagcgctgtcatgtgtcacttcatcta

SEQ ID NO: 23152 - DNA, 515 bp, Oryza sativa
aaaaggaaggtagcaagaaagctcactagcaccagttgcactgtggcttgtagctgttgatgctaggggaactgaaaaaacaggttctgcaatcttgacttgtccagccaatatgtgcactgttccttgtcccaaatgcgcctcttagaacagtggaagaaagagcattttttcttcctaaaagacacaaaaataataataattatagatgatcttgaaggtaaagtctggtatgacagctgatgtattggagctgccaagtacccaacacatactaggatactggctagtaccgcagtcaatgtttcaaaatattgagataataattggcagagtcgaatttaactaaaacaaaatttctaaattgaaataccagttttgtaacaaactagtcaagagaactacaaccctaaaggtacttggcaggtttgctcctaatccgagtctcattatttcagtagcttaaatgacttactgtcttcaaaatgttgaaaagcaaccctagcagcattcat

SEQ ID NO: 23153 - DNA, 1019 bp, Oryza sativa
aaaaatacggttagttcttacagcttatattagtcacatatcatgcattctgtatgcatgcttggtcttccatagaggggaaataaaacatggagcgatcgcatacattttagactctctattactgtacatacatgtgcaattccaggtctatgtgccataatgcacttaaaaacagatgtaagtacattgagaatgtgcattcactttagcctccccacccccaaatcagaactactatccatacaagtgcatatgacatgtccaaacatcaataaacaggctaacagaggtacctcagtactacactgggcacaaaaagccttttcagcaggtcaatgatcgtgaccttcagaccatgcatgtgaagaactgtgtcactaattcccacttcgcagcaaaatatattaaaaaagctaaattgatactcctagcatcatcacccgtcgctgtgctcaaataaaccccaaataaactaactcaacagatcaatggacatgacccagcgaccaaaaaaccatcaatgtcaaaaacattcccttggtctttaaagacagaattcccccatagccaaccggagtatcttctacaactgtcacggccaccgccaaatccatagtagaaaaaaaaaagggccacaagtgacaccgcccaaatctcactcctagtacaatattaaccgatctaggaaggcgagcaacatgcagcagctgtggccggcggccgtggtgattgcttggaacttggaagcgaggttagaagagtaaagttggggtttttttgctccccttacctcggagcagcgaaacgcgaaggggggcgatgcggccggcgtctgctccctactgcgagctgagcctgagctgctgagctcaccaccttccttcatacacgacgtcagtgacacgaggcctaggctcaccggagagaagcggaagagaacagctgcgctctgctcgctgtggtgtccggtggttaacgcgcaccgtaggactgggtagaccggcctcattaatgct

SEQ ID NO: 23154 - DNA, 525 bp, Oryza sativa
aatatttggtgttaaagacagcaactaagtgataaccaatgtttcatgcaggatgaccccaagtatggttgcttgcggcgctgtaaggcaatttctatccttgagaaacttcatgcaaaggggtaagcaggccttttgaattttctattagcctctggatttcactgttcatgttttatttttggaacattttaccaggttcgttcatggagatgttaaaccagaaaattttctacttggccaacctggatcacctgatgagaagaaactttttttgattgatcttggcttaggtatgcaatggaaaccttatgtgattgatactggttgcaaaaattgagcacataacccatctcaataagatttaacattccctaatcagaattgcggatgttcttttgtaatgctgtttgtacctaatatcattgtaaaatgtgagttcacaagtgctcatgctaccatttacaatttcagcatctaaatggaaggaaacgccaaatggacagcatgttgattatgatcaaa

SEQ ID NO: 23155 - DNA, 899 bp, Oryza sativa
attttgaactaaatcagccagaattttcacttcttggctatttctcaggtgttttttttttccatgtaccactaaacgattcccatgtgtaacaacaaatggctccctaatacacgattgtttacctagccaatgaagtgtctttgttttaaatgtatggcattataaatttctacatggttttcgtctccattctaacttctgctgacagacacactacggccatcgagtgttgcaatctctccaaatggcggcctgccaagttgagcacagccgcgatttgtattcttgtataagtctcgaacactttgccacacattttttgtccaatgcaatatgcgttggatccatggtacattcgtacatgtgaataataaagtatgacgcaaccaccgggctgctggcctgaagaggcattttaggggcacttggcctgcactagttgttctttgagcagtgaaacatcaaactgttcctctgccgctcatctgtcatctcattgctcgttttctctgaactgttggacccgtcacacggtcaggccccaacgaggtcaaccaccaaggtcgccagcttccgtcccttggcgccgtgcctgaccacgtcaatgtcgcctccgaccgagcactcgttgtctgtgccctcctcaccgtcggccacgcaccactcgcccggcgtgacgccatcgagcggacgccgcagcacctcctcgtctatcctctgcagcagcgcgtcgtcgtcgtcgccgaacgccccggcgaaggccgccccgctgccgaccatcgcgtcgtaccgcgacgcctgctgcccatccgcgccctgcgacgtcggcgcgccgccgtcctgcgccaccgtgtgcccgaggttgtggttgacggtgctgttccggaactgggcgg

SEQ ID NO: 23156 - DNA, 5529 bp, Oryza sativa
  unsure (1)..(5529): unsure at all n locations
cggagttggccatgactgtctggaagtagaactccatggggctcagggagttgctgaagtacaggagcagcgtccttgggaggttgtcgggagccaccaagcaaaactcgactaagtcccggctcaagatcggccttggcgagcctgtgcatgtttcgcatcaatttgttagtgaatgacccgtgcgagaaatgacgtggactcctaccggaagcctacctctgaagagctcgaacgcgtcaggctttgctcgttgccccgacgagaacgatatctcggcgttggtgctctgcaggaggttctggtcgacgacgaccgcctcggcgccgccggaatccatcctgtggtcgatgaagctgagccccctccgcacggaggagaaggcgtagagaaggtctgcacaaacacgatcgccagttcgccacatcagcatttcatcgcttgtcatcggtggcatcgaaggcaaacaaccaacgggacgacgtcgagcttaccgtccggcgtgacgagtgggtagtccgacgcgccaagcgtgacgagccagtcccactcggcgccgaccctcagcaggacagcggcgccgcggagcacggcggcgacggcggacggaccgcggccgtcgacggggtcgcccttgccgacgacgtgcacgttcccgtactcgaggaacgcccgctccgaccgggcataccccgccagcctcgcccgctcgtacccccccgccccggcgtccaggtgcagcaggtaccggttcctcgggtggtacacggccttgagcagccgcgtcatccgcacgctgtccccgtgcccgccggagatgtagtacgccagcaccggcgggtacccgggcccccgcctcggcacggccgccgccgcctcgacaacatcgtcgtactcgtacgccggcgcgccgaggaagaaggagctcgacgcgtagccgatgatcagcaggctagtcgtgacgacggccagcgacgcgagcgcggccgacggcgagcacgtctgcaggagccaagaaccgtgcggcattgtgcaccacgtcgggatcctcagccgcgcgccggagagatgcatgagccggcgcgtacactacaagttatagtcaactcctcaagagatcgatcacacaagctgcctggcagatggaactaaccgggaatcacattagttcgtgggggagcagacataagccctgacgcaatgatgaacgggatcggagtaccaaacatcgatttacaccaatataaaacgtgtaggacagaattagtaggataccaaccagcggagattttttgttttgtttttgttgtcgggatgctacggcctacgcgcgagacgtgcatatggaggccgtggatcggtggatggaactgtgcggcagacgtggttccaaggaggggaatccagcaaatcgggtgaggaaatgatagaaaaaaaaggagcagagtatatggaagcaaccggcgtgctgcgaagctgacgaacattggaatcgttgtgcacttgtgcttgtgcagatggatcgacgctgacgctgctaatttctgtcgcccaccggccggctgccgcgcgcatacgcgatgaactgtccaaatcagagttcgctgcgtagtcgcatcgcatctcgcatcagtcaaactagttagtttccaggcttctgctagtagagctagcacacatctcctgagatctccccgctgaggcggcagtgtgtgtactaccctttatcaaaactacaattttgaactaaactgaaacaaagtgaggtatctaatcttggacgcgcatgaaacttggctagttttacctttccctctatcgaacacaatccagggcatttggtattggacgagaaaaggctagacaaaggctaagcattagaccgaaaccatgcattgcattgcacaggcatcatcatcctgttcattcgtgccgaccaaaagatccatctcatccttcggaaaatggaaaaggatccttggggcttgggcttcggccactgggccgaccacgcaaacccaacacatacttgctcactggccaggcttgtgttggaccacagctgcgtaagcccaattcgtcgtgacttgctgctgccatctggctgggccgcttgcagtgctagcgcgccgcgtgtttgcagttgggctagagtttggattcgaaacgtcttttgcgttttgccgtttgcccctctactctccccttctctcaagagccacagcgtaatgacacatttcccttttctttttttttcttttcttcttgttctatattttttcctcattttccttttcttttcgtgcgatacacctggctctgtacctgacccgcaccaaacgacgaaatacagtagcttggaggaaaaaaaatgcagcccttgcgtattccttttctgtcatatatggacttcatgaacatggtgtgatgccaccggatgagtaatctcaactgaacatacgtggagttcttgtacgctcgtttatttattctgtatttttgcgagaaatttattgtatatttcttaatttatttactgaatgaagcaaaccatgcgtatgatactacgctgcacatgctccacgatgaaaacaaccgaactgaaaagataagcatacgtgatgtgtcaggattaaaaaaaaaacttgagcatgcgtgtgcgattagtttgggggcaaatagatgttaagcattgccgtatttttcctcgcgcttttacagggggaagtttagacctaaataacagtctcgtattaacttcacaagtcatgatcccgccgtagatttcttgctcatatacaagccgaaaatcattaatacattgactaatatagcactatagcatccccataacaacggtaatattttcgatctgaggagtaaataactttatctgtactccatctcggtaaaaacacacaagaagaagaacacttgagttcaagagaaaaatactactgctccctccgtcccacaatataagacgtcccacaatataagggattttgaggttttacttacaacttttgaccactcgtcttattcaatttttttttcaaatataaaaaacgaaaagttatgtttaaaatactgtagataataaagtaagttacaaataaaataaataataattttaaatttttttaaataagacgagtggtcaaacgttaaaagcaaaaactcaaaatttcttatattatacgacggagggagtataaaagaacaatacttctataaattttgtatttggatcccagatagagaaaaaaaagcagcagcaaatacgtcgagtcacgacgcccccagtacagagagacacacctctccaaaaacgaaaaaaagaaatagagacactcccggaaggaaaaatcttactactgatgagtagacggcgggcccaccgagcaatcccacgttatccatcaccccaccggggaagcccaagcgcatcgtgacccttgaatccagcgagccgagccccggttgcgggcagcgagctcccctcctccccactccgtctccgtggctccgtgccttccaaagcgtgggaggaggagaaaggaaacggaaaattattcacaacgggaagccttcaaaaagccaagcccttcctcgcccattttccagacagcgtctctcggttcgggcctcagcgggcggtgtgtgtgtgtgcgcctccgcgagaccagacaccaacctctctctctctctctctcccatccttcccctcctcctcctccgcctcgccgccgccgccacacgccgcacggtctctctccccgaggtaactagccttgcacgcctggacttcttcccctctcctccttcccgtcgtcgtcctccctctatccggagggtctctcgggggacgccgcgttcgtgggctgggctgtctccatgtcggtggcggcggcggcgtggggggacgcgggcgatcgtcggcgcggggcccgatcttagagtccgtcgcgtccgatcgcgcggcgatcgttccggcgcgcgccgatctccccgtttcggcggcggaaattcggggttgctgctcgtgtttcatcggttggtgttggttcgggctacggttttcctgggacgatcgggggggcgccgatgatttggcgagatgtatgcgttcgttaagcccgatttttgatcggttttggttgggaaaatcagtgtcggggagatcgggataggatttggggcggacgggttgtggaaaccactgttggcaaatctgatggcacagtctgccgtgattttttttttggctggagatgtgatatggttaggagttgatgggtctgctattagatgtgaaatcatcagttggtttactcaaccttatcagtgttagtttattctaatccacatgtttttgagcagtataaatgcaggattaatccgtggtgttgtgactttttgggtggtagattcgtgcgcggcaggaagtgcatggggagaaaggatgccagagttgcgtagtggagtccggcaagctcggttgaaggcaaagaaggttgaggaccttgcagcacaggacccgctgagaacttggtagtggtggcaccgacggtggcaggaagacgtggtagaggaaggggtgggaggggtggaggtagagcaacaggaagaggaagggcaggaggaagagggcgaggtgttccggtgattgatttggacccggaccaaccatgtgaggttctttcaggagctgctattggcggagtcgctgctggaggcccccatcatatcgaggaacttgctaataaggttgtgaagatggatggtgggagtggtgagaagattggtggaggcgaagatgatgggaatgcatctccagttccggataaggtatattcttcatattgagctcttactaatntattatgcatgttatcacttgcatgcatttctcntgttattgtgattgcagacatgcactgttagggtttcggagatgacgacaaattagtagattttggcctggtaccacaagtgtaccgttatatcatattacgatattatgtcgttatgtgcatggttcaggtggaccaagcttttttctttacgtagatattggtaacgccttttggaacttattaaatgcataaaataattgacgtgataacaagcataacagcaccttccttactctaccatttttgtttttggcattgtttgtagggcaaggcaggtgcccctatttatgttctattcagaaatgtttccacttttttctatggatgcttccttgtcaatgatgctagcttgaagtttttgatagtacatagccgtagaatgggatggttgacctcacagaattcatgagggcatctccttatctgttaccgtgcgaatgccagtgcacatggtgctgtgcatccctcaacttaggcttactgtttgcttatatcatggaagctgttcttttacaacatagttgatctaagacgtaatatagttgtccccaaatctagtttggatgccactgtggagtttgtgcaatagcttggagtcattaggttcttc

SEQ ID NO: 23157 - DNA, 905 bp, Oryza sativa
ggtcagcgcacgggcacccccgcgcgccgccgcacgccccctgagcgcacgcgcacccggacgaggggaacccgcctaggtcggagcgaggccatgtggggcctggcggtcgtgcccacgtgcgcccccacggctgggcgcggcggggtgaggcggaggcggaggacggggtgagggagaagggggtgtagaggaagtaggcgtagggcttgccgtcgacgaggttgtcgaaggggatggggtgaggctccagcccgtgcgccgcgtcggcggcgcggccggcgctgacgctggaagcggccgcacgcagggcgcggctggcggaggccgcagcggcgaggtcttgcggcggcagccacggcaagaccagctcggccaactcgccgacggcgccgggcgttgctgagtttctcatttgagcattttggaatggaacagacggtatatccagttatctatagtttcatctgcactagaatgagctcgactcgttgattcgttgcgagttcgatgttcgggaggtaccaaattttgtgatctcgacgaaatttgaaaacaacaaattgcacctatcaaaattttgactatgccaaggtttgcccggattttggcgctaaggctgtgtttagttctatgctaaaattagaagtttgaaaaaattaaaataatgtgacagaaaagttggaagtttgtgtgtgtaagaaagttcgatgtgatgtaaaagttagaagtttgaaaaaaaaagattaaaatctaaacagggcctaacaaatgatgacaagatctatttatgcaacaagatatacatggtagtttcataaattttgacaatttgaccttttgcaaaaactatttttacaaatgaaccgccgccaaaacttatttcaaaaataaccttttgttta

SEQ ID NO: 23158 - DNA, 8125 bp, Oryza sativa
ttatggagcagtgggagaataattactacatcagtgcgatagcgggtgcaacaaatggaagttccttggtggtcatgtcaaaaggttgtctcagctgttcttttgttggaggtctctcatgttactaccattgtattcttcataaaggaccatctatgtttagaaacttggcctgtttctctttccattcacttcgcaggtgtctcaatttttttttgggaagatggttgatatgtcctgatgtagtgatgtgtatatattgacttgcatgttccacacacttagtgtttcttttgtttatgtattatgacatgaatggggttagtctgacatggtgatttactctttccaggaactccttacactcaacagtcttacaaagttagtgaatcgtttcccttcaaatggatcaacaagaaatggaaagaaggatttcatgttacatcaatgaccactgcaggaagccgctggggtgtagttatgtcaaggaattctggattttctgaacaggtatttgtggttattggtgtaatatttttttttcctggtgtgcaaatcagttgcaatctaagcgatggtatttcaattttttttttggcatgtgaaaaagggtacaaaactctttagttgtcagaaaataacttgttttcagatgaaatgagttgtcgtattgatggaaaccagtctttttgaacctgacagggattcttacatcatatatcaagttgattatacttcatctctctcatgtactgcaggtagtagaattggattttttatatcctagtgaaggtatccaccggcgttgggagaatggctatagaataacttctacagcagccactggtgaccaagctgcttttatattgagtatacccaagagaaaattgatggacgagacacaagaaactcttagaacatctgcttttccaagcaaccatgtgaaggtacgaatacatgactaattcctgtgtacattgtttttcttcacagttctctctaaccagaccattcaacttacatttcttgttcaagcgtcaactcgatcactactctaaccttgtcccatactgttgtctttttgtaggagaaatgggccaagaatctttacattgcttcgatatgctatggccggacagtatcttgaggcataccctgcacaccaactcgggcttagcatattcgcaactgagttgatgtcgggaaaaccagcaatctagttgctgctctctgttactctgtatgtgtaggtaacattggctaggtaaaccttacatcatggccagagttaggggcgcgagaggaagcagggaggaaggtggatggacagctaataagctgatgaggatgtcatccggctggtggtctggtggaggtggcagaagcggatgccgtcaacatattttgcatcaagatgtgctttgctgcagtccttgctgcggtgcacagcacggatgacccttatagcctctttggaggcctataatctgagagcccgttgtgtatagctcttatcgtgtcctgcgttttgtctggtggaagcgaaattaccatgtttccagaactccggaattgtctctaaattattgtgtgagaatgggtgtactgataaatcggtgtatcgattccattattcgatggtctcattgcattaatgcaataatgttgcattactgatcatctttttacatcttgtgcacagcgatattcatgaagtaccacttgagagagcggcatccatgaaaagtcactcccagagggtgattatcacgatactccctattgtcacgatgctcctcagagggccgttggtcctacaatttgatgtcaagtttgacattccttttgcacattcgagtttatcacctgccttgcctcgctcaatattcattatcgtctgctttgcgtcgctagcacttagaaattgaccaaaatgccctcgttgctttgtcccttttttctatttcttaggacggaggaaataggtgaataaatgaagggtatcatcttttcgcttatgcttatcagctagaatttgaattttcaattttaaatttggagttggttttgggttttttcattaaagtttatttttcagtctttacttttagatcgctaagaacacgtatataaaagttttattcacaaattatatcccgtgtgtaaatatgatgtttggcttattctacgaataagcgaagcaatgaagctggaactagactatattctgactatctaagcggttcaaaagctatctgagcggtccgaaagcaaaggttaaaagaaacataaagcaataaaaatacccctgaaattaacagaaagcaataaaaaatacctctgaaattaactacaaaattaagtaaatggtacgtagtcgaagcggtatattttgggatagaaaatggtgtttttttttaaaaaaaaacttattattactcccttgactattaaattgaaacatatgagatcacttgaaagctaatgagtcatggtgaatatacaactgcctcgatctacaagacacaatttataggacacacaaaaaaaactacaacatgctgacttagaagccttgggcctcatataaggtgcaaatccttcgcttggctagtacacaaaactcaacatgtaagcatataataataatttatttcattctaaaactaaacatataaatactaaattatcattcacaaatcattttcataatatttcaatccaaattattttatcatttctataatatttaacatatatcccgtaacaaagcgcatggcatcatctagtactttaggaaaaaaaaaaactcctttcatctggaattctttttgcagaaaaacgcgtgaacgtaggattaagatcggacggttccgcatctcgtcccggcagaacagaacacactaacgccggcggcaactaacatccccactgcgcgcatcggaggaactcgtcgtcgtcgtctccatctctccctcctcagatctcaccactccctaccgatcccctctcccccccggttctcctcccctccgcgatccccgcggtcgagataggcccaaaaccctaaccccccgccctcctgggtcggcgccccccgccgcgcctgaggagtgaggacgcggagatggccttcatggcggcgctggaggccgatctgcgcgcgctctccgccgaggctcgccgccgccacccctccgtcaaggacgccgccgagcacgccatactcaaggtattgctcccatcgcccgtgcctcgtgggtactggagatctcactgccgcctcccatttagttgtttttttgctcgctcgttcgtctcggatccaatttagccaggggagttctctccaatggtttccgaagtgtgggctccagctccagctccggtttggttattcagttcaaatacgcagtgaggtagtggcgtaggagtatgattcccacctgatatttttggtgatcgtaagcaggataactaagttttagccatttctaattgaactaattctaagaaatttcaactgtaactgtggtctgccaactaacttagcttaatcactagggttagtgaaaatgtagccaatggttcgagtgcaggatttccatatgctactagtagtggttaatgattatacagactaacctaaccggtctgaatgccaaccaatgcttatatggttgctggtagggactaggggaaacccattccttacctgtaaaacctagtaaatcctcttttataatgctaaatttagactgcagagaatgcttttaatggagtttaaggaattattgggttgccatgttgatttcaatcagagatttttcatttattttttttatttgttcgtttcttatttgaggaactcatgggctcatgctcgagccaggtgcaatgcacttgcttagaatgcttctgtaagaagcctaaggtatcaccagttgtagtatgaactttaaagagctggaggaacttaatgggttttgttcatccattataggagatctggagaaactttataactttttattctccatgtaagagtttgtacaaacttttgtttttttaattcaataagggctgggctttgaatacaacattgccattatagaactcttgacaggttctttcagtggagacctctcttgtattcaagtttcaacgcaagggacatactagaagtagcttatttgtgaaaggagccataaatccacagtagaccagaaccagaatctgagcaagagaatggggtctatcgaaattagtagtggaacacaaatatacgatgatacaatctaacctgattctgctcagaagataagctttgaagtttgaaataccaagttggaaaattgaaaacctattcttaatatttgatggaataacatctgataaaccaatcaaaatgacctttgacctaactacacaagcaagattgttttcatgtattttctagaaattgaggtgtgaacttgagtggtatgcgctgatgtgtttattgcctctcttccactttgtttttcttttctcaaacgtttgagatactttaaatgctaatatgattgacctgaccagatgactgattgtattctgagatcatttatcttctttaccaactgtatacctgttatttgcaagataatgattaagcatgtccttccgcctatctgaagctaatctgttgacgttcttaaatctttggtatcaacaaatctcctccataactcaagtgaagccaataattttgtgttgcaatttagatgatgcatagtgaacaaaagttctgtaatttcttatgttagaccacaaagtaccttttaacttgtttccttcttttaaccgtcatgctacttgtttcctaacttgtatttgaattctttttggcatgcagctccgttctctatctagtccgatggaaatagctcaaaatgaggatatattgcggatgtttctggtggcatgcagtgttaaatcagtgaagctgagtgtaataggactatcctgtttgcaaaagcttatatctcatgatgctgtagcttcttctgcattgaaggatatactgactactttgaaggatgtgagttttgatcgcttctgtatccatatacctctcactattttcatttgttctttatttggtcttaatagatgtataaactgaatcacatattttgtgtcatctagttatcctgatgacctgatgagtctgatagtgtttttctttttgaaaaaaaaaacaaacgtatgtttagaaaacatgattaattactaagtccttttgtttttgcattaggatattttgttgttttattcttgaaacaaattctgtacaatattagctgatgatttctcaatcctgttttttgtttcattttccttgcagcatgcagagatgacagatgagattgttcaacttaagactttgcaaacaattttgattatttttcagtcgcacctacaacctgaaagcgaggtagcaatgccaatggttgccatcagtttaattggttgatttgtataatagatgcaaatgttttgttattttctggtgtagttgcctttagatcagtctgaagcttcccctgttataaagaaagcaccaagattactggccattatcaaacaacttgttaccgctgttagcattttcaaaaatcattttcatgtctttctaatttggcttatgtgtatgaatatcttctttccacgcaataaggaaatcacttcccttattttattttggagcagtctgtttggatttgggggttatgacatgttaatgtgtgaaacataatgcattcttgttcaacatattctggttgactctagaatgtgtttctataatgataaaaagagtaactcaagttgcagtattaatttttgaagtcttctgaggaagttaacatgactaaaattttctattccttgggactgtttagaaccttccctcttgttttgcatagttcatgcaaaacctaaataatatgtgcagtatcattttatctctaatgcctttccaggatcataggaatgtaaccatgaataggtaggcctatttatcaatatattgtttatatctcttcaggtgaacatgtctcaagcatttgacatatgccttcacctacttgaaagcaaccgttcttctgacagtgtccgcaagtaagttccttcgcttaccattaactcagctattctgacttcttttattgtgctctcctaacacacatattgtccttagcacggcagcagctacatttagacaagcagtggcattagtctttgataatgttgttcatgccgaatcacttccctccagtaaagcttcttcagcaagactcagttcacgcgctagctctgttgctgataatgtcactcgtagcttcagccacacactgtaagactgtctattttatcttacattatacttaacgccatgcaggaatgctatttggacatttgaaatctgttgttcatgatatgcccttttttccttgggaggctttgacaacaatggcaccgtatgtattatagtataatataatcagcttcacaataaagctcgattctttttttgccatcgtgcctattaatgagcacacacttgcattgctgaatcaacagttctcttatttgtactgtgtttagtatatcactcatgttcatgtgctttatttggatgatatggcaaccacacaatgcttgtatttccattccacaagcatagacacatgacaactaaatgtatcactgatgcaacacatatatgccatttttcactctgtggattttttcatttcttttgcttgttaaatttgtattttagcttacactagcactgcatgacaggtatagggaggaactctgtggagcctaccgtgagggaaaaactgagcaagttggcaagcttggtctccgtttacttgaagacctgacagctcttgctgcaggtggatctgtatgtgcgaacaattcctgattgcacttatttattcttgccacatgattttttgagacttgccgcataattttttggagtatctgccaatttttattacggaatttctacaccttattttctgattaagctattgttgttattttctgtaggctacgtggcttcgtgtttattcattgcataggacatttgcccttgacattcttgagtaagttttctccacagttaaatgtctgaatgtttttttgtattttttcaaggcaattataattttgtagttatcttgacccaatcttaccttttttatttcaaattaagttctatgttaacaagatgtttcaattgaaccattgttatcggatgttagtgaagctcatgatctgataacactgatttggagtgttgggttctgtcaggagttttagaaaataatgtgaaggacattatacaactgaaattgaaaaaaactaatttcaacatttgtgtattcacctagaaactaaactttatagtgcaacttgtatatagagcaagctagaactcatctagacatattttgtgccaggtttgtgctatcaacatatgtttctgtattccgggcattgttaccttaccagcaggttagttcctatgtttcttttattatgtctaatatttgtgcaaatgttgatttgtaacttacgatgccattaaaaacctgccaggtcttgcggcatcagatatgctcgcttcttatgacttcactccgtacaaatgtggaagtaagtacatcaaaatcaggagttagtttttaaaattgtgtaacgtgctcaagtacatttgcaaaattgttgcgttaccacagtggcaaacgtcattggcagcagaacaaacttctgacttacaacattactagtatagaagtttaacaccagttcagatgccacaccacttatatgagggaggcaaattggattccatctaaaggaacaagtcagtcaacatttccctggcctattgaagtgtttgcactttgcacagcctatatagttgtactttcctgaacaagcaaccctctttgccagcttggatttttgaaattccttcctaattgggtaaaggcctaagagatgcaaaatgtgcctacccttccatttctgttgaatttctcagcatgaatgcgaggat

SEQ ID NO: 23159 - DNA, 665 bp, Oryza sativa
tcatctggggggtttgcatgtttacacccaaacatgagttcgcactaatattctcttctaacatccagctatcaatttcctatcactatcaataccaatacagctacactccttccatgtatgaataattatacattcttgctcactggtcctaaaactaaaaaattaaaacgctggatatgagaggaggggctctcatatcagatattattaagaatgaggctcgaaattaaaggaagatgcctgagccttcctcaactatcatgttttgttactacaaaattatagaactacaaaaatgcttccgtttgcaaaattggggcaatgtaactgcaatggttcacaaataagggcagcagaacttttttagtcaaagctttgttagtaacagcaaactgaattatgcaaagaaaataccttccaagacatcgaataacttccggagaggaattaaacctttcattctgtggagcctccagaaataggttgacaacaatcggcacaagcttttctatgaacataataccccagccacagcccactgcattatccatttttgtgctgctgttattgagatgactccgttcaactgtaaccataataaaatcacagagagtaaatcaagaagatattgtatttcattatattatgaaaagttggatatc

SEQ ID NO: 23160 - DNA, 1425 bp, Oryza sativa
agaagatcactaacatgattagtagtttcagtttgccagtacattgaaagttctaaaaactagcatatattaccaagaccgcgaagaacctcttgcttcactttatcagcagagtcattcttataatttggcgaagtttgaagaacaagttcataaatatcaagaacagatttgacataggaggattatagattgccctgaaaaagtatacatggaacatatattcatggccagttctgtgaaaataataactgaaataagaactcacggttcttttctctaatttgtgaaaataatgccaggaataagtgacaggtccaacacatgctatttcagccagtggcactaatgaagtttttagttttgacaggaaggaggtttttcaaagataaagtatactcttcagtcccccacccccactctctcagggttatagcagaaagcacaaaaatgccatcattagtccaaacagtcaacagatgaatttttttttctcgaaaacgcaggagagctgcatttcatttcattaaggaagaaaaaaatatttataaaggagaaaggcaaaaacagcaaaacaaaagaaccccacacaaccaacagccaagtgagaactcgacaaaaacattgtgagtgcatggcgttggcctacttgggccttagagtgtgcacatgggcttgggctatttggttttcaagggaagttcaagctcatccattaaactaccaaagacacactcaatatttcaccgaaatagcttgcccttggttcgttaaaaagctagacgttcacacgggctcaagttcgggtagttttgagttccagataacctaaagcgagccaagcttgagtggcttttcaaattttttttgacagtttcacttaaaattaactataacagtcagtaacattcttagcttgtgaaaccggtaattattcataatatactgtggctgtgtgtgcattggggggtggggtgagagagagagaacctttgaacagtttgagccaacaaacgtctgcaaacaatttatagctgcaagagcgacctccttgctaccatttaggataccatttttgacaaaatcaagcaaaagcacccaacctgaaaattttaagatacaatccaactggtaatttatataatttatatccaatccgagaaaaatggataatggacagtacaatgaacacttaccagaagaaaatttgctcaattgctggaggaaagggaaaaaggaacgcaaaagtcgtgctatgccacctagtacaagaacgatagtttcatcccattgttttgtgctgtatttcgactggaaataagaaaggggggggtccatcagaacaaagtgtattccgacatgaagtaatatagtgtaatcaaaagctctactatctagtgagagtagtgtgagacccagaaataa

SEQ ID NO: 23161 - DNA, 2311 bp, Oryza sativa
accctatgggtataatgacatcagaatcgaaggcaaaggcaatgtatattaagatttcctcactcagatattcatggagcgaacatacttcaaaattggattatcttttgtctatcttccttgcccataagtattttccagcacaggaatgggaggcccataaattctataacaacgatcactaagtgagctcactaaccgggaaacaacttccttgaagaacatggaagcaacctgaaatgaaaagcttcagactaaggactgataaatcacagttaaatgaatgcgcttcatgtgcacgatcgtaacggatgattttacctgacgatatagtggcgactgaaacttaaaatcaaccaagaagtaaaggtcacatgttccaggaacaggaccaggcttgaactcccaaacatttatcaaatgatcaaaaagtccactttcagatgctgtcgtctgcaatcgagtaaataccagtcagaagtaaaacaacgcatctgttctaacatggaaaaaaagggtaaaagtaggaagtgaatggtcacagtgaattatacgccatttccccacttgttcggtacaaataaaacaaaaatatgcaacagaagttttactcagaaggggcaacagattttaaagatttatggcacttataaatagttgcaacataagtacatttctcacgaaataatgaacacaatcttcaagcaatcatctaaatactaaagttagcacggcgtctgttcaacaactatcttagttaaataaaatagagcatcccagttaaatagaagaagtttatatcaagatctgcagtgatattcaatcattagaacctggagcatgagttagcacagcatctgttcaacagttatcttagccaaaacagggtgcattttatcatgagcagcaaatccaagttgctccaaagaactgagattgagaactggttaacagaaatcatctgtgcatacacacacacacacacacacacaaactcccacctatgcatcaaatcttctattcaagaaaaagttatcgtaacaaatctaacttgactactcccaagtcaaagtgttagaaagtttccaggtttcatgcagcaataatcgcatcagccttcctacatcacaagaaaattttgttgcatgccttattaaaaagggataggtgaagctactccatcagtcagcagcatgatgacggttttacagtatatataatttgatgtatggtttaaggatgatctcagaaaaaaactactttgccaatttgccattgacaactgcagttcatgttagcgctaaaaccaaaaccaatattcattcagaaagcaggcaaaataaatagaaacattacttttgtccgggttgatacagccaaatgatgtactatatcttctcgaattaactaatgcaactgttacttcgtatttcagatattctaagttatagccaacattgcaagcaattcaatgtgttcactactagtcggcacaagtaacatcatatctgactgtttcaagaaatttggcccacatagccgcattgaagaaagaaaaatgaaaggcacgtcctcgacgacagaatttttacatgtttggatagactacaagtaatcctagaagaagtaaacctttagcagatagttgtgaagcaatgtgctaaggaattacaacacaaaagaaaaacgcatgactaaggtgacccatgtgacaaaacttaactaatgcggcttcaacaattaatttgtcgctttcagaaccatttagttattctagatatgcttgtgttccatggtatgttatgtactaaccaataaagtatggtgatagtaccatgatgaagttctcaccttgatatattttggcttctccatctccacatgagaaacataactctcgacaaggaacttgaatccaatttcgagttcagcatcaaacgagccattctcgtgtcgcctgataatcctagacctctgacaccacggcacaaaatcctcatagaggtctactgccgcgacaacagcgaacatctgctccggcgagtacctgcacccaccaacgcaccaacaatcagcaccaataatttccgtttccaaacaatcagagaaggtaaaattatgagctgcaaaacaatcggtccaatccaccgtaccccatgacgcgcctctcctcgtagaccttggagagcacgctcccctcatccccgtcgccgcatccaaggaaggacctcgtctgcgtgcccgcgcgccacaccccgcccgccctctccgcctccccgcgcgggggacccgtcggatcggcccaccgccc

SEQ ID NO: 23162 - DNA, 1518 bp, Oryza sativa
gcgccactcatacgtgcaaaactactttaaattaatttttctcttaaattatttatccaaatcataattcgattgcaccattaaattcgttgcaattaaatctttaaaacaagaccacacatggatatattccgacgaaatttttttagcttattattgatttttttttaaaatgttgcacaatgttccaccaagtatatcggaattgtttcactaagtagattgaaaatgtttcaatcgtttaaatcgggtattgtttcatcttatataaaaacaatgtttcagcaaaaagcgaaagaatgtttcagttcactgcaacattagatctatacatagtgaaacactgtgagtacattaggtgtaacaaaaaatgaaacgaattcccttaatacagggtttccaaaatatgtgggtgatttattgcaaaagaatgtttcgttcactacaacattagatctatacatagtgaaacattgtgagtacactaggtgaaatatttttggtggataaaaaatgaaacgacccttaatagagggtttctaaaatatgtgggtgatttgttgcaatggagtatatggtgcggaccaaggtaataaatagcatatagtgtgtttatagcggattagtgtctggcagcagattgcggatagcgggcgctattgcggacgctaagttccaatagcgaaattaagaaaaataaccataaatttagattgtatatcaatattaacataaagtttcacttaaaatttaaaattagactgtttaattactgctacatttcataacataaaatttatgaaataacatatagatatattagataaagaagacaaacaatgctaaattattctatccatgcgtgaaacgctccgtttgagcattatagcgatctaacaaagtcaatagcgggttgttatagcggtcgcgaagcgctatagcaagctgctatagcggtcgtggagcgctatagcggccgctaagttccaatacgctctatgcagtccgctaccttgtagcggtagcggtagagctccgctactgctatagcgggcgctacgaacgctatttattaccttggtggagacacatggtatggggggcagagaatgtggtggggccaggtgcctgcatcacgcgcgtggggggcggggcgcgcaggggagtgcccgatctgctccacccccgccggtcgcccggtagccagcatttccgaaaggaaaaagtacgaattacctccccccgaactatcgcggtcgtccgaattaccccctgaaccacaaaaccagacattcttcacccccaactatgcaaaccggacaaattacccccctcgacccaatccacggtggttttagactatgtggcgtacacatggcagtccggtcagcattttatttataaaaaaaagtgggacccacatgtcacacacactctctctcctatctctctctctcactctctctcctctcagcaatggcggaggaagcgagcgcgggaaggcgaggcgagcgcgac

SEQ ID NO: 23163 - DNA, 5683 bp, Oryza sativa
  unsure (1)..(5683): unsure at all n locations
agaaagtgtgtgagagagatagaagagagagagtatgacatgtgggtcccacattttttaaaataaatagaatgatgactggactgccacgtgtacgccacgttatccaaaaccaccgcggattgggtcgaggggggtaattcgtccggtttgcatagttgggggtgaagaatgtccgattttgtggttcaggggggtaattcggacggccgcgatagttcgggtgtaattcgtactgacggagcgtggggctcctcaccgggagaccgcgcgggcccccctttgccggttcggccgggggcgctgggtgaggttctaagcccttgatctgtggaatggttcgcgaaagagcaaatgcgcaagacacgagcgatgtagacaggttcgggccgctgagaagcgtaataccctactcctgtgttctggtggatctgtgtatgaaggagttacaaagagctggagagcaagagagttcaaactctagagcccctctccctcctcttttctccagtctaccagctccggtcctctctcctttttttctccttccgtccgtcccctcttttggtaggcatggtcctccttgtatatctcaaggggataccacatacaccatttctacctacccttcttttgggtggggacccatcctactttgaccaaaacttggcttgtaccttcgtctgacaccgggataaccctgtcctccctcattaatgggcggagatttacaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgcgtcagtttagcatgctacacgtatgcccttcttcatacaatgacctccttgcaatggttgcgatgaagcctggaatgtatctggccggggctgacgtgccaactccaggagttcccacgccggctccggctagggacgagtgtctggaggctctcatcattccgacgggacggggcgaggcgtgtgtcaggccgcctgttgccacctaacccgcgatctgaccggtctgtgaccggtcacacactgcgaccgatcacggaccggataagcatgcgctatgctgcattaaatgcggcgtgaggcgctcgtccaacccacaataaacgcggttaggtgagcgccgctgtgctcacctaacccacacacgtggcgccaaaccctcagggggtcggggcgccccagccctcggggggtcgaaacgggagcggcccgacccctcggggagatagagggtggggcggcctcatcaccctcgggcccgacccccccgagggggtcaggccacgtgggtgaccgcggctgccccaaacctctagtcaagatatccccggtcccatgtcaccggcacgtaccttttcctttccgaaataatagaggaggagttttgggtccggtaccgcggtggtgccaacatgttcgaagagaccagcccacatattagttacggcctacaatagactttcggttaaccgacatatcgcggcccaagcagatgcttgcgcttgcgctaccgtctccgtctcaatccccaattccccatcacccttattaatgatccaggatccaggttttagccgatcaatttgctccaatctcacaatttctccgccttctcgtcctcctcgccgaaccacccccatcgacccacacaaccagcgaaccggaaggatttcactcagctgagtttcctgcctccatccccacggcgatggcggaggaggcgaagaatctggagacggcccgggccgaccgctccgtgtggctcatgaagtgcccgaccgtcgtctcccgcgcctggcaggaggccgccaccgccgccgcctcctcctcctcctcctcggacgccgccgctggcgccaactccaactccaacgcgaaccctaaccccgtcgtcgccaaggtcatcgtctccctcgacccgctccgctccgaagatcagcagctccaggcaagccgttgatccgtctctcctcccggcccacgctgttcgctcctgttccgtgcgctcggtcgatttattcgtgcacgtggagggtggtttcgtttcccccttctattatgctgcttcaatttttagggtagttcaatggttggggcgagatgtagcggtttgatttggattgggggacctgtttgatgtggaaggttaagttgattggttgctttatcatagattgccacattctgaaatccaaaacaagaccaatggatcattgctattgattttgtgcttttaaatgctaacactagacagtttgcttcaatttccatctcatcattggttaactctgtattgtgtatttcactggccatggtggctaagcaatcttgttgcaacttaaacatttttgaattcaagcaattagtacatgtgttgttgcagaatatatttctttgataaatgattatactacaattcttcttatagtttttgggagaaaagcccaaagcaatttggaggcataaaccaactactgtttgagcgtttgaaaccaaaatgaatcttaaaaggttttaacagaatgtaactttgtaattaacttcaaatgatttgttatgttgcagcatagttaggattacatccttgtttccttgacgtttagatatgttcatgccttaaaagcagaagctactgtcatggatttgcattttctgtattcttgtataatagtagaaattgacttacggcttctatacttgtacacacacccagtgcctgtttcttatatgttgttagtgaaataacagttcaagatggagatggctcaaacaggcaatggcaatacaccaaagagttactccttgaacatgttcaaggattttgtgccaatgtgtgtcttttctgaatccaaccaaggtaagaataccaggctttctctttatttacgatgcttgcatgtatttctcctttgatatgtgagactttatcactagcaatttctcatggttgatgtgcagttcatttttattccaaatacagtctaggaatagcgttgttcaaatggtctactaagccgtattactaagctatatcgaaggaattggtgcactacctgtaactgtatacttgctggttaggctgcttaattggattgtttaggtcatgcgaccactactaggtgggtgagcaacaaaaaaatacatattgcccatttttggaatatcatctgggaatatgtaaaatataatctgcattcgtactttcctagactttaatgcactgagccagatgggagaggtcatttagttatagagttctgggttatgatctcactatttgtatgggggtgtctgtgggtaattgccttggatcaggttctgattactatctacatattggcttttcatcaaacgttgatgttgttactatcaatatttttttttgttctaatacactattgaaactgtgttctcaacgtatgaaactatcttctttttctataagtttgtatatgatctggaatttttatcggaacacattattgatgtttcaattcttaatttactcaatttctgcattactgaggacctccttgaagttctgctgtctgctggaaacttcatatggcttgcgtctaccgacatatcttacgtgcattcatcacataggtgtttgcataaagatttggttggcacaggatcatgctacattgaatatcccatatgtggttgatgaattctttggttttagctttgctaattctgttacgtggaagaagttcaagggcaacaaacattttcttttgtcatgttcttgccatttcaacaattttttcattcagttctttttggtgttataccttgtaaagtcttattggcattttatttgctgtattttgaagtcattgtggtataatctcctctactacatatgctatagcgaccttatgggaaggactatgcttcttcatttcatatttgggttaggaaggctttgtgttgatagtatttttcacggcttgaagataacatggattgcaatctgtttgctctgtaaacatagtattaacttatttgatacactaaatcatcaactccttgttacagggaagctttcatgcgaagggaaagtcgggcacaaatttgacatggaaccgcacagcgataatcttgtgaactatgggaagttatgtcgtgagaggactcaaaaatctatgattaaaaatagaaaattgatggtaggagtttttatgatattatatatgccatattgatctgcttcatatggtagaagtatttattgtacagattcaccttttgcccttgtctgtttttaggtacttgcgaatgacaatggaatgagcatgaggccgttgcctggcttggtgggtctgatgtcttctggtccaaaagtaatctttcttcagataacaatgccatgtttcatgtattttttttcctatgttgatagtttatcggatcctgttaactagcacagttccttttcccctcaactatcaactgctccgcagaaacattttaacttactttttttaaaccaatctttctattggcaatgtagatctataatgaagggtctataatctattgtaagtttttttttcccagcagaaggagaagaagccactaccagtaaaaccatcagacatgaaaagaacgagaagggatcgcagggaactggaaaatatcttattcaagctttttgagaggcagccgaattggtctcttaagaatctcatgcaagaaactgatcaaccagaggtattttttctcaagttatcctaattatgccgagggtggagcatttgttaagaaattgctagcaccaactctagttattgcatgttctgatatcaaagcctcaactctcccggcttgtttctgtgcagcaattcttgaaggagatattgaatgatctgtgtttctacaacaaaaggggtccaaatcaagggacgcatgaacttaagcctgaatacaagaaatctacagaggacgctgatgctactgctacttagaagtcttatgcttcggtctactagataggagtcctcgtccagtgtggactccaatccgttacttgctgcgttcaaggaaatcttggatacttcgtttatagtttgtttcttgagaaacatattttgtacgcatcaagcgatacatcttttggtgttactggcggccatatcttagacccagatttcggggactcgatatattcgtgtccatcagagtttagaaacaaggatgttgaaatttgtgtgtataatgtattttagctcttctaggcaaactaacatgatgattttcatgatcattaaacaccttgacctactcttccctgcatatccctcttttccatggatgtcaggctgggacgaaaccaactgagatcccttgcagtactgcaatagtaccacacaaatttttgacccttttaaaaaactaattttaattttacaaataaaccgttgccaaaacttatttcaaaaatgatactttttttcagcgtcaaatcacccggcgctgaatttagacaccttancgccacgtcaactggcgctgaatgccgtactatcgcggatgggaggctaaggcagcgtgctaacgcacattgagcgcc

SEQ ID NO: 23164 - DNA, 7222 bp, Oryza sativa
gtgtaaaatttatcacaccataaatgctccatgccaaatttgccttgttattgcaccagtgaatcgtaatgaggaaagcgatgtcatatgttaattcttttaccgaaagttgttgatttcgtttcatccttctatatccattagaaatggcggtgtagaaagatattacagaaaatgaatggtttgggagatgcctctgcgttcctatgcagctgggctctggttgcatctcaacatggcatagtagtgctatatatctctctccttgtattttaggtggttgtgttgttgtgttgttgctattcgatcatttcaacgcatcaaggaaatgagacaactcaataattagttgctcagagtgcagctcttttcttctcatatggatagcccatgttccattattttctacaacaaagataggttttaacattccttttatacatataatcctagttcttagagggcaagctcttactaatgtacccaggaattcatgtcaagagcatttgcagtcaggcatcataggagattaaagaatcatgcattttgggtgtaaatgtggttggaaataggtatcagtatacataattaaggttatagatttagactaagaaatatcaagtttccggcttatcggaacacaatagttcagacatgcaccggcaatacagctttgcaagaggtcacatggggatttacaattgccttgtcattatttgtgtactttgttgttaagaaaactgtagtttggaaatgaacaccctgggtcattgaagattgttgtgactgctcatcatctttatcaccttgccaaattcttatgcggttgccataggcttactcatgctttccatcagtattcattaggattaaagtgtcattcttttactaaaactgtaatatgctcattatttgtgctttactagcatttgaattcttttctgggtagggaagatttgcactgcaaattgtttacactgtttcagttgttcttaggtttggttgttgtaggcttgtagcaggaggattgactatatctggccatcatttcatagttattaacaggaaagatgatgcaatggttttatgatttgtaataattggatggggctgattggacattatccttatgccatctccgtttaaactcatttttttttgtgatttccattttgctctgctctataatttgagtatttgactattggaattgatatctaagctattgtaacttactttgactatcatgtctattttttattataggtgagcttttgacaactgaagaagcaaggaggcggcaggggctatatgatgagcttgcctctgtcggtaagctctctcctgcactcattgtcatacgggagcatctaccttctggaaaagcatgcctaagagttaacattgatgcaacgaaagtggggaatgtggctcgttttatcaatcattcgtgtgatggaggcaacctgcatcctgtcttagttaggagctcaggctcattgctcccaagactctgcttttttgctgctagagatatcatcgaaggagaagagctcaccttcagttatggtgatgctagacttaggccgaatggcttgccgtgcttttgcggtagcttgtgctgttccggcctacttccttcggaagagacataatgccatcatttgtaattgagaatttcctgatgtggtgctgccagaataatattggcatggcatcaggacgagtagacggtacctcagtacctgatgagtgatgactagtgctttcacaaattcagtgtacactatgcatgctgccttggccgttttcatgacccattctgtaacttttatctgacactctgagaaaacgacttgcaagctatgcattctttgctcatagcatagtgtaccgcaagttaccggagggtagagagtcttttggtagggatgttcttaaatcctactagtaaaatgcaattcatgctggcagttgggcatgcatttcccgcttcaggagtcaggaggtgatgaagatgaatcctttgacaaagaagactcctggagagagtggaggactcaacagaaaaacaaccttgtgccgttgcaatcctttatccaaagcacacttccgtttccgctttccctagcgtttgtttcctctgtgcagcaaccgcagcttatgccaatgccaccattgcccatgccccatgttccatttgcactagctttgcaagtgttgtcagagtaacacgatcgggcttcgcatatgtgctgtcctatgatcccgtattcctgatccatatgtcaattgagtcttttactgaagaatcctaggattttgctgtctgagctgtgtgcctgtgagcttgaagcatcccggtacatggcagcatcacttggggtcttgggctatatggcataaacgactcccgagctaacaccctcctcttccctctccccgtgagatccgcacgcgcagcacccgcatgaggagcgcctccgcgcgacatggccctcataaatcttgcgtgcctcggtaacaagacgattggccacgccgcgccgcgcgcgcccacgcgccgggccgccacggctcagtggcgcgccacgcgcgcgcccattttaaaaacccctcacttccgccttggtacccccgcgcgcgggcgctggcgctggcgcacacgcacgcacacatgcatgcagcgcagccacccggcagcagcaagcgccggggcgccgtggagcggccagctagcggcgcgggcctgcaggcggaggaggcgtcgtcggcggggcccggggcgccgtgcggggcgtgcaagttcctgcggcgccggtgcgtcccggggtgcgtgttcgcgccgcacttcagcggatgcggcggcagcggggtgggggcgggcgtaggagggagagggagggagcgcggcgcggcggagttcgccgccgtgcacagggtgttcggcgccagcaacgtggggaagctgctgtcccgggtgcccgccgcgctgcgcgggaagcggcgcgcacggtctgtacgaggcccaggcccggcatggcgaacccggtttaggcaagggtgggcacaatcttggggttcaagcacaggtggggcacacgatctgtttgaaaattggaacagcaacgaacacacacaattcacagcctcctctaccagtcataaatcaagaacaaattcatgtcacaaacacaaactgacacaaataatattgacccctatgaaaaattccgttcttctgattcgaaactccattacgcgagacgacaggtatctctcctgcaagggcagctctccgtcctggagtctcagctcttcaacctgcgggtggccttggcgagcgcgcaccccgacacgccgccgcagcacttcgtcgtgctgcagccggcgcactccgcggcgtccacgctgaaccaggtggtggtgaactacgacgacctcccgcacgccgtggatttcatggacgcggagcccgccgcgctgaggggactagagtctctccagctctcgcagccactgcagcgggaggaagacgagggccaccgagacatgaacctcttctcggacagtgtaggacaacggcagctgtaaaattacctgtgcaattgcatgattaggtgtctctgtggctagtacattcactcttgagttggaccacattgtgtgatttgagaattgcgtgggatcatcaatcatgaatatccgtattctaatttgatcaattccttcacgcgaatttcatgttcgtgaaaattatacattttatatgcgcctttttaccctgtgaattatgaaaaaactatgaatggtagcgatccaaactaggagccaaaaatgaaataatccagtgttcacaaaaaccgatccgttctcatcaaaaccgcactgtgttttgtgaaagtgaaactattggttgttgatttctaaaaaccaatcaatttttgctggttttcgcacgatgttgacttaaagtcagtccttttaactgattttcggtatgtttagcataaactcgtgggaaatatcagaagatgaagatagagaggatgactttcatggagagaagcatcaaatgtctatcctatgatcctatcctatcctatctacacaaatcttctcatttacacaccaattaacaaattttattaaaaaaatatagaaaaaaattgtacaaacacttctaatagtattatacttatgtgtaaagtcataatctcaaattcattatattttagccaaaaaaggataaaaaaattataacagttttgagagtataaatatgtgagattctgtcttttttgttgctccctgtatataatggatttcaagatgagacttcacacataaatacaatactactaaaagtatatatataattttttttctagattttctagtgaaatttagtagttgatgtgcataatatgggggtgtttgggagagacacacaaaaccataaatccctagaagagggacttatatttttatatttttgagagaacacctcctatgtatacgagaaaacttatgtgcataatataggttcctctgcagaagctacaactaaatgcagaggattcggctcccacactatcaaagtactggaagttttaatagatgagatctcgtgggctcagtccaagtccagtgcaggggaccaaagaaaggcactactccgtcgtgaaggctaaaaagggagggggatcgaggcgagaggaacgccaccgaacccaaaccccatccaatcaaaaattcgtacgggagagctctcgatttgatcgccgcgaccgcgaggatgtacaagtcgcggctgcaggagctgtgccagcagcggcggtgggcgccgccggagtacacccaccggtgcgcgggccccgcccacgccccgctcttcggcgccaccgtctccgtcaacggcgtggagttccgcacgccggaagacgccgcgcggtcggccaaggaggcgcacaacatcgccgccaaggccgccttcgaccacctctcctccctcccgctgccgccgcctccccctccctccggtgagtgccatcttccgtgcggaaaaaaataaaaaaaaaatcccccgcatttctttgttcctggatttttcggtggaaccttccttcatataggaatcgaacctcggggagcggtaggaggactagatttgggtaatttggttgcttgtagtttgagttaactgcgaattctttacctttgatgggaggcctgaagaaagaggcacgaaccatttggttatttactgggattttttttgtgtgaaatggcaaaccgagagttagtttcttggcgactgcaaagtttacaggtgaacagtgaactgattacagattaatggtaaattgcagcgaagggaaatgctcaattgctcatcaacttcccacttgaaaaagtaggagtagtacaaagcgttcatgtaggtagatgtactcaccggtacacatcagtctttgatttggcattgaagaagagttactgcactccactcaatgccccaatgaaatcttgcaccataatagctagtcgattcctgaaggtagcaaaagtttggtgagagcataaagaacggattgtcttttctttgtggatcagtttttttcataagttcatgtgcatctttgttgattattattactaaactataggaaggaaggtcgagcacatgcatgggaaccttatttaatgtttcatgaaactcctttattttaaagaagtaaaaaaaaccccgctaatgcttatatatgcataatatgtgtgagcttctttttgtgtctgttactcttgttttgaacttgtgacatagattttttttccgactagtcattgtatatttgaatattatcattggaacttctaaaagatgccttcgaacaaatatatatttgaaacaacttattttggcttgcgtaattagctgcattgtctagcttatttgttcagcgcctgtgatctgcgaaaaggatcacatgtgtttgtttgtggaacaatttagatgttggggatatgtacattatctttttttttctaactggtgtacaagcactgacatggaaaggttggatttaattgagttcgtgaatgttggaaatggagatctcggcttactttgtcctaattgtcctgatccttataacataatgttagaaaacacttagatcagatgggaaaatgataaaactatagagattaaatagatccattattaaataacacttcaatgttgctactgtaatgtgcccgtgaggactgtcgaaattaattagctcatatttctcatccttcttgtgcatccatgttagattgcaatgaaatacaaagaacacaattttatgttcagtaaaaacgatctatacattgcaatattcttgatcaatactagtacattacgctaagttctttcttgtgtcttgtcgcatgctactgaatgtttacagtattgcaaatgtattgcagcgaatgtcgcacaggcatgcacatcaatatattgcagtatgaatcatcatttctaaaagacatggatgtgtgcctgtaactcaaagtctaaactattatagtagcattccatgctgagatgtccatgcagtaatctttagtttgttgtcttctggtgaaaccattttccatgcactatggtccatgtggcttgaattagtatccaatacctgttataatctgaactatggtccacaaaatcaacggttggatgttgttctttctctgggattttctatcgtacttatctatttttttcttagggattccaatcgatgtttgatggacttttagtatataataggtaacatttgtagttgcggggtctaagagcaccgtgtactggcatggtgtaagaaaattgttgtttttcacttttatattctctatatttctcatattgaatgatttttcctattgcagaaaaccaatcttcttacaaaagtcagttgcaaatttatgctcagaagaagggcaaactgttgccttcgtaccaaacaattcgggaaggtccaggtcatgcatctcggttcaagtcagtagtgactgtagatggcaaagcatttgaaagtccggaatactttcacacagttaaggaggctgaatccggtgcagcaaaacttgctcttatgtccttacctcaagaagcaagctcatcggagcaagtgccggttagtcaagcttattacaattcactatttactaa

SEQ ID NO: 23165 - DNA, 456 bp, Oryza sativa
actaaccgagtccaggtctatccacgccgtcctgacctggtattgccggagggcgcgaccgttcttcctttcagtgacgatgtttgggtggcagtcagcctacctactctcaaccattaaggtattctgaacttcgcaattttgcctcaaattttaacttgttcctgtccgttgtctgctcgctaatgaagttgttccctctccaaatgcaggcagaagaaaactacgccttaggaacgttgcggtagacaagaactggagccggtgcttttgtgaagttgtagcttctgccaagtttaatttacctcaggcgtagtgctagctggcaaacggaacatgtccatgctgcaggaaccatggttattaccttcgatgtttagacggatgaactcttgtatcgtatctacctaattagttgcccaactatcttagcagcaacttgaattgaacttctat

SEQ ID NO: 23166 - DNA, 323 bp, Oryza sativa
cctcccaggagtggaccgacccgggtggcaagttcattagccaaccccgtgcttgccccttcagggccatgggaaagaaattcgccatgaccctgtcatcgcccccggcggcctcgatcctggtcgcgtagacctggagaaactcggcggggttgacgctcccgtcattttttcggcgatggtgggccggaaccttgggggccaacggacgttccgaaggctcgccacaaaggctctacagccgacaccaccaaccgggggcacggagggctgatcccccgcgtccgagttgaggtgacactcccgacgaggaggcgccctcc

SEQ ID NO: 23167 - DNA, 632 bp, Oryza sativa
  unsure (1)..(632): unsure at all n locations
agaagctacaaagagctggagagcaagagagctcttactctagaaaccctcttctcccttttttcctctcgtgggatctactctccagttcctctctcctttcttcttttggtccatcgttcttttttccgtccccccttgctaagtgggagaggtcctcctttatatctcaaggggataccacaggcaccatctctcttttttgtgtggggactaatcctctcttttctcaaacttgacttgccttctcttcataaatggacggagatttgtaatggttgccgtccgaatgaccttctgatgggagggcccatacctacctccacttccgccggaagcaggtgcgacgtgggaacatggctgtctgccgacgacatgaccagtgtcagaccggtcacaaatcggtcattcttgtccaccacgtgtcagtttaccaatctgcatgttggcctgtggtggagggggggctagcttgtaatggttgggataagctggcatatatctgacggggtccaanntgccacctccagaacctaacacgccggttccggctagggacaagtgcttgaaggctcttatcctgacgggatggggcaaggcgtggttaaaaccacctgccgccacctaaccca

SEQ ID NO: 23168 - DNA, 562 bp, Oryza sativa
ttggatcatgcaagatagcacaagattttttttcacatttgtttttggttttttcgtgctccaacagctacttttgagagagagtcaactatcaatgaagtgaaaagtataatgagattgctcccggaagttgaggttaggcatattggaagatggtgtaatagggtagctcatgacttagcacaattatagtacaatgcatttgtggagcatggatacccagtgttgaattcatgatgttgtaaaccttgagtgtaacaatcgggcgaatttaatataataggggtgaaaacagagaggatttgggcaatagcagtcatacctagggtgaaaatgaatcggataatatccgatccgatccgttctgaatctgtttgaaatgagaatatggtaggggtttatataaatccaacgattgtggtatcgctaaaatccagcggatgaggattatccaaagttcccattggattatccaacagcccaattcatcagataacataaactccttaattgtagactctcaccgtctcatctcatgcttgtgtagccaccaccactcata

SEQ ID NO: 23169 - DNA, 701 bp, Oryza sativa
cctttccgtttaaaattttcaactataaaattggaactttcaaattatattctaaaaccttcgatcaatcatttatttattgttttatttcaaaagtgattaagcataataagcggtatgcctggagttaattacgttaaaaaaacaaaacattgaaatgagcgtaggtcaattaattaggttgtgtaataaggtctctcggatttaaatatttttttatacgggtactcgtatttatgagtaactattttttttttggtagaccacgtaggctaacccgtggaactcacttgcatactaaaacaagccaggaacccgtcctcatccagcagtccaggtcctcggcattgtgggcttgtagccatccataagattgagatgatgaccggcagtcgcggtgtggagggagccctgcaaggctgcaagctggagcgcaatgcggcagccatgcatgaccttgagctcggaggcctcgttgcgggggtggtgaccgtgaagctggaggcctaccgtgctgatgatgggatctgccccctctcccttcgctgcaactagatccacccccatgagccccaagtttcgcatcatgcccgtcactgccgactgcatcgccctgagttccgcttctgtcgatcaacgttggtcccacaccttgagcctctgccaccaccaaaaggctgctaatggaggatatccatatg

SEQ ID NO: 23170 - DNA, 298 bp, Oryza sativa
aggattgtcctcatcgcgctccacaaccaacgccgcactaaccacttgcggggtcgctgctaagtagagtagcaagggttcatttggctccgggtcgaccagaactgggggagagctgagatacgccttcaactgggcgaggcatgttcagcttcctccgtcaggtaaacggtccggagcgtttgaggagcttaaataagggtagcgccttctctcccagcctcgatatgaaccgacttagggcggccatgcaaccggtgacgcattgcacatccctaagcttgctgggggggcgcat

SEQ ID NO: 23171 - DNA, 459 bp, Oryza sativa
ggtaccagcgaaggtactcacagtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcggtgaggctcaacgaaaatgtcgaacaccatcggcaggatggtgagccagtaagcctggtcgcgtgtgcacaaggacgaaaggcctagcggtgctctcgaagcgacggcctttttgtgtacggctcccagatgacgtcgctcggctgga

SEQ ID NO: 23172 - DNA, 343 bp, Oryza sativa
caagtagttgaggtcatctctgcgaagctgatcttgatcagcctcgcagtacatggtgggccgaggggacctcagggtgagctcagatgggagaaccgcttccgcgctgtagacgaggaagaaaggcgtttccccggttgctcggcttggtgtggttcggtttgcccagagcaccgctggcaactcctcgatccatgaatcgccgtgcttcttgaggatgttgaaggtcttggttttaaggcctctgaggatttccgcattggcgcgctccacttggccattgcttctggggtgggcgggtgaggcgaagcagagcttgatgcccatgtcttcgcagtagtca

SEQ ID NO: 23173 - DNA, 3258 bp, Oryza sativa
tcactactcaggatggcattaatctaagaaaaaatgtccatggtgtcgagtaagttaatctgctactctgcttatatgtatgttgctttccggagcgtactttaaagtcatgcatggttcttgtatatagcagctaattcacgtgcatcccaagaaaaacgaagatttaaatacagcatttgcccatgcaaacatgtcttgggccttattcactagtcttataacttctcttttttttcctccatcgcacactgttatgtttgtacacctctagacaagttcttgtgaatcatggatcatacatagggtcttaagacttatatactgatagcttcttttaatttgaaatcatgcataccaagttactgactattgtgtttctaagggacttctctattacaaggatgaaaggaggttatcgtcgggtgatccagcgacctattgattttgaatggtaagtgcaaccaagtgtttcatgccatgctgttcacctttttaggttccaatttatttgttgtacagtaaagtaaattttagacaaataaattccatgcacctctgtgtacggttgttggatatctgctgatattcatttaatttgttgttttatgtagggatctcatcacttatacagatgagaaaatacctttagtagaaacggatttagatgttttgtctaaaacgaagccattagaagtaaatgaactactatcagatgggatttccagctgtacatcacatgattctgggctggaagcttcattggatgcctctgaatcaataaatggagctagcctagtagtagcagaagccaaatctattggcagctcggatatgttggagaaactggccataaaattagcatttactctaccagcatcatcttatgctacaatggctattagggagttgatgaagacttcaacttcggtatttctccaattctctgatcatttctttgatttttccaaactaaaacttagttatgagcaaatttcatctgttttctgtgtcgttaatatatttttatctttttggctgcacacaggttgctcatcagaaaacattaaacatctgaaccttcggccatttgcattatttatgaaactaatctctgatctaaaggacatggatgtttagcatgcatgttatgttacgtgagtaaatattctctcattttactgattagtttttgtctagtccttaatcgtaatgctattttttggggggagttagtaatccgctgtttctttgtgcttgcaatgtcactcttgtactgcaatgggagaaaaatctaagtctgatccttcaaaaaagaaagagagagaaggaaaggccactgaagcgtcgtgactcgtaaacatgcttagctcatctggtgtgtaacaccagaattacatattaccgatttgtccatgtaaccgctcgtgcatattactacagtcacgtactgggaattgcctgtagtgaactagtgatatgtactaatgtttggttatcaactactccgctttatcgcagtttgacatgcataaggtttgtcaacttcaattatactggcagcctgttagctgtagccacaattttaacaagattcttttttaataaactaggttccacacaccattgtgtaaaaaaattgtaataaaatttccttacgctgcgtttttttctcccattttccaactcactctctcgttttcccacgcacgtttttcaaactgctaaacagtgcattttttacaaaagttttttatatgaaagttgctttaaaaaaaccatattaatccatttcaagttttttagctaatacttaattaatctaaactataatcgcgtgctttgttttccgtgtcaggtgcctccctaacacagccttaagcttgctaagatgtgaccaagaattcgttcgtctcaacttatgtgcaatatttgttggcaaatgatgataaagtataactagaaatcaaacacaacctaaatctaatctaaccttttatgttcttttttttttcgaaatttatgtaggcaagatatctgttgtatctaactctaactctagaacggagagaacgaagcggcctagaggtgtggtgatgagcgggttgttcattttgttcgattttctctcttgtccattgaatattgccactttcccctattttttctctcttctcaagtacaaatcatgattttacagaaaatatacagctgcggctttaaatttagatttgaactattcatgctcgttacaccttatacaggctgattgctctagagcggttatcaccgggattccaataccagagagcaaggataatagtatagttcatttcctactattagctcatcttaaaaccaatatatataatagattagctataagattggctacaattttcttctcctctctctatctatcacttacacatttaatgtatttatcttggatattgtgctaagttagctcttgtataagagccaaccttttgatttttttgttacctctcctccacgtaagtttacagtaggcttatagttcactattatacttgctctgattagaatcgagctcctgcatttttgtttcgaaccgcgagccagcacgtactaactgtgccacaacgctaaacgtatcgacccgtcctctccgcttttctagctattacctgttccttgcctcaaagcgattcaacccggagggggaaaaatgggttagtttgatccatagttatttagataaatatcattataattcgtgtattcatagatgtgattaaaattttacgaaattgaaaccgtgatgatgattttgcttaaaatgtttctctgaatcaaatactataatatcgtgcaagctctccgcttaagtctgaatgtatcttgtcatcttgtggaaagcgggttcagataacaacgaatgatcatgtcccctataccttaaaaagaaaaaataatcaaggttgaagggctagtttaatattggaaccttttagaccttgttcgattaattccttcgataaaatgattaggagaaatttagagaggatatattccacatgtattatgatataaaattattcttcctcaaatcttttcattttttttattaaacgaacaggccttaggttgctttttttttataagaaagtttttgtttggcctatcacggagggtcggaggccctcgcgcctcgttgatgcggcgcgtcacgcgtgctctggaagctggtgcctctctactgatagggtgtttggg

SEQ ID NO: 23174 - DNA, 6869 bp, Oryza sativa
tctcccatacagcccccgagtctactcccgttcaacttcgagcacctgacgctacgggctacgggggtcgcgacgacgtcgcgtgctgctgccgtgcccgcgtacgtgccgtgctgcggtgccaccacgcatcacgcttcacgcttcacgcatgcccgccgcgcgtttcaggcggcgtcgggattaccaaggcgcgggcgatcgaggtgtagggccgctactggtggagtcgagcgagtgcaacatatgatgatttctttttcttctgcccataataaaggttgggcattttgctagtgttgtgtatatatgaacaagaacgcgcccagagatccctccattaattatcccccctctctgctccgtcagtcggtttggcggtcgatcgatcggtgacgccgtgacggtgtatgtaggccgactggtccacgtacgtgcggtgcgattgctgttgtgatcgaggaaccgcgaaatgggtcgcgggggcgacgtggacggcgcggcgggcgcgctgcggcggttcgtgcgggaagcgggagggtgcgcggtggtggacggcgggctggccacggagctggaggcgcacggcgcggacctgcatgacgagctctggagcgccagctgcctcgtctccgcccctcacctcatccgcaaggtcacccaacacacgatgcgtggtccttcactttctccataacataactccgagttgttctgacggcttcgtgcaattaagccctgcaggtgcatttggactacctcgacgccggcgccaacatcataacctcggcgtcttaccaggtgtttgacaagctgttgatatagtaatagtatatggcgtctaacgtcggctataatctcggtgtcgtatatacggtctcattttcgcatgcaggcgacgatacaggggttccaggcgagaggcctgtcgcgtgagcggagcgaggcgctgcttcgtcggagcgtccacatcgcgcaggaggcgcgcgccatcttcgccgagggctggtccaagggcccgtacgccaaccaccgctcctcgccgcgccggcccgtgctcgtggccgcctccatcggcagctacggcgcctatctcgccgacggctccgagtacacgtacgcacgccccgatcgatcagtcgttgatccctggctatatacatatagttgtttagttcgattacgtgtgctgtgtgcagcggcgactacggcatatcggtgaccaaggagacgctcaagagcttccaccggaggaggctgcaggtgctcgccgacgcggggcccgatctcatcgcgttcgagacgatcccgaacaagctggaggcgcaggcgagcggcgaccccatcacggagtgcgccgccgtggccgacgcctgcgcgagggtcggcgccgtcggggtgaactgcaccgcccccaggctggtgcacggcctgatcctctccatcaggaaggtgacgagcaagccggtcgtcgtgtaccccaacagcggggagacctacgtggccgagaccaaagaatgggtggtcagtgcacaccgttgattttgtacttcttgttttggtttgtactgtacgtgttctttcgatcgattggtcgtacgatacacgcgttacgtgatgcaaatgcaatggtgcaggagtcggagggcggcgcgtcggagacggacttcgtgtcgtgcgtcggcaagtggaggcaggcgggcgccgccctcgtcgggggttgctgcaggacgagcccggccacggtgagggccatctcgtgggcgctgcgtgaatcggatgacgccgtgggtggtgacggcgatcgcgacgatttccctgcagtggccgtgctctagttgttcctgccttgtcgtcgatcatcgagtctcgtggttgtctggttgagcgcgcagttttgtgtgtgtatccatgcttccaatcaatggaaaatggaaataaaatggttcggttcgtgcagtttattcgattttcaacaccttctcgccttctcggtccaggaggaacacaatctttcacatcttgtaacgaaaaataaattgatccgcctcaatgtttcatctctaatgggcttgtctatggctactgatcctattggcttggacttgaatcacgaatcattgaatcagctaaaaagaggcccaaaacttcgttgattttatttagggtgcttacacgtctgagtagcacgcaggaaacaaaacaaaacgcggattcggtaattcttcccaaacagattctataaataaaatctcggtaagaactttggggagctacgatttgcctatgataaacaaattttacatcggggtgcatgtgtatcctcatctggtaacataattgcagcagtcagtatcatcttcaaaactctcatttagcaccctggtgaacaatctgtctacagccatatctctgacgatttgtcaaatgcaatcaggatctgtttacttatcaccacccatgcctccaaacatgccacccatttcttttgagcccatttgtttcatcaaagattgcaggccacccatgccgcctatctgcttcagcatctgcggcgggagaactttgctcatgtgctgaacgttcatgttgcgggacagtgcactcatttctcctttctttggtatcttgagccctttcatcttgctccagattttagcaagccgcttgtactcttcgagcatgtcgacaacatctctgacaggtcggccagatccccgagcaatccgaagaatacgcgattcagtcatcaatttaggatttgtgctgtcaagctctgagataaaattttgacatcagcataataaataagtatacagggggaaatcatcaaccacacactcacctccatctgtcatggaatccatcatcgtcatgtaccgtttaatcttagcttggctttccttctcatgtccctttggcatcaattcagaactaaatccaggcaacattgagaaaacctgcaaacacaccaatccagatttaaaagcgtgctgtgataatcttaaaagaaatgaaccctgggcatgtcaattaaacaagtaaacagacatcatgagctgtacgtttcatttcaccgcaagtaaaagatgttgctaacctggccaataggacccattttcaagatgttctggaactgctcatacataagtctcagagtgaaggttccttcagacagcttctgcaaaagctcaggttgttgatcagtgggtactacttcatgaatcttgtccataaaccccgaccagtctcccatgcctgtcaattacactacaaaggttaaccataagaaacactcagcaacatgggacacgtagtattttcactgacctaaaagacgactgacaaatggtttcacatcaaaaacttcaaactcatcgatgtgttctcctgttccaataaatatcactggactttttgttgctgcaaccctgtaaagaaacaagggtgtcagatatgataagtcattaacagattctgaaatgttaataggtattcattcacagtatcaaccctaaataaggcatttttcacaaaaggaaatgactacatgaacagagaaagtgtcgtgcacacaggatctctgcactttgaacttttaaagtatgctatcctgaagcacatacaatatgatgaaactgttttgcggataccacatctaaatgccacaatatcatgatttcaccaagctcaggtacttaaaataaaatttgcattaactgaactaaacttcatggttgacttgacactatatggttatctagaataaaacagggctctataagagttcttgttttaaatatgacccaaagttcacacaagatctctttcagattatatggaaacagtactcatgaagtgggaaagagaatagaacaaatatgctatcgcaagggaaagaagagaatactaacgcgctaagtgcgccacctcctttcgcatggccatccattttagtgacaatcacagcaccaacagaaacactttgcttaaatgcttgtgcctgatcaaatgcagcctgaccgatactactgtccatcacaaatattaccagatctggtttctgcagagaagcacaaaaatgtgttttagtttttcactataatcagggtgtttctcgaagtacttcaaaattttgactatattaccgtcgcttctgaaacttggcgcatttcttcaaaaagggctgcttcttgtttgtgccttccactcgtatctacaatgatgagatcacagttttctttcttgaacctctccacaccctcaacagcaattttcactggatcagactccatgtagctgcaacaagacacccattaggggggaaaaaagaatacataaggttaaacaaaagttaaaggtagacaaaatatagcaccttccgtaaaaaggaatcttggcctttgttgcattctgttttaactgatcaaaagcaccagccctaaatgtatcagcacaaacaagtgctggcttaaatcccttgcgctgatgataatatgcatatttggtacaagtagtagttttaccagaacctgcatggacacggtgcttgtcatgggaatggaatattgcaattctattaatgaatctaaaaagcagaagataaaagccaaacagaacagaacattggtctttgtggctaaagcaaacaacagggttcattgctaagccaggtagtttgacaagaatgacaaaacttgcaattttgcacatatttgcaacagatccatccatcgggaagccataaaaaattctggttatagtgtccaattgcaaaaaaaaaagagtaaaaaagtgatagagtatatctgttcatgatgcatcatacacaagcccagataaggaaaaaaactagatgaatgtcttcgtgcaagacccaatttaggattacttaataatataaaatacttagatgattcattgcttctgaatgggatgatccaacagataaaccatgtcacacatgataagcctaactacaagaccacaataggaacccacggttcttaaaaaggaaaactaaagtactccaataaataaagctgttggacaaactactcgatacgtgcatgatttattcagctgctctgctttttgactaaacagaagaacatgaaactaaaataagaaaaacaaaacttgcagcatccttgcaacagtcatgctaacactagccattaactggaccatgcacatgaatggttaggataaccatacttgtgtgaccaattcatttttatttattctgcctggcaataaaatcagaagagaaaccacttaatagttaatactatcacatccttctgtttgaactaatttatcaagttccctttcagaatcattcgctgaggcaaagttctcaaattcagctaagatcatggtgattcagaaagtgtctaataaaaagtcgtgatagataggacaattctactttctacattcttaccttgtacagatgtaataaaccgaaattatcataaaagagaaagcagcagaagtaattaattggggcataactcagcagcagctagactgaccttgcaaaccaacgaacatgaccacgcaaggtttccccttcttgggagtgaaggaaggcttcccgggatccaacatgttgcagagctccgtgaagacggcctaaccatcaaaccatcagtcaacaagatgctgcaaattacccgcaaattacaccgatgcgaagggggcaggggggctcacctgctggatgatgcgccgcttgttggtcccggcggcgagcgtctcgaggttgacgatgcgcttgatgttggactgcatatcgcggaccatcttgaactggacgtcggactgcaggagcgcgcgcgagatctcgttgaggcagtcgctgagcaccttctcgtcgatcacggtggcgttgctcatctgcgccagcgcgcgggagatgctcccgccgagctgcgcgagcaccatcttgcccggccttgggggattcgcctacctccggtggtctcccctcctcctcctccaaaccctacttcccctcggatcgccgacgcgcgtgcgggagagaattagggttccgtcgattggggggactgtatatctattgcgagttggatggattacgccgccgcggaggtggagccgtggaggtggtggtaatcctcagatggggggcgactcggttgaataccggggattcctccgacgggaaggcacggagtacgcgtgtgtgtaacactattctttttttcaaaagaataataataattttcataaaacactacatattatatataatgcaaattacgcaaaaccacattaattttagcacgcgacgcataatctcaggtattatcatcctaaagttttacaaaaccacaccgttaaccattctgatatacttatagataaaaaatttaaaaacagatgtaatatttatgtgattgataacaaattcataaatttaagcaatgattttagaagagtaaaatccatcaccggtccctaaacttgcacagctctgtcatccaggatcctaaactcccaaatcgaccgtccaggtgctaaaacttgtccgactgtgtcatcccggccactaaacttgcagattagggaccgggatgacacagtcgaacaagtttgaggacctgaacggtcgatttgcgagtttagggaccgggatgacatagcggtacaagtttagggaccggtgatggactttactcattttagaatttataaaacagtggtacatctgttagtgatatggttccgggggtatcagaaccatagggaggaggctgcccccggtagccacgtggccctctcctcgaggggggtcgggcccgaggcagggcgacggccgccccctccaagtctgggggtcg

SEQ ID NO: 23175 - DNA, 6556 bp, Oryza sativa
  unsure (1)..(6556): unsure at all n locations
tccgacccccttcacatagtgccgcgtgtgtagggcagcgcccacctaaccgcatttaaggcagtgtgaccgagcgctccacgctgcattaaatgcggcacgtggtgcgcctagccggattgtgaccggtcgaatgaccgatgtagccaaggtagtgcgcctgcgcactggttgcatgtcaggcggtgtgccatctgacatcccctgtcacgtcacgatgatgagaggttgcttagcctctcatcacagccgaagacggtttgcctaacccggttaggatagggtttacgtttcccgacgcaagtgaggatccaaaagtcttcactcattaaatatcgaatgacatgcgtgtcccccgtgtcagccagataaatttgacgggccccacgccatggcaaggcgtgcaagagacttccaaggcaagcaatgagacatgcatttaatgagattatcctccatagataggctaggtagacccatgtggtaaccccttaagatataaaaggaggtccaagcctacctagggagaggatgagcccttttttttagagcagtcctctgcccatcatcatcaacaccttctactccaataaggagatattgtaatttctcacacaatcagctaagcacaggagtagggtattacgcttttcagcggctcgaacctatataaactccttttgtctcatcgttctcggggggttcgaccccctctagactgcctttctcaccgagtcctcgaatctcacccgctgcccccggccgaaccaacaaaggggggcctcactgtcccccgctagtggagttcaccctccgacaacatcacagttaaaatgattaatagtgtggtcttgtgaaactttatgatcataatactttggtttatgtaccatatctcaaaattcatgtggttttgtacagattggaccattagctcgtgagataaatgtctcaaacttagattggccggactaatatgaaaggagtatcaaaatatcacctattgactctgatataaagaccaaatctaattgtaatgcataattgaaccgagacaagccattacatcataagcatactactccctttgctgataatacttgtcgttttagacaagggttaggtcaaactttagaatctttgattatgaatcatttttaaaatatttgtctttcaaatatggtcactacatgtatagattagttctaaaacgtactttaataaaatcatatatttgttaacacttttacacatattataatggaaaataataatcaaagttatttttttggagaccatgctcttgtccaaaataacaagtattatcaacccagatggagtacattttgtcggattatggttttctctgttttttagtgtgttttggcacatgttacgctattttgccaaaaatacaatcctcatatttgtacgaaatattgcatagttgaaaaaaggctacatcgttcgaaccaaaaaggttcacaccgtccgaaaaaaggcagaaatttcgggtggatttcaatcaaatccaccacctttagatccgtgctgcgtttcgcgctacacttcttctccaccaactcaggcaagatggcagcaacctgacgaattatgtctcaagttggggtcaaggtggaagggtggaggaggagtttgccaccttagaaggatggttatgggaggcgacaatgcagtgaagggcagtagaacggacggggaacgatgcggcgacgacaccgaagccgcggggtcgacagcaggcgatggaggcaaagcaaagtgattggttaacaagcgagggagaccgtggcgcctccggcggcggngagcctccgaagacaaggaagaaggtagcacgggggcgccaccactagcttcangaggaggaggatgaggaggaggaggaggaggagagttgagaagggatgaggaggaaggggggaggggaaggtatgcgggccttcccggcacggttggctccttttcgacattggcgaggcttgaccgcgggggattgggcggaggaagcgaactcaatcaattgatagggactggtggcgtagtcgtgggaacatgaggaggtgaaatagagttcaagtttagagaatgcatgaatcttagaataaaaaatacaagctatgggatgagattttctatcacgcgttgtataggtggtcccagaaaatgcccaccttcaatcaggaaccagtttggcagtcatcatgttctacgaatgtatagatcctttttcctttggttttgctagatttcatacgactaaaagtttgtaactctttagttacctaaatttgcacattgccaacccaaatatgcgatgctatgcaattaactgtagttttgttattatatatagttttgcgctgaatttatctaagtttgaatcatgtaatttcatgaattgcatgttcatttcatgtttgtgttagaaaataattattattcaactgtcggagatatgggtccgagggtatgcgaagtgtggggaatctaccttcctatcttgccgcgtgtccctacagcctagtcctgcccccgcagcccgcgaaccgctggagcggccgggagggggggtcggggccttgtggtgccacgtcatgcccctcgggcccttgcaccgcttcgccccgaggccctcgcccagccgccatttggcgggaggagcgagcgaggagggggcccaggctgagcttccattaatgcgcgcaacgccccaactgccccctgtcgtatttaatgcagtgaggcagacgtgcggcgtgctaatctgacgcgccatagtcaagaatgaccggtctgtgaccgacctgacaccggtcacgtctgactagaccgacaaccgtgctcccacgtcgcgtctgcttccggcggagtggaggtaggtatgacccgtcccatcggagggtcattcggacggcggccgccacaagtcttcacccattaatgggggaatgacagggctgtcccccgtgtcaggcgagggacggcgctggccccactcaagggcaagctatggcttagcttccgggcgaaggcacgggtcgagcccggtcaggatagggtgggtccccatccgaaagaaaagtaggtagagacggtgcatgtggtatccccttgagatataaaaggaggaccttgtccaccaaaagaggggacgactctcagtaggcttgaactctaggagaagaagagcgagagtgctctccggagttgaggaacccttgtaacactcaaccataatcccaaacacaggagtagggtattacgcttctcagcggcccgaacatgtataattcgattgtgtgcaagctaactagtagccctaggggcggatacgtgatctctaagaggcgagctccttcctccggtcgaactcacgaaagggggggggggtctcacgacctcccgctatcgagggacttccctcgacatcaacaattttaaaaaagagagactttgtttaaataagtaataaagggagtgataagaactactccctctgctctattataagtgcagccatagttttccgcgcctaattttgattatttgtcttatttgaaaaaaaataaaaacatacttcctctgtttcacattataagactttctagcattgcccacattcatatagatgtgaaacggaaggagtaagtcacaagcaaagtattattcatgttttatcatctcataacaacaaaaatactaattataaaaaaaattaaattagatggacgattaaagttaagcacgtaaacttatggttgtatttaaaatgggagggagtgagtattagattgtcattcaggaggaaaaaaatgactgaagtactcgaaaattccagtcacatagtaaaagctgggcactcctttttctttctttattcacacaaacggtttgtccaaccaaaccaaattagtaaattacaatagggcaccctatctattggttcaatttaggactaccagagaggttccagaggggaaaaggagtagggcgtgaaggcagtgatggacttctgaaggtggccgcaatcatccattaagtggatagcgatggatcgtcaagggtcagctcggttaggctgattatcatttggacgtattcgtaagaagctagctaggagtacggtttaggtggtctttttactctaaaattttcatttacgacgatagatccaattatccaaacataattcccataccattctatcatattatataaaataattttcgtttcatcatacattagcataagaaaacgaatccctttatttcttccttctcataaatcgatccctatatgctccaaatagacgatatattcgctcagctcaaattcaaatgaattaacttagcaaagtgagtgtaactcttgattaaatttcttatgatagatccaacacacatatgttcaagttctagacttagacacgggttctcacatagaggtaagtgcgagcaccttataatcgtctccgtttatactgtgtttaaaaaagaacccaactcagctcagctcacaagagaccctctttgatttacagttgaagtgctcaaacgattgaaggacgaggaagatcagtgctcaggtagtcatcgttaagagaagaagaatcacgtcaaaacaatttagtagagattagagacagatttaacaacggaaaatccgagcgtctaagcacacaaatgacagatttaagtagggaccagtaatgaacgacaaatcaagagtaaggagctaataatgtatttttgagattatgggaacgtagatgacacatacgaacaaaatatacatcgaatttccagctgcccgcatgcttgcacctcatgcgcaccatgtgtgttaaaattacaaactcaattcagatacagagtacaaggaattggcataatttacaggagtgatctacgtcaaaatataacaaaaaagaagctatctacctgctgactaaaacgaaccaccatatttcccaacaaaatgttacatatacaacctttctcgtaagcacaaaattgcccgtcgcaatgtagaagcaaaaagggaaaatttaccagcaaaactctataattctatgcaataaaaataatataagggaggattacaccactcatcgttacgttagacgttgcagtcctagttccgaggcaatgagtctgagcagaacctgtacaagctcccgtaccctagcttctttgatgcattgggatatatagaacttcagtataacttcattagcaataaaaagttggtactataataaactgaagccaatttttaagaaaaaaaaaaacaccaccaactgctttagccgtgcagcaaaaaaaaaaaagttgggaactatacccagattgtcaaatccctaacaccgatacttatttttctctatagagcttcagggcatgtccatctgttaatatttatattttgctgtgtcgtgtatactataacagacagaataaacctgaagccatttccataggttattcttgtcttgttcaaatttcaatgcaaagtgtaaactgaaaaggacaatccaatttttggcttccatgttaacaccatcctaatgttgaatggaaaagaaaaacacaaatggcttactcagcaaacataaacatgcattgccagcacataaagctgtcggctatgacacagagttgtactgtaaaattgcatgcgcacttaagaactgtggggatacaaaacctttttcttaccttgagacaacaagctcagaaaaggttggtagcaaagccaataaatgagcccgtccatgggactcattcttctctaaagcttcttttagatataatggcatgctgagggcattagctgtttccatgtttattattagtctagcgagttcttgtagaacacaaattgtctcatcaatccttacactaggcaatggtccttctcctgcagcatatttgaaatatcaattaccatgttgaaaggaaaccagaaaatgaagcaggtttacatattatatataaggaagttcaaaattatatcattatccatttacctagatcattttcatcagctaaaaactgacccagtataatctcacaccgcttcgtaagaactgagatcgatactttgctggtttctgatactgtagcacataagcttgtccccgatgtacaactgcaatcattgaaacaagctatactattcagttctaaatgtatgcagagtgtagcggaggttaacgttctgatgagttgctagtcttgtgggtctatggactatcctatgttatcatgtaatgtgtgaattctcaaacatgggcaatgtttccaattatttttaagataatctgcaaatgcttttgaacactgacggatctggttttcacagtgaggagcaggtgcaatgcagcactggttatcacgtttgtcttttggggctatttttgtcagatttggtaagtattaaatactatttgctgaaaaagttgcaataaatattcaaacaaaatatgagtaaaaaacaaatttgcccatagtttaacagttaatggcccaaa

SEQ ID NO: 23176 - DNA, 492 bp, Oryza sativa
acatgaaaatacccatcgattggagtgcatttctgagggagagctcgtcagatccacaatgacattgccgtagtggggaggccagtaggcattttcacatcagagcctagcacacagagaatgatgttagttcccggaaaacatggctcactgaacatcctgctcacaagctgataacatctataaataatgttgaacattgatacaatttatgccagaccaaacatatgcaagatcaaaaactcaataaggatagtcgtgatcctggatactgcatagttgcacatgacaaacaaatggatggcatgaacaaaaaatgctgaaactcagtcacaaaatgccagaaccatgcacattatcagcactccagtcatgtgagttttagaacaatttaataacttagcaacaacgaatcaaaacaaaaaattatagcataatcttcgaagttacctctaattggcaggtggcattgtaatgaatgcagcatgccag

SEQ ID NO: 23177 - DNA, 150 bp, Oryza sativa
ggcgctcttcgtccaagcggtcacgtggggcgcacttgtcttctgtgccgacgacctcggggtcggaggacgacaggtgcggccttcccacagtggcctcggggccgtcctgggggtcgggggctcctggcgtcgtcggacaagcgggca

SEQ ID NO: 23178 - DNA, 433 bp, Oryza sativa
aagccgaaggttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaa

SEQ ID NO: 23179 - DNA, 1245 bp, Oryza sativa
tgtcttgcttctgatgaggttgtttgaaatagaagaataatgattagtgaagccttcttctgacactattgagttaaagctaccattatggcattgtcatctgcaaagttgtggctatgcgcacctcaattataattttttgtgttgttttgtaggtagtgtattgagtggtggtggaagtgtccctgctccccaggctactcctgcagtttgggtgaacatggtaaatgaattccagaaaggcgccttgtcaacacgtctaggaatacctatgatctacggcattgatgcagttcatggtaataacaatgtctacaatgccaccctatttcctcacaacattgggcttggagctacaaggcatgtgttctaatatctatactttcgtgtattcattttgttgtgtgagtgcgtgtcaaacattatctttctttgtattagggatcctgacctcgtaaggaggatcggcgaagcaactgctcttgaagtacgggcaacaggcattccgtacacctttgctccatgtattgcagtaagcacacgcacgctgtagtattgttgctgttatgcattggatcttcagtggagcatgttgcaattgcatgagtatatggctatatgtaccattcttgattcattaagagctttgttgaccaaaaatgcttcatacaatttggttcaggtttgtcgagatccacgatggggccgatgttatgagagctacagtgaagaccacagggtagtccagcagatgacagacattatacttggtctacaaggagatatcccaataaatcataccaagggagttccttatattgctgggaagtaagatattttttctcattggtgctataaatgatattgtagatgtaggccattgtatggagcatgtgcatgttgacctaaataagtaaagcttatcggcctaaatgagcaccttttattaacaatatactttttacatacatacgtatgtaatagttagtggcacatctacattgcaaaagctataggaaaataatcaatgtcaatgtcaagttgcaatgtgaaggttttctgtcttatgtctcagcttatggcttttaacagggataaagttgctgcttgtgctaagcactttgttggtgatggtggaactcataatggaatcaatgagaacaacacgatcactgatgaacatgggcttctaggcattcacatgcccccatattatgactctattattaagggtgttgctactgt

SEQ ID NO: 23180 - DNA, 7941 bp, Oryza sativa
  unsure (1)..(7941): unsure at all n locations
tggatccccctgtgaatttctttcaagaagattagttcatattttcatactagctacaataagcatggtttagtttaattttagtcaacattcatatcatgatactggaagtggaactggtcttactactttttttttgtggggggaagtcttaatacttattataccaatattaagctggaagtttatttcgttctttttattcagaaaaaagaatacatcatttcatctccataacaggtcatggtgccattcaattacacccaatacattgatgatgtgacatctcttgttaagaagggtattatcaatatgagcagaattgatgatgctgtcaggcgtatccttcgagtcaaatttataatgggcctattcgagaaccctttagctgatcttagcttcgcagatcagcttggaaagaaggttgataactacaacatgctgtatactccacagagtaaatttcacaaaactacaaatactttggttaaattatcacaaaaccatagatttaaagtgatgtaacacagaactacatatttaacaataaatttatcacacaactataagtttaaggctaagtatcgcaaaactacagatttaataataaaattattatcacaaaactacaaattttggggtttaaatccttagcactaatgttatgttggacttataattgttttaaattttgtgattaaattatcattaaacctgtagttttgtgataactttgttactaaatctgtagttttgtgatattctaccttaaatttgtagttttgtgataaatttagtgttaaatctgtagttttgtgatgtatcaagttaaatctgtagttttctgataatttgatcaaagtatctgtagtttcgtgaaaattactctacacaattgacaagtttggaaatcatccaagtaaatgagtaactaatttaacaggagcacagagatttggctagagaagccgtcaggaaatcacttgttctattaaaaaacggcaactctcccaatcaacaattcctgcctctaccaaagaaagctagaagtatccttgtagctggaagccatgctagcaatttgggctaccaatgtggcgggtggtcaattgaatggatcggaggtagtggagatattactgtaggtatgtgttttttctatatatcatatattcttttcttttaaaacgaataaatctactatttcaggttcttatttgctaaattcaactatacttaagaaaagctattttgattttttttccttactgtaataattaaatgcatttattctgttcaggtacaacaattcttgaggccataaagtccactgtcgctgattcaacacatgttgtctactctgagaaccctgatgaaagcttcatgaaaaacaatgacttctcattcgctattgttgttgttggtgagcgaacatatgctgaaacaacaggtgatgacccagaactcaccatcctagaccctggtacagacacaatccgaacagtgtgttccacagctaagtgtgcagtggttatcatctctggtcggcctgttgtcattgaaccatatcttccaatgatggaagcgctcgtcgcagcttggcttcctggaacagaaggtcagggtgttgcggatgtactgtttggggactatggcttcaccgggaagctcccacgcacttggttcaagtctgttgaccagctgcccatgaatgttggtgacctacactatgatccactcttcccttttggttttggtttgacaataaattcatcgcagccagggtaagtaatttcatcaatcatccacactaatgcagctcaaaatctaatcctaaaaatctgaaaggcacactagttcgaatcaatgctttgtggtttgaccttcatattgtttcatgttttcaggttctctggtgctgacagactgagagataggaatggggggatgatatacgttgtgttgagtttggtactgtcagtaatactgatgcatgcttcgggcataggtatattttaactcgagttgccctttcctagtcgtagtatggttccacatcaagtgctccatgcctccatcgttatacgttgtatgtactagctctatggagattttttgattgcaaagatgcatttatccctaaagctaggtgggtcagtgggtgataagcagatttgttctttcacggttttaccaaattatgtgtggttataatagagcatttttatctagggaggacaaagtagatggattatgctctgcaaatactgatgggcctacagcacttctttactctccgtaccatgtgacactccacagaaagtaaaggaatattaaaatgtgggtaagaaattgatgggtttgaatcatactccctccgtttcctaatgtaagtcattctagcatttttcacatttatattgttattaatgaatctagacatatatatctatctagattcattaacatcaatatgaatgtagaaaaatgctagaatgacttacattgtgaatatatatctatctagaatagtttgttgcattatgatattcacattgcaaatgcccttaaacaccgtaataataagttaacaaccacaactaagacatggcctaggctcaccacccttggccatataggcgaaggggcaaaggaagggcccctctggctggccatgcagcacggccgtgcaccacaacgtcacaggcagccggccgcagcaatcctccatcctcacctccacctccagcgacacgcgctcgcgccgccgccgctggctctccatgcgctcgtacagctcgccgggtatccccaccccgtcgctggtcgccacgatcggcacggagccgaccgcctgccccggcacgcagaacccgcccgggaggtcggcgtgcgcgagctgcacgccagcgtacgacaccgccgcgctggcccggccggcgcagaacgcgcggcgcgtggcctcgttgtcgacgcggagggtgagttgaagacgggcgccgctgccgccgcgccggccctctcgagcccctcgatgccgggcaccttcacccagaagtcgggcttccggtagccgtacatgctgttccactgcccgtacgctatgagcgataagagagtcgcgatgaaggtcgctagtagaaagtatcgtagacatgggcgcctgtccaggcaattgccgtggtcgtcgtcatcttccgccatgtcggcgcccatgactctaaccgctaaaacgatgcggcgagaaattaacagtatcaggaccggacctggataggcacgtacacctgtacgttacttataaaagactggtcgtaactcgtaacggaaaaggtaagactggtcgtacccagacttcgggcctccggtagccgtactcccgcgcagcgtcgtcgtggccggcctcgtggatagcagcagggcagcacagttggccccagcaaacccagtgtccacaggaggcaagctcgcgaggagcgacgactaccacaggcgcttcttgttcgcgcggatcggcgccctcgacagcatggtacgtcgctgccgccgctgcttcgactggtcttgatcgccatgagcccatgagctgccatgcatgcatgctttaatactagctagttacgttcgacaagatctccaatggatcaaatataatagggtcgttgaatccaatcacaaaacggcaacactaccgaacgtgatcaccatgtcccacagagtcttataagtaacgtaccaaatccaggacaggtcctgacttttttctcgctgcatcctagtacgtcttagcggctagatcatgggcgccggcatagcgttagatgacgacggccacggcgattgcctggacaggcgcccatgtctacggtactttctactcgcgaccttcctcgccactctcttattatcgctcatggcgtacgggcagtggaacagcatgttccgcgaccacgacctcgacgccttctccgtgcgcctcgccggctacgagggcatcgacctgggcaggccggccgccacggtgtcgccggagttcagggtgacgctcgggacggcgaacggcgcgtgcgtggaccgcgcggccgtgaccgtgctgtactcgggcgtggcgctgggttgggcgcgcgcggagccgcgcgactgcgcggcggggcgcttggagagggacgtggaggtggtggcgcggggccagggagtggggctgtcggatcgcctccgcgcgcgcatggcgtcggaatggcggcgctcgtcgatcgggcgcgctggagctcgacgtcgacgtgaagatcttcgacgaggacacctacccggtgcacgctacctaccacatccctgacagggtgatgctgtgtaaggtgaggacggatgggcgagggtcggagtcgccgtcttgcccttggttttcgccgataactttagctttcgcatagaaattagtaggcacactgcaaactgattaattaatattagtagattgtatatttgtactactgttgtttgtgtacaaagtccatatattaagattggtagattgtgcatttgtactattttttttaacaaagtccgcatatgttttttttccataaaagaaagttacaaagcgagacgcttatatatgtgtgcacatttaccactatgaacaccttcaatcaccacatacatctggttcttgacaggtactgtatgtctttaatcactaaaaagataatttaaccataaatatgagtaacccatgtcagattttaaacctgaatttttaccattatctaaaaaagattttaaacttgaacttggattctcaagtggacatatttttaaaaatacacagtatgaatgcagacgttcataatgtggatatattcatcctatgaatgcacgcaagcacatttacccgtacagacgcacaccttacctatgtgagtatctcttaccatatatatcgaccatacattcatgcttattttacgtagtttaaatatgttgttggtaaaattccacaaaattgcgttgatgtatcggaatttcttctatcttttttttccctcgtacaactggaatactcggttgagtttttcttctttttgcgagatacttgctaatttgcaccatacaatcaccaaattatttcgatttatttatacacgtttgatgagtttggagaaagcgagcatcagaccgttgggcctcacctttttcttatgctggctcatcagccaaaattgaaattttcactattagggcccgtttagttcccaaaaagtttttccaaaaacatcacatcgaatctttagacacatacatggagtattaaatataaataaaaagaaaatctaattgcacagttataggggaaataacgagacgaatcttttgagcctaattagtctgtgattatccataagtgatacagtaacccacatgtgctaatgacggcttaattaggctcaaaagattcgtctcgcggtttcccgacgagttctgaaattagttttttcattcgtgtccgaaaacccctttcgacatccggtcaaacgtccgatgtgacacacaaaaattttcttttcccaactaaatacacccttaattttggagttgattttggggttttttcatcgaaatttatttttcagtatttgtttttaaattgttaagaacatgtatacaagttatatttataaattattttttgtttgcaaatatatcatttcatttattccctaaaagatgcgtgagatgtttgtgattgcgtgtgttcggcatgcacgccacgccacaccggtcacatgaaactagacaccagcccacatgagtgcatgacccaaatagtgttacagtgagaccgaaggacaacgccggattactactctcactagctgatgacgtgaaagttgaaagtactcccttcgtccaaaaaaacacgatttcatcacacctggaattcgaggtgaacctcggtacacacctcaccgcgccacggcgtgagctttcaacctcagctatatagaagtagtactccagtaattgacattgtgttgcttcctccgcaatcgcttcaaacagttgttgccacagacctactccctacgtctcataaaaaactaacttagtgttgtccagattcgttgtactattatgtatcacacgatcatctccaattctagattcttttttttttggacggaggaagtacggcggttgaaaccgatctttatcatttctctcctttcaaatcacccacgtggtcagtgtatgtgatgcggtgtcaaatcctattagagcaagtttaacagtatagccaactactagctccaactcatctatagccaatctaatagctcatttatacaatagttatatactacagtattaatacatggtcccatctatcatacacacattgcttcttggagtccgtgttacagctggctataaatctgtagcccgctgctcttctctctccttatttatctccttaaaatatgtctgcagctggcttatagcctgctattgtacctgctcttagagcaagtttaatagaatagcccactggtagctccaaatcatctatagccaatgtaatagtcaattcatacaataggtgcttaccatactattaatatatggtcctacctatcatacgcacgttacgtcttagagtccgtactgcagctggctacgatctgtagcccgctgctattgtacctactctaatgaaccacctccttttacgtgtttggagggagagttcactctccctaccgaggacagccttaaaacaaaagcaaaccaaacaaatttacctcacattaatccctggaatttctatttctactttaaatccagccatcacatcgatccgcactaagagcaagtttaatagtgtagctaactgttggctccaaatcatctatagctaatctaatagcccatttatacaatagttagctataaaaatatactataccattaatactcggttccacctctcatacacatataacgtcttggagtccgtgttacagccggctacaaatctgtaacccgctttcttctccctcttctctttttttctcaatatgtggttatagctggcttactgttgtactatacctttgctttgtgaattgtgaggtgcggccgcgccgatggaaacgtgtgtgtccgtctcgagcccctcgaggcctcgatgtcggggtaccttcacggcttcacccagaactcaggactttggttagtaaaacgccatggcacaagaaactctggacgccttggtaagttggtcccgactctgattggtacacacgttacttgtagcacgtcttgaggtatatggttgcggtaatcatatatcgcaaggggaaggatttccatacatggatggaatcaaattgttgttcgatcgatcggaagttcggaactaatcacggaatcgaatataaaaccggctaaatagaccctaattttcttggactctactataaaatctccagtcgaacgtaaacctggtagcattgttgaacgtgctaattgcatgctaatcatggctcatggggaagacctcgacctccaagctgcggaggccgcggcgccataccatgctctccagggcgatctgcgcgaacacgacgaggcgtctggccgtcgttgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23181 - DNA, 642 bp, Oryza sativa
aatcgtcgccgccactgccagccaccagccatcaacatcgaacgtgacgcatgggccctatcagtcagtcacccaccctcctagggtctcctcctttgtcaggcccatgaggctactacgcggtgcccctgttccccagcacagagctttgagtggcggcgacaaccaaaaaggactgaacgcgaagaagaatgatgccacacggagcttcccgtcgctatcaccatcgagctccttcgtgtcgtgcctgagggaggtaggcggcaactctttagaggatgagcggcggagacggcatcctgatctgccccagcaccttggcgacgaggagggggacggtggatggcggcacactgaagagtagggaggcggtgtgaacaagaggcggcggttggaagccccgagctctgtcggcctatgccacccaaatccgcaccgcttcgagctccattggccaactccacttcaatgttcaaaatagctggctatggcttttaccggctgggatctgtagaggctaagaaaggctatagcgggctatagcgccgctatcccatttaaccggtttgaaattgcctgacagaaatcaggcaagaattattgcatataaacatggaatcaggaaaaaatcatgaactaaca

SEQ ID NO: 23182 - DNA, 28263 bp, Oryza sativa
  unsure (1)..(28263): unsure at all n locations
attatcagtagtgcatggtgggaagggaagacacaaatcagtttggacttctgaagtctgaacctcattgccgtgtgctgaaacatggccaatacagatccctttggtccttggagagttgcacaaacaatattttccataagttaaaatgcaaaaacttgcccagttttagccgcagctgtagttcaccttattagagctgcttttgtttatttcttctatacaatactaataaataataatcttttgtacaacaaaacaataagcactactgcaaaatgcatcagaatggatgaatgatggcgagattggtttcgatatatctcagcaagtaacaatgaagccatgtgaagaccacacgagacaatgaaatgaccaaatggaggaacaatcatgtatagacagaataaaagggtaattattcattttgtagcttcaagatacgtagtgtcacactctcatttagaacacatcaagtatgaacagtagggaaaaccatatcacatcatatacacaaaattccatggcattgatgatgggaatactgctgcttccatggtaactgagaacatggaagcaatgagaaacatcacagtaaaaactatttgcagccacatctcagcctgatcatcaactctagcctgatgatgcattgcatttgcatctcagcaaactaaacatagcatacttttctttcaaaaaataaaaaaaatgtacaacgatcaacaaatgcagataatatatcttcatacatcggtctggcgaatgcacaccaagaacagaacagatcaagaaaaaacagcaggggctagcatgtaagatctatggaactagagtacatgtacagatcacccaagacaacattcccagatgtacgatgatgatgctgataaatcgcacactctgctaccgcaattcgcaatagctcaagttataacgtttcacacatatcatatcagtgaacaatatctatcacaatagctctggtattggcactattagcttctatttgctcagaattacattattttcctaatggcttcatagactaccaaatattttgcacaataattttactgggtatttacattttacaaaaaggtgctgtccatcgtttgtggcactcaaggcctctaaaacatatgtgcaaacattcaatattctcatgtaacactgcagtttaggcaacacgaaactagcagcaacccacatttcagcatatatgaagttggaaagaaaatagcttttgtgataattaattatctaacatttcatataattctgatgctcattaatcatcatcgttcattctcatatcagcattctaattattatagtactttattataaaaaagaaaattgctgaatcataacatcatttattacaaatggcaccactttctctgtaatctacaaatagaaaaaatagagaacatgcataccttataatgcaattagccttgacagagttaaattgccctagtagacaggatcaacattttgaatgcataacatgtgaaatattactgtattttttgaaggttcaggatgacaagatttatgcagatagcttgatatcttgcagcataatagagcagaatatgttcaaactatacaggtaattttctttatcccaaaaaagatcatcaaatcaaaaaataatagaatgtaattgcaatattttgactgctgtttactgtttgcacaaagttgattaaacaaagtgctgagtttgaaacataggacttagattactacccaataattgcctcctaaagaagtgcaaataataacacatggacttaaagggtaatcactaaatagcaaagatgacatcaatggtcccagagttccatctacgtataaggcagaactaaaggcatgttacattagacaagtggcaaaagacattcctcagcatttactctaaaaattcttgataccaagggacttcggaatagagtctgacagagatttgagcacatcaaatgaaattggcaagaaccttgctcacagtaaagatattattagaactggttaagtaatccagattaggtacagaacctttgcccacattcatcatgcatgcaaacatcagttcaataaaagaaaagacatgtatatataggctatataaactttgcatgcatacagaacacagcatgaaaaagataacgtttctacttcatgagatagcaactatattgtattctgtaaaacatccaggcattgcaatggagcattgtataacagaagacttaagcataatgagaaacgttgaacagattaactttcatgccacctaaattagagattgtcgcattacactgctacttgtaaagataatgacaaagatacatgcagatagccaccatacaggtcagcacccaggtcacagatgaggcatgtaaactactgcaaagggacaggacatgcctaaaacctacacctaaaaggattctgcagtttgtaatctagagtacatacagacaattactcagaccaaacagctgcagagcaacctacaaagccaacaaattttagaatttcattgtcttttaccttatggtaacaaacttgtttgttccatgcttcgcccagaaggtcttcaggtcaatcggattattaagattataaccttcaccagcaagcttctcaagtactttcttgaacgcaccatggctcatcttcctgcctgcgattcgtgcaccacggcgcttcgtactcattggcagtgggtacgttgagatggtggttgtgcagcacgcagattgccaaccacctgcaccccaccgatagcactgctgtggtgcgcccgtgcaagaacaaatgggcgttggtatccttgagaggtccaaatcaataccattaattaccatccctatattcttcctgggaccccttctccgtggtgctggtgcattgggtggtgcgccatcctcacgaggagcagcagacttcttgggcttcttagcccttggtaccttgggttggcggccctgctgccgcttcttgggaggtggtggctcatcaataacaggtacattttcctcgatcaatggcgaggaaatgcattcctcttttggctgctgaggcggtggtgggggttgcagttgaggctctgtttgctgctgcatcatctgcagggtatgcgtaccggggatcatcccatagcccactgggtcatgatgcgcaatgtgcgaagaaccatggccaacagtgagattgtgaagagccttgtgctcgcggggatgatgatgttgctgctgctgttgcgggtgcatccacatgtcactgcgcgcgaagttcatcggcattgaagggggagcctccgtggcaggaggaggaggcatagcaccaccattggcattgccattggcgccgcagtcacgcgggtgatggggctgatggtggtggtgcgggacatgctgctgatgctgatgatgcaggaaggggctaccagagagcagctgcttggtgtcacgctcagcaggcaccgacgacatgagctgcaggccgaggttcctcgccggcgactcgaagaatcccccccatcttatgctcatgctggcgtcgtcgtccatctcgccgccgccgcagccgcccaatcctacagaccaccggccggattcgaacaagagcggcgctgcacaggggcgtctccaacgtcggacatcccagaaaaaagaaatttctttagggaaacaaacaaacaagcaaagaaactgctattagtatcacattacgaacaaatcaagagaaaagctttccagatccagatctacaacggaagctacgtactatctagggttaacgcacagaaattcattcttgaaaaaaaaattcgaataaaaaaatgtgcgtaacgaggggcggatgctcaccaggacgcgatacaggaggaacggacggcggcggcggcggcgctggtctctgctcggcgggtggatgcagatcggcgccggagacggagggggaagaaatatcctccaagaagagaagaaggagaaggagaagaagaatgaatttttctttatttttcacttttttgttaatagaatagataaaggtgggagagatatatagttggaccgagccggactgtaggaggcccagcccggcccatccaagccacaccaccacactgttttgggatggaataagttcactgtaggtcctttatcttcagaaattattaaacatccatctttcaaaaccgggttaaataaggccctgtgtagttcccaaacaaaaatttttcaccctgtcacattgaatgtttcggcatatgcatggagtattaaatataaataaaaataataattacacaggttacgtgtaaattgcgagacgaatcttttaagcctaattacgccatgatttgacaacgtggtgctacagtaaacatttactaatgatggattaattaggcttaataaattcgtctcgcaatttttaggcggaatctgtaatttgttttgttattagtctatatttaatactttaaatgtgtgtccgtatcgccgatgtgacacgctaaaaattttcgttagtgaactaaacaggccctgaagtagtaagacaatatggatagctgatttgactgatgtggcatcctagtccgggaaactcccatcgaatgtcaggagaggagcaaggcaacgatgccttgtcggacggcgacaacaatttcaggatagtagctcctcgctattcctacccgcactccctgcgagctcgccgatgtcggccgccgtctaccaccctagcgacctcggcaaccgggtcgaaggccagcggatgcagcgcagggctcatggattgtgacatcttggcccaaggcttaatagaattaatagaatacttacatcaacaagttgcaacttattttccagaaaccgatatctaaagaactctgaggttaagcgtgcttggcctagtgtgcagaaaagacttgtgttggtctgtgaggacagtctacaacatatgaaagttgccaaatgtaagtgggcctggcctgggagaggcgggggctgttattattttaatttttctcattaacatgtaggtctcatgagcgtcatgaaggatgaaatctctatccaaagagactcgatttgctctagggcctagggagaggtgggggctgttattattttaatttttctcaccgacagtctcatgagcgtcatgaaggatgaaacctctatccaaagagactcgatttgctctggtttcgaaagttggggaggtgttatactcagtacttcctccgtttcaaaatgtagctacctagtactagatgtggcattacctagtgaactaaacaggcccacttcaaacggagcgaaacggtatggatcgttatttttttagggtttcaccttcatatatattcctgtaaaccgtcgttcggtgttgtaacctcacccgatatggtgaagatattcgctggctggcatccgtggtttttcctctcctactttgggagggtttttcacgtcaaatctcgtgtcttctgtgattgatctactattctttattatttatttgcctatcgtttcctaatagggtaaaggtaagaaatgaatggctaacatgtgaggttattattattttaatttttctcactgacacgtgggtctcttgagcgtcatgaaagatgaaactgctatccaaacaatcgagggactcgatttgctctggtttcgaaggttggggaggtgttatactcttgagggagacagatttaattaggagcaagagttgagggagatgaaaagatttattcctttgtatttctttacaaatttgtgaccgtcggatcgtaccaagacttgccgttaggtttgggtttttgacccgtttttgttccgagtctgttttatcctgccctcctcctccactcactctatgttatctgaaattttgtgataaaaaaaattatataatacattttgttctgtgataactaataatacaaggtgtttattgttccaaacattaactaattggattatatcaattgtacaaaactacaggtattatggtccaaattacacggaaccatatatattttagtgcgtatcagagaaccatagatattatggttcgaaaattccacagaactacaccattaaccattttgacatactcctgtatcaaaatagaaaacgtgggtgtaacatcgagaaatttcattatttaccatccaatatgctgactttcaagaatttaccattcaattcgtaggtctttaagattttgccaccagaaccatgaatttcttcatttcataccactccgccctcccgttcgcatcgtccgtctacacgaagccgtctcggaactaggtcgccgccgttgccacacccgagctcgtcggcgaccttccccaagcttcgcaaccaccatcgtcgatgttcccgctcgcctccgcttttccttctcctaccgccgccgtcgccgtcgctgtcgcgtcgtctgcgtttcatatttaggctccttccctgcatcacccctctcccacgctgccgcctccgccgcagccacagcccgaatcctctggtctcccagccatcgccgcctcgctcgccgatgtccacaccacccgctccacgaaccccacctaggcatagccactcacggcgctgctcccctccccgctctccgatgcccacctcgctgccgcagttccgagctcatcggtgaccgtccccaagcttcgctgccaccatcgtcgctgttcccgacctcgtctgctgctgaggtgcggccatgcccgagcttgcatatggttgccgccgccatcctctcagccgcagccgcagcgtgaagccatccccgaccacgccgctgtcgattggggggatgacaaatgaagatgaaatacgtgcgccatggcagcgagggagggcccagcgatggtggcggcggcgccctacgtcagtgtgaacagaaggagacggatgagttgtaaatttgacgggagtggtatgaaatgaagaaattcgtggttccggtggcaaaatcttaaaggcttacgaattgagtggtaaattcttaaaggtcagcgtattggatggtaaataatgaaatttctctgtaacatctatatgatagataatactcataaatttgagatatgattgtagatctcaaaagtgtggtaaatcaaattcaaaatgattagtaatgtggttttgcgaaactttataaccataatacctaatacctagaattatgtgccacgtgccaaactttacgcaattttgcaaaacttggaccataataggtagggttttataaaatttatttttttaagttgtttgacacatagactatccctaatatttcccttatactttttctttttttacttatgtattaaattaaaccaataaccaattacatcataatacatataatccatcgattctttgatcgattcaaacgtaggcgtttgtaaggaaaacgtgccatgatgactttggctgtgtttagatccaagggtgaaaatttttaccgtgtcacatcagatatacaaacacacatttgaagtattaaatatagtctaataacaaaacaacttaccacctgtaaactgtgagatgaatttattaagcctaatttagcaaatgtttactgtagcaccgcattgtcaaatcatggagcaattaggcttaaaagattcgtctcgcaatttacacgcaatttttttgtctatatttaataattcatgcatgtggccaaacattcgatgtgatagggtgaaaaaacttgttagatccgtccctttgagaaaatacattggctttgtttagattccaaaaatttttgacaaaaaacatcacatcaaatgtttggacacatacatagagcattaaatgtgaatgaaaaaaaaaccaattgcacagtttgcatgtaaattgcgagacgaatctcttgagactaattacgccatgatttgataatgtgatgctacagtaaacatttgctaatgacggattaattaggcttaataaattcgtctcgcaatttacaggcggaatctgtaatttgttttgttattagtatacgtttaatacttcaaatgtatgtctgtatgcttcaaaaactttaaaaaaaactaaacacacccattgtatgatatcaaccatgggaaacgggacggcttatggtatcgggctatgggcctaatagcatcactttgttagggacagattaatttagattaaattgaatacagtaaataaataaaaaaacagtaattcaaggtttacgtcgtttttcaccatcctaatatactaccttcttaatatataatagtccatattatagtacacccccatcctaagataatactatgaatatgtatccttatttttgatctggagggttaggtggttgtactcaaacacaccaaagccgtgttcaaagttccaaaagaaacagtccaaagtacaatggtctgagagaaaatggaaaatgaccttttaggattttgtatgatatgaaggggaaagaaaattgagagaagattgatgtttgttaacaagacattctaataatatacagcataatactatccatactactgcacaccagggtttacaaaactgtacgaaccgtacgattatcgcgcatttatccaggttatcacatgcgataaccttttcagtttttaaaccacgggatacctcgcggttaccgtagtaaccgtcaaaccgtagtgttaacccaaatggtttggtaaaccctgctacacactagtaagcgtgtacatgcaatgcacgtcattagtgtcagggttacggataaggtataccctctacccttggatatacgtcatatatcgatatggtatatctgcgcgtatacggacgttctttgtacacgttaaggaaattcatcacggagtccacagatggaaggaatcctactcagatagaactgggtcgtcactgtatcgtgtagggtccgatgtctccgagttctacttggagaccaactgacctacggtataaaagggactccctaggaggacataaggcatcgaatcttgtcgccaactcaaccaccacagccaagtcgccgggtgatctagtcgaaccaactcgactacggtctcgtcggtatcatcgagttctgctattccctttgtaatctgtggtttcatcatataatcccataccaactggattagagctattacctatcgaggggtctgaaccagtataatccctgttttctgtttgcttgatgtcgtactacgtagatctaagtacaagcgtaccctaataccctctatatccggtttacgggtatcccccgtcgacaattaggcaatataaattaactctaatatactacaacttcaagaatatactcattgcagaatatcatcagaagtaggagcacacattttcctttttaaaaaataacttttcatgtcaattgaattaaccaaatatcttttaacagatatgccatctttacatataaagtttgctttacaataagtctaattcaactgacattcagctcaaatgtccaaagaaaaatacaaatatgggatcaaaggtttacaccataccaatgcaaattcaattccatgctgacacacctattgttggacacataagaattgaataagatccaggcatacattatgcataagaatcttccttgttttcctcttccaccaacaattgatcattatcaatttcataaaagtggtctgaattcatcatgttttaaagtgttctagatttcatcatcatagtttctacaaataataatactatcatttaagttattatacataaacaaacaaaaagatcggagcataccaaactggttcttaccggttcatttcgacacacaaaaacgctcattttgacaaaagagagatgttcagaatgtattctggcaaatgcttgtatattgcaaggccagtgaacttatttaagaacaaatgttaatttagctcataaaagctgaaatgtaaagcattctagactattctgaagatgtaaagcccaatataaattaagcagggaccagtatatatcaatatatgtataccataccgaaatagcaaggcagtaattacctcagagatatccctcaatgtcaacaagattagatgcatactatttttcatttggatgtatacatataaaactaatcacatagtgcaacttaggaaaactgaatttcagtttggatcacattgtttctaagctttctgaaatggaattgacatactgtaagaaaattcacaagaatcaattcacactcagtttcaacaaaactgtggagattatgggtaccccatacccacacggcgtggttatccgactgatataggggataacttatatctatgaaatatgtaacggatcatgacttgggtattacgtttccttgtatattatggaacggcctaaaatcctggtttgataagattgtaaagtagatttatgaaaccgataccgtattggttaaggtttctatcttgtaatcctgccccccatcctatataaggtgggtagaaggccctctagggggcatgagacaactagatcgtcagatctatactacacccggtggattcaaatccccaaacaggagtagggtattacctctcatcgagagggcctgaatctgtctaaatcctttgtctccgcattcatccacttttaggtctcgtgcgctaccctcttttattattgccgaattcttgtttcgacagttggcgccccaggtacgtgttgcgtcgagtattccgtcgagaagtgcgatggaaccaatttttctggagatgtgatgagatcgatctcgatgagttcgacggtttcaattttctactcaggtttgctgttccgatcaaacttttatcagattaatttttcattactctatttgatctcttgatactttctggttctatatatgcaactatgagatcaaggcgaagcggtcggcgacctcgcacgtcgggccgccaatccgaacaccgtcatgttgtccaacagccgtccctgcacgcggagcagtgctgaacatcaagctgtcgtcggctacaggggcttatatacgctgcatcgcgcgtcgtcggctgtcactcatgattcagcctcattgcccgatccgagtttttcgtttcttatccatatatattatatttctaattgcagattgatctgttccagcattacttttttgacagtaccgtcgatgccaagcgatagcttattttttggcagtactcgtgcgtactccacctcggctatggaggctcaacggccacgtcatcaagtcgttacaagctgtacatgtatatatgtacaaatatatatatgcttgggctggcatacgaacacatggatctgcatctggagtacataatggcggttgtttatcaaatcgcctccgtcgttatcgaccggtgttctcgccttcatgattggttggtcacaccaccgttgatgggcgtctacatctttaccgatcggccgcctcatctgccgccgactgctgtctccgtctgcacggttggcctattatgctgccgttgatgggcgtctacgtcttcaccaccggcttgcctttgccgccgccgactggtgtcttcgcctatacagttggttggtcacaccactgttcatgggcgtccacgtcttcaccgaccggcttgccttcgccgccgccgactagtgtctccgccaatacggccggcctattatgccactgttgttgggcatctacgacttcaccgctggcctgccttcgccaccgctgactggtgtctttgcctatacagttggttggtcacaccaccgttcatgggcgtccacatcttcaccgaccggcttgccttcaccgccgccgactggtgtttctgccaacacggccggcctattatgctgccattgttgggcgtctacgacttcaccgccggcctgtcttcgtcgccgccgactggtgtcctcgcctatacggttggttggtcacaccaccgttcatgggcgtacacgtcttcaccgtcagcttgccttcgccgccgccgactggtgtcctcgcctatacggttggttggtcacaccatcgttgatgggcgtcttcgctttcaccgaccggcttgcttccgccgccgactggtgttttcgcctatacggttggcggactccgccgccgttgatgggcctcgtcatctacaccgacttgccttcgccactgctgcccggtgtcttcattgctattgatggatgactttgtttccacatcggtcacctctatcgtcaccgagggagatacaaaaaagctaagtcatcattacttttctttatatgatattttccttttcctctgcctcactacatcaactggttcgccgttgactagtgagtcaggggctacagatactatatcatattttttaacaatttttcataatatttatcttgattgcttgcaaaataatccgagtaacaataaagttcccatcgagttatggagttctatcttcctatgcttttcgtttggtttgtcgatggatagttgcctttgggccgattcctagcacccgggggctcgttggatggaccgagtaatgcaaggtgctaagtattactcggaataaatcataagcatagagatgagataaatttattttctgctcttaataattgtaaaagtacccaagtagtaaattctgatccatgaaactttgttccattaataacgaactcatgtcactcatatgcatgtttgggaagtgcctaggccgactcccggtgcttggtggctatgactagtcgggcagagtgtttaaacgtaacgagtcatctgctcggggaaatcaaaattgacgagaggagaaatacatatttataaacattttaaaatacttgaattttcatcgagtattatatttacatctatatgttcgttctgtacgatccagatccagatatgcataaaagggattcatggctttaagcttatctactacgctccaggaatggatcagtcagaacatcaccaccggcttgccgtcgtcgtcgccaactggtgtcctcgcctatatggttgggtggtcacactaccgttgttgggcgttgttgtcttcaccgatcggccgcctcgtccgccgccaactggtgtcttcgcctatacggttggttggtcacaccaccgttgttgggcgtctacgtcttcaccgatcggcttgccttcgccgccgccaactggtgtctccgcctgcacagctggcctattatgccgccgtttgttgggcgtctacgtcttcaccgacagacttgccttcaccgcagccgactggtgtctccgcctgcacggctggcctattatgccattgtttgttgggcgcctatgtcttcaccgaccggcttgccttcgccgttgctgactggtgtctccgcctgcacggctggcctattatgccgccgttgttgggcgtctatgtcttcaccgaccgaccgcctcatccgccaccgactggtgtcttcgcctatacggttggttggtcacaccgccgttgttgggcgtctacgtcttcaccgtcggctcgccttcgccgccgccgactggtgtctctgcctacatggctggcctattatgccgccgttgttgggcatctatgacttcaccgttggcccgtttcgccgccgccgactggtgttctcgcctataaggacggtggactccgcctccgttgatgggcgtcatcatcatcttcaacgcaagctgtctacgtctgctgccgactggtttcttcacttccacggctgcatgattatgccagtgttgattggccttatcatcttcaccgtcggttgtctcgtctgctgctgaccagagccatcgcctctacggctagtttataccactaccactactgatggatgtcatcatcttcattgctggccgccttgtctgacgccgactggcttgttcgtcatcattgactggcgtcatcgtcatcgttggtttgccttcgccgcagctcatggtgtcttaactttcacggctggcctattttgccgccactcaaggacgtcttccttttcatcattattctacttcttccgccgccgacttgttattatcttcacaactgcgcgtctttgctaccggtttgcttctgtcatcgactcatgttcacttcatcatggctgtgcaactttgtcaccatggtggagctacttcatcttcattgtcttcagcaccggcaaactctattgccgctacttcgcaagttttgctacttcaccagccatgacttctacaagagctttgacatctcggtatgcgtcgccaaatatgatgccatgttattataacaagtggtgttctagtaaagatttctacccggacatcctcaatacatatcttcactcaagtgatggctactcgacgacaataaactacagttctcgactctatgttcagttgctttccaactaaccaaagagtcgggggctacacagatacaagactctcaaaattcgacaagctgaagaaatcaattaatcagtcaacgagtcaactccaggagtcattatctttatctttgcttcggagcagacattctacttcagcaactccaattatttcaccagcaattttggtttctggaagctgccataatctactccaaatttttcaagtatcaagtttgagattctatctacatgttcgggagtttagagttatcaaccaatcagctcagtttcgatgagttggacaacaacatttactttccttcaagtgaagcatctacaacagctacaattccaagttctactgccatctttatagatcaagaagcgttgcatcagtcttctttatgcacacgctcgcatcaatgaaactactcgagctttgatatcttctcaacagtttgatggattgttgttattgacatcatcaccagcaaatctacttcatcggccctgatgtctccgccgttgctaagcggtgactacgtcctcgccgtcggttgcttttgtcatcaccgactttcatcgccgacttgttatttcgtcttcacggttggcctactacgcaactgccgatagaggatctcatcgttatcatcggctgctacaccgctattgactggatcaccgacatcgtcatcttcatcaatatcctgtcaagcctcttcaacatagcctattctactgctgtttgatgggcatcttcgtcatcatagtcgctcatctatgattgctgcttatcatcattactgtcggttgcatttgccgttgccaactattttcttcatcttcatgattggtggatttcgtcatcgcctttaatgcgtgtctacatcttcaccgtcggcttgctttcgtcaccaccgaccggtatcctcgccttcacggatggcttattatgtcaccactaatgggcatcttcatcttcttcatcagctgccttgtctatcaccgacttcatcacttttgattggtatcactatcttcactaccaccaatatttttgccacctcaggtgggcaatattatctctatattggtcgtcttgtctctatgccaactgcgtcggctaccatcaatggaccattctgactacgacagaaggacaagctatatgatcaggggcttactaactcaaacacaagtatcataccttcaatttgaactcgttctggatacatgcaacatgaattcatgatcatgggtctattttctatgctcaaagactggactatttattattccccgtaaggttcatcaaccgaatactcgcgccaatcgggattcaattattatatatattttggagtatcctataagggataatcactcagatcataagctattcatatgagctacacttggtctatatcacccggaagatttattactcaggagcatgttacatgcgtcatcctttgaagggtgtcgaaggcatattttttggcctaggctaatatatctgcagcccatattttcacgttcttttagggacttaggcactttttgcttaggccaaagtgcgcgtgatcaagtgcctaataccttaaaatccttttataccgcagttactcaactttttaggagttggtacaatgcatcttaaaaggtgtcaaacagtaaaactttatatagctgacccgctgacttttttatataggtcaaggtgctatttgggtttttaagcaattgattggatataatatcattgctttttgccatgtaagtgtgcatttttattgactaatattaaggcttaggctgattatatatcttggtcatttttcaagcggttggtaaatcctttatgagtttatttactcggattttacaccacatatatcgtatatttccgggtgtggtgaagccatgtgtcttttagggacttaagcacatctgttaaagcaatgtgcgcatggcgtatgcccaatactttggaaatttctttattcacaacatacaagcttctttatagctgttttgctatgtgaattttcaaagatgttgtcaactttaggttgcacgcatcatattctacaaagcagtcggtatatcacttggatcatattattcgggatttcacaccgcatatactatatattggtatcaagtcacttggttgactataattatcaaaaaccactcagttggttggattatttattccctgactatatgcttagtttattcaattaaccccatagtcgggagctacacctattaggtgcatctagtcgatgcacctaagtttacattcagttatttttcagccctccacagtcttcagatttggtaaaagtacttaggagaccatggcaaagatgattgaagcactcggctttggagtaatctggttcgagagaagattatcttttcgactgtgaaggtctcaggggctactgtggagattatgggtaccccatacccacacggcgtggttatccgactgatacaggggataacttatatctatgaaatatgtaacggatcatgacttgggtattacgtttccttgtatattatggaacggcttaaaatcctggtttgataagattgtaaagtagatttatgaaaccaataatgtattggttaaggtttatatcttgtaatcctgccccccatcctatataagatgggcagaaggccctctagggggcatgagacaactagatcgtcagatctatactacacccggtggattcaaatccccaaacaggagtagggtattacctctcatcgagaggacctgaacctgtctaaatcctttgtctccgcatccatccacttttaggtctcgtgcgctatccccttttattattgccgaattcttgttaataatgcccaattcttgtttcgacaattcagaagtaggcaacattcagatattgcacattcaatttttgtagaaggaaccatcagccaatttgtacaggtcccagtgttgctgttccagatgatcaaaggctcaaaagtcatggccatcacttctcaagaagggctactgcctacacagtgcagtttcagctgccaaacaatcttcagtctggtttgtgctcttgtaatgagctattgtgctggtgcctggtggtcatctcacctgcctgtaggaaaaaaactctctaaactgaagcaattaattgatcaagattgcctgcaagataattgagtaaaggattagattaggcatcatgctaaattattgaaatcgttgcattaatcatatacattttaagagattatttaaataggtgtataactgataattctcatgatcagatcctaatcactcgaaaaggtgcatcacatggactcagaagaattgcatctatttttagaaagaatattgtttgcagtgctcttaatctcaatatttcatttttaccatttgaattttgttcttgcaactggcgtctgtaggcagtagaatggtaaaaatgagaatgccatttgcgtaaatcaatgcgaacaaaccttttttccctcatgaatattgatctgagctaaagcttgcatcaaaaattagcttcgaagctggcaattggcacctctaaaaatgttttctcaactaaaagaacgacaaacataaaggagaaatggtgttgtactaaaaatattgcacaaagtaatgtttgtgaaatcgttgtcatgattaatgtttgtgatgaataattggctatgcaaatgatttaattagtgaattggtttggaaagatgtgtggatgttggtgtgagtgcgtgtgactaatgtgggtcaggttgtgatatctatgcccaggaacagttgttttgtctgattgtgtacaggtgacttgaggtcagccttggtcaatggtgatgtctgattgtgtgcaggtgatttgaggtcagccttggtcaatggtgaggatcgggactatgttcagggaggaacataggtctagtgcggtcaggataccatgtgaaaaggtgactagagtcaggattcttggaggtcaacttcggtcaacggtggggaccgggactaaactcagggagaagttgaggtccaaatggtcaaggataccgggtgacgaagttgaatacaagatggcacacggtggatggacaccgtgtgtgagagatcttcgcaacgggttttatgaggtgtgcgtgcaagcgtcggtgttcgcgaggaggaatgagaaaagatggagatgtacatgtacggtggagggcatggttgctacagtactcgatgtactgtagcgtgtagtttgcatgaacgtgatgtacatgtgtgcaggtagcatgcatgtatgcaggtccgtggcttggactgggaggagcagcagtggctcggttggatggcaggccgagtcggcccaggcggccaggagaccgagtgcgagctggcgaaggatcggtacggaggcgtccgatccggagcaggattttccatggctggtacggctgtggttttggagaaaaggaaattgaggaattgaatcctgttggaaatagaagctctacacctaatttgacacctactttgagtaggggatttttacggtataaatagagaggaagcgtgaggcttcctgtatagcttttcatagcaattgagtttctagtttagttagggtttcgagtttagtcgagatttttgtaaggagtgctgttggtgcactttgtaaacacagagagaagcaataaagttgtcatctactttgagagttcttcgatttgtgtttcttcgggttcaggcggcagggaggcgatctaaccggcggcgtgcgagcggtccgaccggcggcgacaggactacgtcgagatttccatcgatttgagggtaacttttatttccgctaaaagtttttgggtttttggttttccttaccattcacccccatctggtaggcttggttacttgtgttcgatcctgcaagtggtatcagagcctcgttttcttttttggattttaaccgatctaaagttttgccatagctaataagtttacaactaagccccatgttttcgatggaacggattttccttattggtgtagtaagatgcaatcttatattcaggctgaggatcttgatatttggaggaaagtttctaatccttatgtgattccggatcaaatcagtactgctgctttaaaaactgaatttgaacaaaattgcaaagctcgcaatattntattgagtgggatttctcgttcggatttttgcgcgtgcttcacattttcaaactgctcatgagatttggaacgctttgaaaaattttcatcaagaaacttcaaatattaaagaacttcgtcgtgatctttttaaaaaggagtacattaagtttgagatgaaacctggagaagctttggatgactatctttctagattcaacaaaattttgagtgatcttagatcggttgattctgcttatgacaaaaattactctcaatctgaagtttctcgtcactttttgaatggtcttgacatgtctatttgggagatgaaatttacatcaattcaggagtctgtcgatatgtctactttgattttggattcactttacacaaaactgaaaacacatgagatgaatattctttctcgtaaaattgattctaattctagtgctttggtttcttcctcgacttctttggatgttggtgcttcttcatcaaattctactgttcttgctttgattaatgccatgtccgatgagtaactcgaacagttcgaggaggacttggttttggttactaacaaactttctcgagctgtggctaatgttaggtacaggaaaagaggtggaccaaatcgttgttttgaatgtggttctacggatcactttcgttcacgatgtcctaagcttgggagaggcaagaaggaagatgatggtagagttttggagaatgaagttgacaagaagaagatcccgaaggagaagaagaagaattgcatgcagtggctaatccaagaattaataagaacttttgatgaatcggaggatgaagatgagagcaaaggtaagcaagttgttgatctagcttttattgctcgtaatgcaagttctgatgttgatgaatctgatagtaatagtgaagaaaaacttagttatgatcaattagaatatgctgctttcaaatttgctaaaaaacttcaaacatgttctaaatatgcttgatgagaaggatcacactattgagattctaaatgctgaattgatagattaaaatatttgattcctaatgatgatgactgcaaatcttgtaaagttttattttctgaaattaatgctttgcaagatgtctattctgttaattgcaagaaattggaatctgagattgaaaaatctaaaaagttggagtcttcttttgctcttggatttgctttgcatgatcgtgttcttgatgcgttgattttgacaaaaaacgttttgaaaaaagttttggaggcttggttacttgtgttcgatcctacaatgttttggagcatttagataaattttgtaccccattcatatgtgccttcatgaattccatcgaagaactgtaacccaattaggctgtttgaataaactcttttcacaaagaagacccctgacctgcactgttttgtattcaacgtggtgaacaaaacagtggaatcatagcaaagtgtagcgctaatttgatagactatctttgaaacaataaatattgctgtgtagaattaacattgaaatgtatatatcctataatgacagtgccacaatttatctctgatcatatgaaaaaaacatttagcataaaattgagaaaaagtgataacgcatatgaccctacaccaatcgtaaaatatatcatcttgtaagcaagatgggtgggcaaattcattaatactataatttttctcatgaaggaagattaatgtgcaacaatttttctccaatcctcacaacatttttttcccgaggtcagccatttataaaattaagcatgatctcttcgtattgtttttttgtcgactaaatttgttgatattatagagtaaaacaaaaatttaggtttacagaacaaatattagactagatttatgatcatgtttcttactatgagtggcaggagcggtccatggtcttctgagtttttcctgatgaccaaggatgatagcatcacgttgaagacgataggatcttatttattctttttccttggatagctcctgcacagcatacaatgagaatcatcattttgcaaacttaatcagagtaagaacagtaataccaaagtgatatttgcaatgcggatgaatctcaaagttcaattatcaatctatagttaaagcaacataataaaaatgtaataccaaagcctgtatcacatcacggagttcccaaccaaaggagaaatgggaattagaatacatgaagaagaaaagatagcgccaaaatcagaactgaaaagctaagataataaacatgctttactcattttaaatagctatggaagataagtactatcataaactgcactgcgcagtttcttttataaccataatttcagcacgtatctagttaaatagatcggacgagcatatgattaatcaacccatctagatataattaaaaaatcttggtccatgtatctggctcttcgattgtgcatgcagtctagctagatcaactcatttatagtacgagtcatctactgatatggcttttttttttgcccttttatggcaccaaccatggagtactgtatatggtagccgttgcagcatgctctgttgcaatcaatctgagaaaacagctcgttagtcttgagaaaacaaagcattgtcctattccaaacattggcacacaatcatgtaaaaataccaaaaatgatataaacatacctaacaaaatcaacagttcagtttttatttattcatcactctggcatctcgcaagagggcaaaggcacagaaagaaaaggcacgaccatccatccatacaaaccaaattgtccacaaaatacaatcaactttccgtatcacccaatcataaaatctagtcagctcccattattttatcgattttattggtctgatcttaaattaactccgagataacatgaaagatcgaaaggctaattctgacaagtgtgccccttaaacagtaaagtccatagcaaaatgatgcaactataggatacctagaccacgccaataaactggaggaaaaattaagttcccaaaaaatatcaagggccacaagaatagtctttcaaagagagtataaaacacaaatctctacagtgggctaaaggaagggttgaagtcattcaagtgcatattcaccaaggtactgtttgtacatataattgaaaccaagaaacaaccaaagtaagaaaataatctcagttacaacaataagtaagattttgatgtatcgagagctaggagtacttgaagatactttcctcacacagtgaacattaaacaaaatcgaaacccttccagtaaatcacacagtgaactcaccttcagtttaagaagcacaaaaggaacaccttccagtaaaaaatctgcagaggatgttgtgttctagaatcggaaccctcaattcaaggagttgtgcagcaatgagttactttcatctgggagcaaattaatcaagcatgacaaaaggtatatatatggttcatgtttgcaactccaccctctcttctttcctccatgatggtctccttcgaaaaaaaacctgccaaggagaaaaccaaccaaccaattttagccaaaaaaaagaaagaaaaaaaaaaggaaggaatagagcagagcactgacaccgttttatcttttcaatctctttagtttcaccttttgttgtcacagccagcactgtcttctaaccattgccaatagagccacaacacagcaatcactgaagtcattccaagaagggacagatacagggctatcaaatttcagtttcactccacaaaaagcagacaatatacatgtgaatcaagatataccgtggatgagtcgacgtgtggggatggcggatccgtgggtacaggctatcactaggggacaccgcactcctccatttggaacgccctcactctcacctcatgttcttcttccctgcagaggcgatggacagcaaaaaatagatgggtataaacgaagacaacaacctgagggaaagagggaccgacctaagaggtgacgcgcagcaagcggccaaaagctccactggatttgtaccgccatctaggtttggagcctgcaacgacagcgaggttgagcgaaggacagatcggtgatgaggggcaagctcgagagcctggcaacgtacggctctcctcttctcgctgcagccaccgccttccttgatgtcggttctgtcaccactgccgtttcttcgatggcagcggcaacggagggcggagcagcagccgtcagcgatggcgccgaaggacgcagtggcagcgctcggcgatggcagcggcagtggaggacggtgctgcggcagtgctcggcgacggcggaagcggcggagcgaggcagaggcgttcggcgatggggatggcgggaggcggaggtggtagcatgattgggaggcagagggggcactcggcggtgacgcgacggcggcgcgagggggaggtggaggcggcggcgctggtgacggggacagcgtgaggggaggcagaggcagcagtgggggagagggagtgggagtgggagcaggccatggcggctagggtttgggggtggttagggttagtgggtgtccttttgcgaaaaagccactcggcttccgcattttagagcgtagccctaatccgtgatttttctcttcttcacatgcaatatccatatttcctaagggaatccacgtaaaataacacctcagaggtactgtttgggaaggagctagatcgaattacgcacaaatcggaggactttttggcaaaattctaccgtgcgcgcactgtagcactccgacgtggcatcacccagcggccgcccctaccgcgctgctcaatgttttccgatatacagcttaataccatctactatacagatagaagtcatctctaggatcaaagcattaattgatgtaatctatttgaaatggctaactagacaatccgttgtatgggtttgtctaatattttatttagatatgatgtggaaaattatatagtcaacgtcagattaaacacgaggttaaaagactaattcattaatgtggatagaaaacgaggagggagtattactgattcgatggctaaagagaactagtgaaacccactctaaaattacagtacttattatagttcagaaaagaaaattgttgaataggagtaacatcgtttattcaaatggcaccactttccctgtaatctagaaactaaaaataaataaatatgcatactaatgtaattagccttgacaactacaaagctatggactggagttaaatccccctagtagataggatcaacaatttgaatgcataacatgtgacatttcagtttttttttcttttgcaacagttcaggattacaagatttatgcagacagcttaaaatcttgcagcataatgaggaagcacaatatgataaaactgtagacaggtaaatttccttatccccaaaaaaaaataacaaatcaaaaatcactagtatataattgaaatattttgactgttgtttactgattgaagtaggacttcgattacttgacaaggaatgcttacaaaagaagtgcagaaaataacacatggagtactatacaaaaggattcatcaatgaacatcaaggatttgtcttcaatggtcagagttccatcaatgtattttttagaacacgcaagagatctgcgtattattcattaagacagagaagttccatctatgtataagggggcaccaaaggcatgttacattagactagtggcagaagaaagtccccagcattcattctaaaaattcttgattccaagggactttggaaaagagactgggagatttgagcacattaaatgaaattggaaaaaacttgctaccattcacaacattaacgacacttggttaagcaatacagattgtgtactgaatttatgcccacatgcatcatgcatgcaaagatcagtacaataaaagaatggacaaattgtacatataggctatataaatttcacatgcgtacagaacacaacatgaaacatataacatctctacttcattagataccaactatattgtgctctgtaaaacatccaaacattgcagtgaaacattgtataacatatgatttaagcacaatgagaaacactcaaatgattaactttgccacctaaattagagactgtcgcattacattgctacttgtgaagacaatgataaagatacatgcagatagccaccatacaggtcagcacccaggtcacagatgaggcatgtaaactactgcaaaagggacaggacatggctaaaacctacacctaaaatgattctgcagtttgtcatctagagtacatacagacaattactgagaccaaacagcagcagaggaacctacaaagccaacaaatttagaatttattttagtctcttaccttatcttatggtaacaaacttgtttgttccatgcttcgcccagaaggtcttcaggtcaatcggattattaagattgtagccttcgctagcaagcttctcaaggactttcttgaacgcaccatggctcatcttcctacctgcgattcgtgcaccacggggcttcatactcattggcagtgggtatgttgagacggtggttgtgcaacacgcagattgccaaccaccagcaccccaccgatagcgctgttgcggtgcgcccgtgcaggaacaaatgcgcgtcggtatccttgagaggtccaaatcaataccattaatcaccatccctatattcttcctgggaccccttctccgcggtgctggcgcactgggtggtgcaccatcctcacatggagcagcaggcttcttgggcttcttaggccttagtaccttgggttgcctgccctgctgcctcttcttgggaggtggtggcttaactggcacattttcctccatcaatggcggggaaatgcattcctcttttgggtgtggaggtgatggtgggtgttgcagttgcggttgaggctctggttggtgctgcaacatccgcagagtatgcgtagcaggcatcatcccatagccaactgggtggtcatgatgcgcaatgtgtccaccatggccaacggacagagtgtgaagaacctagggctcgcggggatgatgatgatgttgttgttgcatgtgcatccacatgtcattgtgcacgaagttcatcggcatttgaagggggagcctccgtggcagcaggaggaggaggcatagcaccaccattgccattgccattggcattggcattggtgccgcagtcacgcgggtgatggggctgatggtggtggtgcgggacatactgctgatgctggtgatgatgcaggaagggggtagcagagagcagatgcttggtgtcacggtcggcgggcaccgacgacatgagctgcaggccgaggttcctcgccggcggctcatagaaggccccccaacccctcaggcccatgctgctcatgctggcgtcgtcgttcatctcgccgccgccgaatcctacaaatcaccagccgaattcgaacaagggccgcaatgcacaagtgcggatctaacgccgaacatccccccaaaacttttttattttttggaacaaagaatcaaacaaacaaaaagatgttattagtatcaagggttgaggaaaattaaggttccagatccggatgatccagatctagaagagaagaagcttacctagggttcattcgagaagggaaaagaaattaagaaaaaaaagagagaaagtgagaatgcgtgctcaccgagttgcggcggggaggagcaaagccgccgcccgccggtgatgtgcgattggcggagggaggaatggatgtagatcgggcggggggcggaggagaagtgggaggaagcctcgcataggggacgatgagacggggaaatatccgcaacgattttttcctccttttatttactttttcttgatatataataaaagctaggagggatgtataggtgggtcgggcccaacccagcttagccaagccaccacatgggcctaagcatgagcacggcctagcttacgcctgtctggcccacttatgtacgcactaccatgttgatgcctaaaacgagaaaaaaaacgataaagtagtattaataaaaaggaaaaattacaaattacccctgaactatcgcggtcaaccgaattaccccctgaacctaaatatcagacattgcttaccctaaacttttaatgtcggacgaattaccctcgtcaacactgttttgagcggttttgatttgaggttgcacacgtggcgccaacgtgtcattccagtcggcaaaaagaaaaacctccctagacccacccgtcatacctctctctcgcacgcgcgcgcagacggcggtggaggcagaggcggagctcgctgagcggccgaggaagagctcgcccgggcggccggtggcggaggcggaggccgaccgagcaccagcatggtcccgttcatgtggctacctcctcgcccgcagcggccaccaacgccacaacagcaagtgtcatccatgcaacaacgacaaagggggggaagggggatgggaggagatggaggcgggaatgaaggagaatggaagggagatcggagga

SEQ ID NO: 23183 - DNA, 4151 bp, Oryza sativa
acctccactcccccttccccatcccctcctccccacgagccgccgtgcatgtcgaccaccgccatgtgcgccgctgcccatcgcccgtcctcgcgctatgccatgcgtgccgccatgtgcgccgcggcccactgaccgaccaagagagagaaatagaggaagatgggtatgacatgtaggtcccaccattttaaaaaataaaattatgactggattgccacgcgtacgccacgtaggacaaaaccgctctggattagatcgagggggtaattcgtctgggattggaagtttaaagtgagcaatgtctggttttcgggttcaatggagtaattcattcgaccatgatagttcagtgggggtaattcgtactttttccaacgtccagtgaaccccaccctacaatacagtattcgcgtgacaaattcttaagctaaaaatcagtattttagtcttttatagatgaatggagtagctagggtcaatttttcgacatgggtgcgaagtgatagtagctcaattggttaggttctttttggtgaaacttgtccatccgggtttaagttatagacttcaatggtgcttgtatttacagctaggtgacgtacccattgacacttaacagcgagacacttgtgatgacttcgtctattcaaaaaatccagtatttggggtacgctcatagggatacgtgttcattgggttgagtcttgagtgtgagcgcttacgtttgtaaaaggcaaattttgctacaggacactttgacttcgtggttttagccgtgggacaccatccgaactcacttttgttccaatcgggtgggcccctgccgtgtgcgctgcgtccccctcgaggaggggactgacttcgccgccgccgtcgcacgcgagggctccggctgctacgtcctctccgtcctccgccgctcccgcggcggccactcccgcggcggccgctcccgccgtcctcaccatctcctccgccgcgatgagctcgaaccccgtgccgcttcgccaccataaccaccccggcttcgccaccgcttgcccagcgcttcctcgtcgcagcctcctccgtcgacacacctgccaccgccttccacctccctgccccctccactcccgccgagagagggctggacaatgatgaagacgacgggcagcatagcggcgttatggaatgaagatagagagagaagagaagagagataggagagttgacgtgtgggcctaaaggcatttttgacatttcacacgatttttctctcctcttaaaccggaaattatcattctaatcggcgcgatgtccatcggtaaattaccacgtttatggagtgtttcctccaaaattgagttcgggtggtgttgtacagctaaaaccacgaagtcgaagtgttccgtagcaaaatttgccttcgtaaaaatatcaacatgtctggcaatcgttgattttactccagccagatttgtatattaagttacaatcaatgtacaattatgataaaatctcccagataattccgttcacaatctatctaattaatgcgtgggcgtttcgatatgatccaaagatatctcacatctatttcgtctataaatgcaaaattaattgtaatatactatatatattcgtcggccaccaacaaagttatctccaagaataatctgctgttgtgcgagaaggagtaatggatccagcatcacgctccctctccattattttcttcttagtcgcagtgacatttgtggtaatgtatttttttcctttacaaaataatttattttatttgtcttctaacaaccgctgttaccaaaccattaaacttcagacaatattgtttagtttgtttatttggtgttccaaaacaatatggtttctgtttattttcatcacaaaggatgccctcgttttgttcttcaggttgaggtgtctgggcagaagaatgaagcagtataccatttggtaaatttcatatcacactagtattattcttttgttcgaacactaggaaatagcggtacaaacagaatccttcatttgtttgcattcaatttttctcctcctttccacttgattgattatgaactttgtgttgcagtttggtggtgaaggctcgctcaccaaaaatggtaatgattatatccgctaccctccaaactaaatctggtcttttcttattaaaaacacaacaattagttaaaagtaggggcgcacgatgaaacatggtcaaatcacctataatatctatgagtagcatatgtataggctcgaattataaatctaacacgagtcaagtgaatacttcctccttgcatccaaaagtcttatgcgtttcttttgtaaccaagaccaaaaaaaaaaattatctcaaatgtaaaaaaaactaagaaaccaatgtatacatgtagctaatgagtacttatttagatggttgttcgggctccgattaataatttaatctagcacagtaaaacaaaaggacaccatctttcttttggtcttggatgtacaaatattataatctcatttggaaaattagaaaataaaatatgtacaagactttgaaatatgttagctaaaaaatgtttctgtcgttttgaaatgccttaacacgtgtaattttcttgtgtgttcaagaaatctttcttttttaacaaaatgtcaagaagtaactacccctaattagatttacattgtgtttctctttgtgctatgtgtagagtgcccagggaaatgcagctaccgttgctcggccacatctcacacgacggtgtgcatgacatactgcaactactgctgcgagaggtgcctgtgtgttccatccggtacatacgggaacaaggaagaatgcccttgctacaacaacatgaaaacccaggaaggcaaaccaaagtgcccctgaaatcaactatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattat

SEQ ID NO: 23184 - DNA, 27733 bp, Oryza sativa
  unsure (1)..(27733): unsure at all n locations
tttttctttaaaaaaaaacctcccaaaatgtaacaacttttggcagtgtccagattcatatctaaatatgcttatattttaggatgaagggagtaactatcttaatagcaagtgacgcatttgttttgttccataaatcatgcatcatcatcatctacaggcaacatcagaaggttgaattattttctaaaaccaatatctcaacacgaattgccaaaatgttgatgatccagaaatctctatttcctacggcggatattcttccacattcagccatggtaaagcgggattacattatgttgcatcccaatgcaacagacatgtcaagaggaacctaaaactagttaacaaaagatacttcaatattggaattccatacgaaataactgtagttcatgtgctcgaattacaaaacctttctgaacagagtactgaagcaaaagatgaatccaaaacaagttctagcgtctcatacaatacaaaagcagggaagtgcaaaaacatcttaactcccaaaccacaaaaggaacaacagacagtaacaccggtattacatatccagccttgcaaagcggcagagctcaagcgccaggcaacaagtaaacatgcttctgcctcttttggcaacaatgacgagcacctagaacaaccgttcaagcagctgaaatggtgcaaggatttgacagagatcatcattaacattattaggggaataattacagtactagtaaagaaaactgtgatgccaacaaaaacttactgcagcaatcaaatttcagttattgtgctcatcagcagcttggtgatactggtagtcaccttcatcatatgcctcgccctcttcagggccttcaggttctgtgttgttaggttgcatctgatagtactcatgctcatgtcgctttgagcgctccgtctcataagcatcatggcttttgtgttgctcatagttatagccatattcctgatcatgttttggctcaccgttggcaaattcagcatctctctcaatgcatgtgaccacggtcccgttcatgattgcacgctcgtaatctctctcacggtccctgcctctctcacgatggcgatcatgaccacggtcacggtctttttcataatccggaccacgatccctgtccctatctctatcacgacgatcacgctcacggtcacggtcacgaccatgatctctctcccggtcccttcctcgttccctgtcccgagtcctgtcccgatccctatggtggtgtctatcttcttttgaatcacgctcgcgagtacggtcatgggatcgttcacgagttctctcatcacgatctctttcccgtggcctttcacgagacttctcgcggtccctgcatcaaatcatgagtaataagcaccacaattagatgttaatgcaggaattccatttatttgataagatatacctatctgcacgacgctcatctctcctaggctcctccgatcttgggcgtccagcgtgctgctgatccctgaacataaaaaaaaacatgcatgtgttcagcatcaattacatggatacttaaatatatgaggaacaatagctatacccaaataagcacccaaaatcttcactgcactaaaaaaatatgcacctattggagtcaatgtccttacataacaatatcaaacttcaatataccgaaaaggtataaaatcacctctgataatattagtaatgaagctcaacatacagtaaggggcaaaaagagaaaaatggtatcaaaggaacatatccaagagcgcataaagcatttatgatcagctaatctttagtgctcacatcacttcttgttgccttagatcatacaaaagtatttgcttccttcatacaataaaatggaaaaataataaatatacctagtggagagcttctgttcagcattttcaccaccaattctgcttgatccaagtccaccacccaatctcctgggacgccaatttggaacagttctaccacgctccacatcaactagcaccctcctattgtccacttttctcccatctgcttgcttgtaagcatctgcgagaacacatattagcagagaaaatgtaagacagcacttcatcagtgatgacgccaaattggactgtatagaggagatatgctaaaccagaagctttacttttcatgtcccgggtgtgcatatactcgatgaatgcatatcctctaggtttatttgtttccttgtcggtcacaagccgtacctgcaaaaagctcaaatgtacccattaaggtctttccaaaaagaaatatgcactgaacttaagaatgttgccggttgtcattacaattgtttgtttgttttagcatatattctatgctgcacgacagacaggcataaagcctaaaacaaccgtactaaccttggaaaagtagatccttcattacgaaaactaaaatccagcgcatatcaacacacgtggaaacaaagaccagtctaactaattaccattggtaagaaatacagtgatacccccttaccagggaatttactagattaagaaaagaagatggtggtggactaaatacaatacccatttaccctctccattgcatatagttcgttcagccttcgtcggtaagaccatcaaaatagacaacggttacataaatggaggtgacaaatagcaagtcagtgatgtctattccttacgctgttacgcatcagaaaatggagccatcttcaactctaaaagttgagatgtcatttgcattatattttgctgttgtttcctccaagagaagcagcacttgaaagcagaactagctttaacagctcagggaaagtaacataaacactgtactcaccagcaacctaataaatcccagaatgtagaaaccccatgcctgcagataagctgcttttaaaagcataaagtgatctaagcttacttgtgccatcgccaacattcttcaagcttgtttgctccagttaatacacacgagaagcaagttcatagaatgggaaaacaaatgatacattgtgcctactgcagaagcaaatggtttgatcttttccgagagtaaaagggaaaagatgttctaagaaaaaaaaacatcaaggctgcatgcagtaaaaatacctgcttgtgtgtatttgtatttcccaggattttttagtcttctaatggttgtaccaaccattcgcacattaaattgctcaacagtaactcagataatatgtctaacaaaaattaccagaagacataatttctgctggagctctatattacttatccactaagtacatcaacagagcccacatgtttagaaatggataacaaagaaaagactgtccgaaccacccaaaccaatacatgtcaatacaagataaaagtgttatttaaataatttgagaagattatttggttattttctccttggtttagcaaaatgcaaccaacatcattattgagaagcaaacagcaaatgcatgcttacacacaaaacagtgaatgtattgcccaacttgaaaatgagagtgctatgaatactgtttgacaaaaacaagaagttatttttgtttgctgcaaaaaaaaagacttgacagaataacttatttttgttctttacaaaaaagaagacttcacagcattttgtttgatttagaaacaaatactacagacaattctgcccattgaaaatcggagagagatagaagatatccctttcatcctttagcaccttgttgtgaaattccaagtaagcaatatataatggcagtgaaccagctttttcttaaaacatgtttttgtagatgaattagaacaaccaaacaccttaccaaagaggaataagtccacctgcactggaatttaccacatgtacttacccttttaataggcccataagcttcaaactcccgctggaccctatgctcagacgtctcatagttctgtaaacgtttgctggagtcaattggaagtaacatacaaaaataataccaactatgtagttcaaaataatttgtgagtgatgcaacaaaaaaacttacaagtcttgcaacaaagagtgttttgtatggatctccagtggcattggggtcactctgtgggtcatctacattaagaaaccacaccaatgatgttatcagtatctatcatatgatacaaagggaagagcagctaagaaagaacttacatttctgaagctcttcagccaccttagccgcaccttggtcaagcttacttttgcggatcctatccttcttttcagcctgcgtaaataaaacataatcaccaagtcatgacctggaatgatgaaatgacaataggcacgaataatacagtagatctagaaacaataacagacatggaaaaaaaaagagtaaagccagtagtgccaacaaaaagctgcgtatttgacatagtcacatacaattaccagaagaagaattttggcaaacaaatgtttggacagctacacatgtcttattttgagagagttttcatgtggtgaaagtggaaatattcatctcagaggtgggaacatttgactccaactcttacctcgcaatttcaggtagaacttattggacctaattttcctgtgctgactatagtggaacaatgctcaaacagtcaaattgtgagtgactttccagcaggtgtagtcatagaagctcacatactaatactaacagtcttaagaaatcctgattgttcagagaccagcaagcgttctgacaccattacaaataattgattttgtcgattgaaaaaagcaactatatggttgtggaaactatgcaatatggttatggccacacgaaaagtataccattggcataaatacgacatggtcacgacaacataagaagtaggaacatcttgcactacggagacataaaacaaaatgcaacactaacgattgcgcttcaaacgagttaaaattgatacagaaaacaaatttgcagcagtatcagtataccttggtctcgcatgtggggacgggtggcgcgtactcagggtcaccgggctccgcaaactgcgacacgaactgcgccatccctgcaaccaaccaatcaacaacaagagtgagtccatccatcaggaagcaactcatccacaaaataaatctaacagacaaaattaaaagaaaaaaatatattcataatccccctagaaccgaacagatagaatagaagatgaggcgggtgagggaatataccagtgtaggccggcaacttgcgcttctcgacgggcggcttgaagtcgagcggcgggcggggctcgaagagcttgagcaggttgggggtgaggcccgtcgggtgtccctgccccatctgtggtcgcgagccatggagagagatctcagatcgaggcggatccggagaggagctagggttatagcagctagggtttagggggggggtgggggcttaccagcttgagctgctgcacgttgacgcgctggcccttggtgcgggactgcatcccgccgccgtccgggttcccccgcatcatcccgctgccgtagtcgcccatggccgcggcgccggcggtggcggcggcggcgcgaggagagagagagagagagaagcgagagggatttgcgattcgcgaagcgttgggggatctctctttctctctctcgggatattaggggaggagagagagaagtaaaaagagggggaagccgagacggaagaattttatgtggggcccacacgtcagcgccctctcgcacgggcccatgcgtcggtgacttagtgtatgcttttgctgcctgagcgttgcagggatctttgctgccgctattgaatcacgggggctataatcgtgtgtcacattttttataaatagtaaaatgcccgtgctaacgctacggcgatatttgatgatgcaaatcccttctctactattataaaaattgaagatgttttcgttagaattttggtacatcatctgtattggaataggttttaattttatgtttctattaaatcatacgcgtacgaagtaattaggcatgcacctttttacgtgccccttgccgcttgcagacctgcgcctgagttcattttccacatacgcctctgtgctcctctgcgattgggcccgcaacaccctcacgcgtgatttttcgcatgcctgattgggcccgtgacgtcctcttaaatctaccctattagcatataagcactttaagggaaaaaaaacgagattcccacttgatttaatctttggtaaaaaaaatacaaattcctacttgatttgatcttatcaggcctttatttacctgcatgatatcatcaggcttccatttacctatatcttcttcaagtttattggacaacctgattgcaattaaacggcatatattttagttgtggtaattaagaattaacatttagttaccaaacgtccatcattgatattatttggatgcaaatcgacgcacatacctcatgagcacatgggaatgaggatatgaagaggagcgctgctatagacctagggatgaaatgctccaataacaaatggtataagcacagcagagccataatatatagaactggccatcgttccattttactgcctaacgataggttgaaggctagcaagccaaggaaggctatatacctctcagttctgacaactaccttttcatgaactcgtgggcttttttaagctaaacctcagaagacaatagggaaagcctgtttttcatctaagaataaaagacttggcctattattttagaaaaattggaccaaaaaactcacaaacacttgcccatgaacctgtcggctaaatattgtagtgtaaacttatctgctgcaagcagctttggagtaaatctaccctatcctaaacctttcttacatgcatattgttagtttgtaccaagcacaagaaaataaatcactcactttaaaaccatctcaaaattacatatatgcccactttcatccattaaaggcatagctgcaacttataaatctgaactgtacatatatgtgtcaaccatgagtttacaatcgaaaggggaaagaatggaaaaacagttagaagagattatgccccagccttgcttccattggctctgcactgatcgaataatcgcatcctaccttgccattctgcactgatttctcttgacaactgcacttcatttagcaaaaccatgaaatggagcatgttcctgtcagcctgctaaatagaaacaaccagcttcttttgttaatgagtggcttccaagcttaacttgttttgctaaacttttgaagcaaatcatgctagcttatggtacaccacaaattgatataccagatcagtgatgatcaataatgctatttgctttttaaacagataaatatgaccataagtaacagagaaatgcagttgttttatatttcttttttccccacaaatttgttgcttggtaatcactattaattggaagcaccgtataactcaaaagcagaggtcatctctcttgaagcagctcctcttaatggcgaaaaactatgtcaagagaaatgagtacagatcagtggtgctgcatttgaattcctctgcaatggcaatagtccagaaaaaacatcaatttcaaagatatttaaagaaatcgagggcaacattagtctgcattgggttggtaagatccgtccgctagattggttctggaagcaagcaatgatgctctgttagcaactgtactttggaacgttgggtcatgcatttatggaaaatgggagatagaaaagagggaatgacaagcaaaatgcaaaaataaccatatgtttgaaataccagctattcttgtacaggaataaatttatatgctagtaaggaaacaataatctcagctctcacatcaccaaacaacattgaagcgatgaactctgacagtctgccattcatgtgatcgtgtaaatcagttagcgtaccgcttaaattaattatattaaagatagggtaattcaaaagcacattcctgtaaaatcactggatattttaatcaagtagctaaaatgcataacacaataatatgtacccatcggcaaatgaaaatacatgcctgtttgaatggtcaggagcagtggaggacaattgtcatcatctccaacaatggtgttttcttgagcagaagattagcctgttccaatctattgtgataccatgaaaaacaagggaatacaaatcattcaggattaaacaaagattgctaattacttcagaaataaattcagcaagcagaccatcagtggattaatgctgggttagctgtttatgaacaaccaagtatcacatgtcctattttgacccctaaagctctaataaacttttccttttgtccccagactatcatgaatgcatcgaacaatatgttagcatttcaggcagcaaaccaaaaattagttgtctctaacacattggcgtaatacattccaaccatcgataacaaaattgcttgatgacaaaacttgatttgattagcctggataatgctagcttcctgcaatataacaaaacttgatttgattagcttgcagtatcattttcaagtgacattggaaaccaagtcctgagccatctacttaagaggatagaaattgttctctccatcaataaacaataaacatgaattaaaaccttttagaacttccattaaaaagctttcaaagaatggttttttgttaaaatgcatataatggtatttatatcatcatccattagccacaatgtctgttaaatactatatattatgcacttatgtacattcctgatcaatggaagagcgtgcgggtctgtccagttcatactaagccaagatcaatggtgaaaaaattgacgtgatcctgaaatgatattttgaaagatcaatattacgaagagaagaggtatctgatgacttcataccatgtgactgagcctcatatggctgttggatgcaaagcaccaaacacttctttcccaatagtaaataaccaatccgtatgtgaggacagacatttttatgggataaatcaaatttcacaaaagaacaatatattccatttcataatttagaaagcacaagaatatatatacttaaaaagcacatgtgaatccttcgtcatggctctgcaattgcagtatttagacacgataaaatttcttacagttcaaaaagctcaagtttgccaagttcagctggaactcaaactttgcacaggcacaactcttttcatgattgttacagggaggagggttgtcacttgtcagttgatgacaggaggtcaggattagttggtttggaggtgacaagctaatggtcgcatttgttttagcacatctacatctttgagtttctattgaaaattagatttgtgatggtgatgacaaattcaatttccttttgagattccttcagtgcttccactattcattcataaaaaaacattaaagattggcatgtggtaatccatggcaaatgattacaaagctacagaacacatcaaccatgaaactcaaaagtacctgcagacctagtcaataacctccatgcagacctagtcaataacctccatcaatttcttgttcgaagaaaagtagctgtagagaaatatttagcgaatgagagaattataaataatatcccaaaattcaaaagagatgcagaagataaaagcttcaattccagagcaaccgaaggaagaattaacctcataccttaaatttactttgtgcggctgaggttactctgattacaatgcctgaccgagcttgttcttcgcttatagttacaccataaaaaagagcacattgcttgtcaacctataaatagaaaaatatatgtggtagccatcccattataaacaagataataaaactggtagtggcagaacctttcctcttgctgatgatccaacagggagcggtctcgctgtaactgttccactcatagcttcttcaagaacattcaagacaaaaggagaactggaaggataaaaactgacctttcttgtttaactcgagcgaaatatttttgttaacctgaaccattgctgaaagaatagaacagaaaggagagaactgaatcctttctaattcttcattataccaagctgtcacagaacggctaccggggcgtatcggccaccacggaggtggaccggtcggcagctaccgacggtggccgccgcttcggaggggtgggggtgtcgtcaagcacgatggttgacgccgcgagctgccaccgcttcgggtctggagggggaggcgtgggagggaggtgcggtttccgcgtcctcggtggcggcggggctaggcggtgcggatgcggcggtgcagaccaatgtgatgggaggaggggcggcgaaaggcgaggcggatggccaggagcgatagaaagaggagggagggcgcggtgattttgccggagggaggggaggcgatccgatctggatcggatcgggagggaggtggagagccgttggatcaacgtcgtcagatgatttccgatcattggatatgtcacatgatgaatgagtaaaaactatttgttgaacaatagggtagactagtaaacgtattataatcgtgcattgcacgtctttaactaaaaaaattaaggctaacatactacaagtgcaatcatatactccttttgaaaacctaattcattgggtaatatcaataaaagctagagcacatttttttgtttaaaaagatcatatttccgagtcacctacataatacgcagcaattaataaaatgctcctttcttttaacatatatgctggaattacatgtaatgacatgttcggaaagtaatttgggagatgtattttggaacaaaacatatgcatattgttttctatttggatgtgtacagaaaactcatcatatagtgcaactgaggtgaattgaatttcagtttggatcatattgttcctaaacttcctaaaatgggattgacatactgtcaaaaaatcgcaataattgattcacgttcagtttcagcaaaacaatacacataaaaaggtaatattcaggtattgctcattcaatttcagcataaggaacaaccaggaaatattcaatctcgaccatgtactggtcaaaggtaatttacccattaccagaagattaatagcagtgtactatactaaactttggaaggcttaccagtatagattaaactaaagaaaaatggtatcttttatcaggaccaacatctacagttcaacacacatcgaatatgatctaaatatggccatttgcacaaataccagaaaatatgatatgcaacatcgatctataaattgtatatttgattcaactgcgcatcttctgtacaatggcaaatagctatatagatgacctaaaattggttaaaagttattttacttgcgtctattcatctattgagatagtgaatgactgagaaacataacatggtcattgatgttagctctgaatctatatgtgtagctaatatttatccttcccaactgatgattaattctgaattaatcagtacgtatttgtcttcctaacaaatgacataccatttattgctgtcacgaaaatagataattgcagtcaccttaggaatgtaaaatataaatgtttctactctgcctagagcagcttatattagcccacaaacatgcttgatgcccatatgactatatatataagtacgtgatgccagctaattaccaaaaaataccagatgcaggcagtagagaaaaaccataaatgtttctactctgactgaaatgctttataaaaaataattattggactacttaactcaatgaagagtctgttaccatgcttacggactgaaagctcagttaaccccaagcacattcagtacaggagacaagctcaactaaccatttcctctaacataaactgaaaaagcatataaacaaatcagtttttcctagagaaaaagatggcaactattgctacttttttttatccaactacaaaatacaaatgtacatgtcgatagattgccgtgagatcggtggagataaaagccacaagaaagcatgattgctgctctgatttgtcacttgaggcctgaaagataagagaaaacaagtcctcgtcatgagggaaataaaaaacctccaagtacctgacatgcacatcaagagcaaccagactgtggcctgaatgcattaagcccgtgctcgcatcgagttcgattaaaagatggaaaataagagttcaaagttgaagcctgagaccaacctcatgtgtagagaccactgtgctggtggagacgaaaactcgacgcggattgaggctgccggcgccagcgatggtgtttggcggtggggatggccaattcggcttggaccactgctgctttggaggagacagcggcagccgcgtcggtcaacatggacacggaggtgattactcaggtgtggagggatgcagattgtagcacacgcagaccattgccgcgagagagactggggcaagccagcagattatattagtatttttatattagtatagataatatatagtaaactgttgaaataaccataactgtctgttaataatattcaaagcttaacagtagttaaatgaaaatgtatacaaagaaatatcatcaaacggctcatattattcacatcatttgctgagatgaaatgcagtaaaaaaatctcacaaaattggaaagaggatacatgactaacacaaaaatctggttacagtttcacgttcgcttaccttatgaactcctccgtaaatgatgaaacaatggaggacttaaccacttacttttgttgttactatcatccatcttgagcatctaattttaatgctatcaataggggagaacatcttctggagcgggccttgtgtactccaagtctatttctccgatatgcattccctcttctgtaagtgctagacttgaacgtgttaataaatcactatacctatatgcgtagctcatttgatcatccattgttggcaggatgaattacatggaagccgaagcgatgagaaagcctgtcggctacctaaactcgtgcaggataagtcagccgaaccacacatacacgctagatgagaggaagctaccggaacacatcaaggcgatgactcccgaagagaggacaacttacatagggcaaaggcatcaggaaaaactgctcgatgtcactacttacgtagctatagcgcttcaatctacgcaggacaaggagtgcgtttatgccccatatgcctttgagtaagttttaatatccactaagagtatatgcatataatcacggctcgactaacaattttgtttgcagcgaccattggatactctttcttctctatctaaagtacaatgaagtcatcgtcttggattctttgacgaagacagcaagacatatcaggaatttctaagaactatcgacctgcaagttatatattatcatgacgtgttttaatctttgaggaatgtaaattaattatatctgcaaacagtgcatttaaaaggtattaccagcaaggcggacaacgcaaaaaatcaagagaacgcatattcgtccgcaataagtggccggtaagtccatatgaatgccaaacagtactactaaaatttcataaatgcatgtgtctatccatttaataacccttaatataccttacaatcaattgatcttgaaagtgtcacaagcaaccggtgggaacccgtactatgcggatattacaccagcgagttcctaaggggtaatgggaaatattgcgcgaattacaacgaggtaagtaatacacacttgttaaatgaatcgctaacttgtattattgcgaataatttccttaatttttcgtgatttgatgcagcttccaaaattccccaagtctgaaagaggtaatcttagagcagtacctatcctaatttttaattcggtttgtctaggttaatctccgatgttaaccaagaaggtatggagcatgcgactaagtctcctgtcttgccgtaattgagaatttagattaaagtcaagaaattttgtctcgacgggtacaccatcgcttcattccataatccttgtctaactccaccaaccgttctcggataatcgataaggtgcaaagtctgcgacaaagccctgaaatctgacttgactgttctgatgtctgactttcctgaaatcagtagtcagaacatttgtcgtactcgcttagtcgttcccggtgtagaatcgtagagacatggagtcctcgataacgctgaatggaactttcctgaaatcaatactcataacagaatattaaatagaaatagcccctgagcaaacgctcaagggtaacatgctataatatgtatggaaaaattaaaaataagttgaatttgcgtgtgacaataaaagagtatactctctagagtcccttagcaaacggagttcggtactcctcctagcccctagctgtttttatggaaaaagccattttccacaaaggcagtttaaatcttataacaaaccagcccccagccgtgaagttgagaaaaccaattcccgattacacggcttagttaatatgcatccagtgagcactctaacatgaccagatctgacatggtcgtttggctttgcagtatctaacaaagccttatcagctctgggcgttcctagccgaaatccccttaggtttttcggaggctttgttagaatagtgtaaagggacgataggacagacttcaagacgaggcaatacaagaaaaggagatcaacggacaaatattgcacatataaacacttacagaaattggcgtagatgatgagatgaccaccacattgggcaaagaccaggtgtatagttgtactcaacaaatcgctgagttagtaggagaatcgctacaccactagtcgaagaccaattatagtcataactcgaccactggagtttaaggtgcgagagatcgctacggcctaatggttgacaaccaggagtaggcgtctctcaaccatttgaagtcgaggtacgagaagatcgctactacctattggttgagaaccaagattaggtatctctcaaccttttgaagtcaaggtacgagagatcgctacgacctactggttgagaactaggagtaggtatctcttgatcgtttgaagtcgaggcacgagagatcgctacgacctattggttgagaaccaggagtaggtatctctcgaccatttgaagtcaaggtacgagagatcgctacgacctactggtttgacaaccaggagtaggcatctcttgatcacctgaaggcaactgataggcggcgagatgtcgctacaactgtctagtcgataaccaggagtaggcatctctcaatcacctatagggatgctagagttggttattacatgtgcatctcatgtggccagcatgactcacatacccaacttatagcatatctgaatgtctgttcgtaatcatgccgggtgatcaagccgacaacatttacgaggaattatccgttaacaacctattcccaaatagtccagccatagccggtgctatatatgagataaatcgtcggtcttcgttggtaggtttggtgcaacaactcagcctttaccgagaacgttctcgataatggggtgtactcaaccacaacctactcgagtgctcaattgttcctgaaaaatattgtctagaaggcaagatatgtagcatagaatattgaatatgtactcaaaaaaaactgcatgaatcttcttgtattatcaggatatgacgagcagattaaatatcaggcattatgtaaaccgtaaacaagcatgatttatataacaggaacagagcgagcccccaatattagaccgtagtcggcctaacatcagaaacactcgtacaatagatattgtataaaaacatgctctaggtaaacataataaatcatggatttgactatattgtattgatctgaagaataggtacaataaatcacatatggaatattgcgtacctttatagatacatatcggatatatctacgaaatgagtagcttaattttaaaaaaccaatctagcaattaccttgttgcgtactcgtttgacatcatataatccgacatctgttggtacaccgcgtatcttgtggcttggatgatctcaatggatcaaaatgttgacgacgatggttccgatcttgtcagggcatgtactctggttgggtcaaatctcccaggtccaaagtagtagaagtatccttcatcgaaaaatccgcagcgacattgcctcgatgaagcttgagatgacgagggtcctgatccgccggaaaacgcacttcgttcgggtctatcaccccacagccgaagtcgtcaagtagtttgttgttggggaatatatctcttgaacccatcccatcgaaaaccttgaagcaccaaaatcccctacctggcacgccactgtcgatgtttgaggtcacgactagattatttgcatggtatggggatcattggtaccagggtatatacgagattgagttaaaagagatggagaaggattttatacaggttcggacccctttttataggtaatagcattacttctgttgggcgaagccggtgttcctctatactcatcaaaatcacacaagtacaatatttgggataacgtatctagtcgtcgttgacttggtggcatagataaccaacacgtagtcgacgacaggatagtctgcctcctcgaatataaactcgtcgacatcaaagatagcgctagatccctcttatcagcctctgcaggcaccatattgggtttgtctaggctaatctctgatatcgatgtctggcggcgtgtgttgatcttggtcttggtttatcttgtatgttgtgtgtcttccctctcctagggggtcttgtatttatacccatagatgtccccttgtccaagtagaactagggagaccaatattgatgcaatccgagtagtccttgtaatttccatatagaactctactcgtccttccttatccggaactccttctatatatgaggtatgattccgtataagacttggtacatggtgggccccaccgagcttagtcgattactattgggtatatggtatccataaccctgacatgcatcaaccaagaaaccatatcagagcacaagttcttaccaacttgactcattgttagcaaaaaacagtattacatacgcatgtcatgtactcatcattgtgaccgccattcaattaagcaaccactttaccactttatagtcctcctgttgattccgtacaagacttggtacattgtgggccccactgagcttagtcgattactattgggtatgtagtatctataaccctgacatgcatcaaccaagaaaccatatccgagcacaagttatcaccaacttgactcattgttagcaaacaacagtattacatactcatgtcatgtactatcactgtgaccgccattcaattaagcaactactttaccacttttacagtcctcctgcccaaaagtttttggcccctggcctgaaacttctggtcatcccctaagaccgattagaggagctctcacggaagttcctagcgaaaatcatgaaacctccgggcccctggtctaacttggacaaaacctcttctttcgcatgtgtagcagtcccttccttgccgaacgtcaagcattgtttgccattcacaacggcacttgcatggtcgactttcatggggacaaaagccaagaccatgtccaaacttcttgttgcgagtggtgatagtcttgtagagtgcctatttggattcataagttttcatgcacccatacttaccaaggttcctaacctttcattctctttcttaaaggtcaccatagcttcaagattagtaccatagaaatccaaatcataattatagcatctagcacaaccattgctaatggaggcattggatgagtaggtttgtttctagagtagttgaacttgggtgagtaggttccaaaatcaggaagctaactagctgatgggatggtgacaatggttccgctgaactccacaagccattttatctcctaaatgcattgagtgatctcctaatgatccctaaggatgtgctgatggaaaccggcactagaagagaggtatgcactctcatcttgttgaaacaaatgcataattatttcaatgcctaaaatatccatatgaaactatgaagttctcttttctgtgaggaacaatctaataatctaaagcggtctcttttgctagctttcgattggtccatgtggcgcctcttactttgaagaaaaattataaatttatactagggaaaaaaatacctaacaatcatttttgaggaaaaatctagagaaaaatatgattccagaggcttccaaaactattttctctttccaatcacacggacttctactcatttgtcttctataaatataccacacctacttggtactactcctgtaactctagaatatatatagtaaacccaaaattattaagcaaaaaataaatctaaaacaacgaatttacactcattttccttctttaaatatactatgcatactcggtactattagctggctcttttgctagctttcgattggttcacgtggcgcctcttacttattataaatttatactagagaaaaaaacacctaacaatcatatgtgaggaaaaatctacagaaaaatatcacacgaacttctactcttttgcctgctataaatataccacgcctactcggtaccactggtgatgggataaatataccacgccaaacatcgttgatatcactagtgatgggataagctaatttttaacagttacatcatttttcttctgaaaacacaatgtagcggtacttttagaaatgaattctagatgttagaaaatggctcaaaatggctcctaggagagggaaaccacatttggttttggcatgatttttggtgtggtacctgcccattgaaaatcactttcttaatagtttttgaaatctgtaattaaagttattttaatttcagaactggtactgggaagaataggctgcctaacttttagaagatcttttggggaagatgaatttgatgaatggaccactttaggagatgtaattgatgacttaatagcaaataacaatcctgatgctctaaagtggtgtctcaaagctagcaaaaattatagtacacaatctgtttatagagctatcttgttttgtttagagggtaaaggatagaaaaattcaggagatctggcactgccctgccatatgaaaataaaacattttgtctggttggctatgagggactgaatccagtccactaagcagttaaagagaaaaggcaaggctgggaagggactgatatttgtcgcttatttggtgtatttgcagggatactttctgctggggcagagtcccaatatagttttgtgatttctttttaattattagtcagtataataatgagaaaagtagagtttttgctgctcctttagctgctatcggttgggtgctgtggattactataaataacacgattgttagatctaaattgatctattcttctctaatccttcccttcaaaatcatttcccatttgcaacgttggaaaatgctaggtgttaaggatgctgatgccattaacaaaatgaccgaggagctcacaaagacaacggcaaccctgggtgctcagagagctagaattgattgaatagtttctatttagccgcggtagtttttagtatgatagagttgtgnnnnnnnnnnnnnnnnnnnnnnnnnnnnttctgaacttcacccattgcaggtaattttgagccagttccttggtgttctacatggaacgagcataaatgttaatattcacgcggctttgtgaatgggccatccgagttgggacatccaaggctgaggttgagggtgttgctgctgctgtgatctgttgggcagtcgtggatcaaggggcgctgggtggcggcgactgaagattgtttttggaggccgccgtattgtcctcactgcgcgccctgctctaggtctggcaagggtcacctcgcgtgccttttgtcacagctgcactgtcagtggtgtcttcggcttctctttcacccaggttcatcttcgccatctcatttgtacctcggtatatcaggcatcgctacaggagatcaattaggttcagaaatcatcctcatcagttcatatgaataatcgatgctttatcaagcatctctgaattgcatctttagataattgaacaggactaggaatatttttgttattctggttagaaatatccattaggttcatagttcttactcctggatttttgttagatagcaatgcaggaggaatgtgtggaaattaggttctaacatgatcaacactgaatattcgttgcacacaagatgttgaaacgatatttcttcacagttttgacacatccatctcctcctcatcagtcaaagtaacacttgcagtgctagctatctcctattgttggtgacagtagaaagatagttagcccccccagcttccccttgacccggagcaaacttttcacttttttagacgtgactcatgcattgctataacacttttggaagccgagctcggccttatctcctgacagtgtaggtgtgggccctaccgggaggaaaaatatctcccctggctggctcggctcgattttttcggtgtccgttttttaaaaacccggcacctacaatatacaatatatggttggtgtcggatttttttatcggttttttaaaaaaaccgacacctataatgtaagtgccgatttttctctaaaaccgacacctatcttcgtttaaaggtgtcggttctaattttttttcatcttatgaaggtgggaaaagcactatatattggtgtccgttttaccactttcggtacctacagtgttgacatctatccgatgttttgtagtagtggtctgggtcattaggatcttagataattacgttgtgtactgcatggatggcctagtcgtgagcgtggcatgcggctgctagtggcgtacgtcttggcctctaatctgtctatttaagcatgtacttagcatctttgttaattgagagtaaaaaagagaaaaacgctgcgtttgtgcagctccaaactccagtgttcttcgccagttcgcctctggtgtgtgtgttcatcaggagtgtgtgcgactagtgtatctagttagggagtgattcccaacattaatcaagtcacaaaccaaaaaaggattttaaccttcaagtaatgccattctatctttctcacagctgcagctttgtagtcatatacaggatagtataagtagagtcaaagttgtagcatatctattgtgccatccctgaataagtaatattattatccttcaagcttaaaatgagaaaagcgcacaagtaacctaataactaataaatttccaaaggctcgtccatcttttactggtaaaaaaaatagtggtggtgatggtagcatattatatgcaatatgatgaatagtattgcagtatctttttggtaaatgagtgaatcattccattatctattatctgtatatgtatgtggccatttcatttaatgtgaattatgccaattttctagatttggggatactattattttctagtttagaacttttggtatatttataatttacatccatacaataaaccggcaccaggttggttccagtataaaaaaatgctagtgactaaaatatatctacctatggtcttacagaactctataattgtagtcatgatacctacagtacacgtatgtagtatttaggatatctcgtgaaatatatatacttatggtcttacatgagattataactaaatataacggctgctgttggacttggagccctagccaagagaagccgctaagccaaccaggcggcataaccagtaggtttgcactgcatccaatggaaagatgatgaggagcagaacaatagcattactattacgcttcacagtgagtggacaaattgtacgacccaaaaaatagatgtagaattacataatgaaaattttctttccaaattgtaaactatgcgcaataagtttttttacgaaacatatggtattatcgatggcaagccaatataaacaacaagagagaattacaaatatgccactgctttcatctcctaatttggaatagccattataaatacacaaattgcatatttgccaccaaagttggtgtgtgtggcttccgtttgccattgcagtctgaactggtataattaaaaggtcaaaagtttttttcacaaaactaatgtagaaaacaaggaacatggtatgaccgttttgctcttggctaaaacagatccctcactggcttctctctccaagagccctaaatcctcaaatccccttatctcttcctccaaatcgagaacaaaactattcaaaattggttccaataggagatcgagggcaagggaggaatggaggaatggtgacttgggcggtaacagcaagcgcagcggcggggagctgcttcggcggcaacagcttgatgtagctgttgctagtgaaccatgtacatgtctctccaaccttaaactagtgaaccatgtacatgtctctcaaaggcaaagtgaattcccttgttatttttatcttttcaggataataaattacaaaatacttcgtaccatagtctagcccatcagaaaaacacaaccatcatcgtctcattgttataatggcttgcactggttttcctctctaaattaaaatacaaaataattgatttataataaatagtctatgcagttgtatagatatgttatatcactgctagagaaagcatttgtagtcccagtttgtaaacccctttagtcccggatagcaaaccagggctacaagaacaggactaaagatcgtcccggttcagatacccgggactaaaagttttttttctacttaaatattgattttaaactgtcctcaaaatcatcctcattcacaaaataatccacaaattcaataacaaaatcatccacattcacaaatgcaacaacaaaatcatccacatttacaaaaacatcagaaaatcttccacaaatttacaccacaaaatcagtcaaaaaaaacatctaaaaataatcccctattcttctattttttttctactccacgacggccgttccgggcgccgcccttcgctccagcgctgggcgccgccgccctccgcaacggccgcgccgccaatgtctttggctgccgcccgctgacgtgagggtaaagggagaagggaagccagcaaggggaggaggggaggaaaagatagaggatgtgagggagagaaagagataaggatgagaggaggagggaatctctgaaatttttctctccctcacatgcgcgcctttttgctttctctatctcacgagcgatttttttagtctaaacaacagggactaaagatattagggggcctaccacgtcctgacaataaatgaaccggtctttagtcctggttgttaacaccaaccgggattaaagatcaagaaaaatacctccgaacttataactcgggattaaaaatagtttttagttctggttttttatcaaccgggactattgtggtttttcccaacccacaaaaaatggtttctccaaaaatgtatgtctatcaggtttatccaggctcacaaaaattcctaggtccgccacagttcgcgtcccgtccgagcgaacattcgcaccaccccgagttcgtacccttgctaagacaaccatatatttttacccattctttttaaacgtgtatgtttatgtaaactagtgagaaaaaaagtatttttttttaaaaaaatgttcattctattattggtagtctgtcggtgcagttggtagaacattcataaaattataaaattatggcgaatgaaaaacgtcacaccattcgtgacgaaacgcctcttcccactacgcacttactgcaaccaatgcattttatctcaaggtgctcacagtcatgtttgtgacaattttcacatcctttttacgaaagtagaacgtcacagaaggtaatgtgaaaaaacaactgaacactacataacaagtcatgaagagataggtcttgacatttttttcccctatatggattctccaacttgaacgttcacattttgaggtcgtatgaattagttatgaattttacaagatttaatagggttaaaaacattagaaatgataaatgaaatagtactttataccactatgctcagtttgaaacaaattattgagcggattgttgccatggattatctacttgattatataaggataacatttacatttttcccacattgtatgcgtttttccttgacgggggaccttacgtttttcccacatttataaatgcattgcagaccaatgaattgctgatagctgaggcccatcgaaagtacgatgcagatgatcagcaaaatttggagtgaaacaatcaggcataacaggtggctgcttttcatacttggggaagtgatcaagacatgactgtacaatagcattttgcatctgacggaaagattttcattaaaacaactggaaaagaatatgaaccaagaaatcaaaatatataaaatgaattacctgaacattgcgacagcagaaggcatgcaaggcaacatattccctttgtgttgttgcaagggaaccaacactaatcagactaccaagtaatctgaggatggagtttcttcaaaatattggtccaacagctgcacatacaacacaaacataatttataagacaaatggaagtaaattattaagttagcaaatgttgtatacaatggaaaaggcattgtaatattattcgtatatcaagcaaagttagcaaagatatacaaggaaattatatacaatcatgagtatatgactcataacaggtctttcaagatgagtctgcctgtttttactttggatttagctaaattcacgcaacaggctaattgggtcatgtgaatccgagcatgttttacacgtgtccaactgttcaatgcaactctaagtgtggggctcacaaatgaagagcaaaactcaagttttgcaacttatccttacatttggaatttaggaagaaatgcaaccagagaacatttcaacataaaagtttgtgatgcaagttgtggtaaagggcagggctcatgcttgacactgcagttggtagaaaactgggacaaatgctgctggctgcacaacaaatatctgaacattaactcgtttttttttaattcatattccaactagaagtcttttctgtgctcctaggtttcagtttagtggttgtctataactcagaacatgttgctttaaatcctgttttaagaaaaatagcaatgccatctgctcttcctgaaaaacaaactgtgactgtgcttgctaagactttagccaagcaacgcttattgggtagtgcaagctctaataataccatgcctaccagaattgaacaagcctgtcctaatcagaagacatcagatatatgaacatccaaacaatataattctaaagaataataacaaatgcatttgcaatgaatggaaagattagcaaaaagtgtagtacactgtaccaacaagccatccacaatgactcagcttctttgtttgaaccaacattctgcctattagatatacttgattgagaagttgaaaacaaagaatagataaataagcccagttatcaaaataatttcattttagacaaaaggatcttcaggctttaacaaatgaaaagaacccacatagctacctgaaccaggtcaaggaaatgatattcatgcttcacagtaccacaatgactcaacttcaccttttctgaaagtacatttatattcatgctttagtagaacaacaacatcataacatcctgaaatcattggcaaaatattattaggtgatttcattgcaaagacatgtttgtatagttgctccacagaaaatgccatcaacaaaacaaggtggaaaccataacgtacctatttcatgcatccactgctttcacgatggatatgagaggatgggctctcatattgaaatttattaagaggggtgaggctcgaacccaggtcaactagcccaaaccttgtggtgctagccggaagacccccgggcctttctcatccactgttttcaccgacagcgtgacatgcacatcccttgatacagattcatgactattctcataggaattatataggtgagctcagcattcctcaaaatagcaagggctcaaacgttctaatgtactcaacagattcaaagcttccagaaacaaattgaagttctgcctctgttcaggtaaaaaactgcagagtatgaaatttgcagttaagaatatatacagttgttttggcgcttcagaatgaaaacagaaacaacaaagatttatcaatcatgtataaggcatgcatgagcccaagaaaaaatataagtgaaaattacaattgccacaatatctgacataaaagaagaaacacagagttcgactttgagcaaacttgaacagccttaagaacaaagcacaagtggtgaactatccctaaagtttagaatatttaaaaggtttgtatacagaaatagcattttacatccaacagaaagatttttattcaaacagctggaaaagatatttaccaagaaagaaaaatataaacatgcattacctgaacaatgagatggcagaacgcatgcagtgccacatattccctttgtcctgtagcaagtgaaccaaaagaccagttagataccaagtactgtgaggttggagtttcctaaaaaaaaaacattactcactgctgcatgtacaacttaacagaatgatatgataaatggaagaaaagattcagttaacaaatgtatagacaataaatataaaaggaaattagaatattactcataaatcaaacatcgtaagcaaataatgcaaggaaatcctacactcatgaacgcatgattcacgacacagagtttttggatgagaactctgtcttcacttcagttttaacaagaaactcaagcttgcattgcaatgtgccccaaggtgctggatgtacagaaaacaactatgagaaatacagcatcacacgcatacgtaggacatgtcttacagactttttgttttttgcttagtgattaactgctaaatatacagaatgatatagtccataaactaatacttaagtacatagaacagggcaggctggagcagtggagagttaatgctgactctatataatggatcagagcagatgtgctcgaccctaaataaatgttacctgaagcatcctgagttctgtctttgtgatctcccaccaatttataaacatcctgcatggctgcatagtgccattttgttagcatctgctcacagctttcctccaatacctagctcaggcttctcgccttcctgaaaccttgaagaactccaagtagctttggtaatcactttggcatttgatgccttctgtagcatacatccattatcctactgcatatagaggcacgctaccctccatttcaaaagccaaatcaagttccccctgtttatagcatagctcctctaaacatttctttgtttttttatcaagatacttccttttcttcagcatcattgtaaaaatcctgtcagcctcactccatcgtccatcttttgcaagtaccaatagcaaagaagtgtagttggcatatcgtggagtataaccctggaaaagca

SEQ ID NO: 23185 - DNA, 1719 bp, Oryza sativa
gcattctaaataacatataccttgcttccttcagttttttagccagagacggtctcatgcctgggcgagcttatatttcggcaaatgccagtgactaaagcaccataggtgatgagatcaggtgcaacattggttttcatcatcaaaacaacaagatctaaacctaatcttacatctcctttcctaaaaaactgatttataagcattgtatagatgactgtttgtggtgcgatgccctcctccagcatcctttccaaataaccaagagcctttctgattttgtttccctttaccaggccatttataagtgaaccataagcatggggaccaggttgcaaacctctctttagcatttcatcgaaaatacggcacacattccttgtttgcctcgtcaaggaatatccattaataagtgatgtgtaaataatctcatctggtgctaatccttctcgaatcatttggcggagtgtagcctccgcttctttaaggcgcctcattctacacaagcacactataatagaatcatatactgcaatagaaggctctatcccatccttggccatttcaccaaacagatgaagtgcactttctatttcaccaatcttacagtatgctgttaccatgattgaatttgtggacatatcaggtctgacacccctgctctgcataatagtaatgagtgccctagcatcatccatacgattttgctcacacaggcattttatcacgatattgtatgttaagacagagggctcacagccataagccaccagcttccccagtagatagtaggacacatctagcctcccctccgagcacatggcaattatcatcaaattgagaacgatattaacagggagcacattgcttgtcactatttcatcgagaagatggtcagcctccttctgtaaactcatgttcgagcacccaccggcaagcgaagaaagctccagcagcttggcgccacaatccaacttggcaacagccttcaatgctttccgcacaaataaaaccacccagcctttggggaagaacctcgctatcgaaataaacataacatggtcagggaaaaggccactctccagcatcttatcaaacagattctcggcctcacccaacttcccatccttgcagagcgatgccatcagaatagtgtagcacctcaagtcaggtgcaacacccgtccttatcatcaccttgtagatatccatggcagcaccaacccacttgctcttacaataccacctgatcatcacattgtaggttgctgcgtcaggctgaatgcccctgtcaatcatctcatggtacatctggaggccatgatcgacacgcccatgctcaaacaatccccatatcatcgtcgtgtaagcgtacgcatccaactgaacatgctcatcccccttcatcctacggaacacatccagcgcaggctccagccgcccctcccggcaaaacacccggatgagcgccgtgctgagctccctatcgagatacatccctttgatgagcatcagctggcacatgtcgctggcatcgagggagcgcctggccttgcagtatgcgaaggcaagcgacctgtagacgcggacggggggtgtgagcccggagcgaagcattgcgtcgaacaggaagcgggccttgtcgacggccccctcggagcacaggcccgggatgaggagggcgaagtccgagacgggcaacggcgaggggttgcccatc

SEQ ID NO: 23186 - DNA, 2367 bp, Oryza sativa
cggcggggtcgggggcttcggcaaggccaaggcgggaggcaacggcgcgcgcttcccggaggcggccgcggcggaccaggcgggtgaggaggtcggcgcagtgcgaggcgtgggaggtggaggccgccgccacgcgggagcacatggagaattaatgggagcaggagacggagtcgtcgccggcatcgagcgcggcgggcgggggcagccgagggtggcgccgccgccgccgccgccggggaattcggggaggagaggaaggatttgacgagcgagcgatatccaccgttgattaccatccaacggtcacttgattattactctcctcttctcttatttggaatgaaatcattttttatgacgctattgtagtcttgtagatagtagagcagagtagaatactataattacttaaaatgggatactaacatatggttttttattatttattaattatagagaatgtgtatgtcttcattttattataaagattagccatgatgatgctctcctagctatgataataatatggacatagttcgaagggattagtgtgcacgtttcgtgagcgtccacatttgtgctgtgtttctaaacaaacaatatagatacaatgcatgatactatttgcagtttctttgatagcatgacgataaattgtgaatggtgcattttcgtatatgttaactggtgggaacattaaaagaacattgtagtgtacattaacacaaccttttgaaaaacgaacgttgttgtgttgtgtacacattgttcaagtgagacccacttgatgactataggcctgtttagtagagctacaaatttccgatcgtatatgtttatatgttaaattatagcggtctaaaattttattgttttatctaaaacatgaataaaatgatttattcaaatgttgatcgtaaatctaaatttatggatttgtagagccaggaatacccagcaaaaaatatcttaaatatgtagtctaagaagctgtgccaaatagggatgaaaacagatcgaatacggtcggaaactagctttatcatattcgttttcataatttttttcggaatagaaatcggaatcggaatcggaaacccggatatgaaaacggaatcgaatattatcgaatacaaatacggagcgaaacgaatactgtgacgaatattaatcggaatataaaaactcctcactactcacaaacgatttttgatattgtgtttctaaaatcatgctctatcatgttattgtgtttctattgctattattttggcctttttgtgactgttgttttatcaattaaaaatttgaatatcaaaacttcaaatgatattttgaagcagtaaataaatttagctgaaaaaatcatgaacataaaagttgtagaactcatcaagacatataacttttattttggtaatttcttcatccgataaagtgacagtaacattgttcataaaatttacatctatctttcaaagtttataaaaacaaatgagagatgtaaattttgtgaacaatgttactatcactttgtcggatgtagaaatgaccaaaataaaagttatagattttcatgagttatacaactttgttgttgatgactttttcagttgaaatcatttagtatttgaaaatgttgtttgaagttgttatattttcaaattcaaattcaaactattcaaacaaagtcatatagaaaaatgaccaaaataaaagttatagatcttgataagttatacaactttttttttgacaatttttccatttgaaatcatttactacccaaaaaaattatttgaatttcttatattttaaaattcaaattttatatagttcaatcaaactcagatggagaaatgaccaaaataaaattggtagatctcaatgagttcttcaactttgttattaataactttttcatataagttcatttagtatcataaaatttaatttgaagttcttttttttaagaagtctgatttgcctcctctttggcttgggctggcttatgggccttatgtgttgtcggatatccgatggaaaataccggataatatccgacggatatcacctatatcatattcattttcatatccaaaaaattatccgaatttgaaaatttccggatatatccgaccgaaactatccgaaccgaaaaaaggtccggtcggacggaaattatccgaatcactttcaaccctagtgccaaagaagacctatgaatatagctttttgtagttctgtagggatacttgcatctcgaattttttttatttttaattttttttattaaaagttttacaaaaataattttccattttgaaaattgacggaagtagtcgcctaccgccctctgggagg

SEQ ID NO: 23187 - DNA, 5024 bp, Oryza sativa
ggcccccttgccgccctccgctagggcgattttatactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattatagtgaagaatgttctacataatctcaaatctagattacgtattaccaatgaataggcttccattttcgtgtgttgtgtgctagtgggaaagaaaatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcatcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccaaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttattacttacagtgaactggagcaaccaagccttgctaggcccgactgtagagtacggaggaagggtggtggtcggtcctaggtgtggaaggcgcatcacctgctctaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctataagagcggcaaggagtgaccggtctgcatcccaccgcttcgctgggtcacggtcgtccgccgccgcctcaacaagcctacaaagtggtagaaggcctgccgcacgcaacctgtatagagcaaaattcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagtcaacataagtaataaatgttcataagcgaattactaacacatattaaacaagagtacaaactaaacaaaagtgtttagtccgaacactcatcacgataacattatgatacaacacccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggtcttgcgcgcctgcttgttgttccttcaccaggtggtcgcctaccatcacttgcctgtccagatggactagcatttgcgccgcttggaacttctgcattcttcgggcatttcttgtaagtatggccgagcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatggg

SEQ ID NO: 23188 - DNA, 1854 bp, Oryza sativa
gcaaagcataggtaaaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttctaccgacacaaatataacgaggggccatgaccgttcaaaagccatttccacataccgtctccaagcatcagtgctgtccatcggcattagttcccaaaaataaccttctgttgcacgactcactacaactgacactgacattgtgtatacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacttgtgatgaattgagcgaaccagcagggcttcgccgctccccttctgctgccctcccctctctctctttcgttttttttggatttttagtgaatataatgaaatttcacagaggagggactgggctttatagagggagaggcaaaaatcgccctcccccagggcggcaagggggccgcctgcaaaattccatgcccc

SEQ ID NO: 23189 - DNA, 2960 bp, Oryza sativa
gccgcctgcaaatttcgttgacggccgtcgcccgagagcgaacggccgtctgccacgtcattttcgccgccctctgggagggcgatttttaaatatgcctcccagagggcggtaggagaccacttccgtcaattttcaaaatggaaaattatttttgtaaaacttttcataaaaaaaattataaataaaaaaaattccttgcatctccaccaagcatctaggccctgtttggctactgggatagggaaatgattcccacccaccaaaagtcatttttaaatcctaaccatttcattctctttgttacatttaatcatagcccttcattcgtttcccaatcctaatcccactcctcatttgtcattatccaaacacacccctattgcatgagttgtcaacccacagcgtctctttgatcaatagaaggatttgcgtgatggtccaagcccatgtcaatatgaaaagtgtacaagattggtagagatcaatagctagtatggtaggagaagattttaatccttaaggagatgttctctagtgtaacttgttatctcaaggttaatagaaatggttataaaaatctttaaaaaaatttacaatgtagattataaacatctaccatttcaccaaaaaatcatattcaaatttgatctatagaaatgaaaacgacaaattaagacgtaaatagtatcaatactattcatatgttggatttatctctttttttatgtcaatttgtgacttgagtttggacttgatttttatgtagtagtttatgtatatggcatgaatgttgataatttgtttttttttaatttttaacaaccatttgaatggcgtttgaagcgcgcactttcttccctgtatggtggtttgtcaaatataatgcatggctgatcatgcctttaggccatcgttgtgagaaacatgggcaaatgtcacaccatatcagtgatgatcatcactaaaagaagggcattcggacgctacgcgacatcaacatacatgaaatcctcgtcatgtgcatacaagcgctggacagcgtattcgttaaggcaaataatccgactatttgtgagagaatgttttccacggatcacctcctcaaactctttgtctccaccatgaaatttctccagagctggatgtacaatctttgctcttcaacttcgcagtacaggcaccggacatgttctgttggtaataaaatgaaatgaaatcagaaacttcaacaaagatgatgaataagaaaaaaaatactcgaatattagggaaggacctaatatcaaataattagaaggggtgaggctttaaacctaggtcatttagcccaccaccttgtggagctagccggaagacccctgggcatttctcaacaaaggtgatgaattaataagtaaatcaatatatatcataggattgaccatctaaaaaagtaaaattttgacagtgaaaacgtagttgcaatttcaccatttctaatgtgtatgaaaaaggaacaaaaatccatttataacctacactcaagcgtaagattgaaatcaatcttggactacaatttgggacataataattacgtatgcatctggttgtattctcaaaataattcactctaactatatgtggcaggtctggttatagcaagttcttccatcgtatttttttagttttatccatatacattgtaattgaaaatagttatgaatgctgcatttttcaacatatataacagatcaagcagcttaccagcaaatggcaatggcatgtccaccttgcaacacatgatagccggttcaccctcagccttcttattgtcaaactcggcgaaaaagagcaccggggaagatggtgagcaatccgtcttctccgtggccaagaagttgacatgcgtgtatttatactcgcaaggtgcaaaggaaaggtaatcttcctgcttggagcaataatactctggaccgcacaccgaatcgttcgcgccacaaatcacaagaaggctgtacgtaggtttctacaaaataaagttacgataatgagcaaattgcattggcagtatatcataaattgtgtatatatgatgaatagaagcaaaacgaaccccatctcgcagaaagtgttggttcagggtagctttgacattcctagagatcctcctttgtgtggccatggagcgcatcttgccatcggacaccggccatgtggatttcttgcggagatggcttctgctcagctagcaacacgccggcgaggtaccggacatcctccggcgagagaacgcggtctccaccctgctgcagcaacaacatggcagccggtgattcctgcagcttcgctttgcaggaggtgaggaacgccgcttgcgccgtagggttggggtgccacgccgcagtcgccgccgcctcgtaggcttcttgcaagccggcgcacgggctctgttgccccgccttgatcaccatggcttcgtcggcggcgaggggcaggtcgccgcggcaggcaaccaggcactgcacgatctcgtgctcggagaggtgatggtaccggctctgcaggaaggagatgaggccgtacatggatcgactctcaatgcgggtgaggatgtgcgggccgatcatgtcgagcactggtggcggggctgccgccgggaacgcggcgtcgtaccagacagtgttgaggatgatgttggagactgggtccatgggcccgtagcagtgaccggccttgacgatcacttggtggtagcggttgcgcagctcgccggcgggcagccgggccagcgaccgaaggtagaagccgcggaacgcgtggaggagcaccctcatcagagacgacgtgtggtggaggcggtttttctacactaggtgctgcggcacctaggctgcatgccgtccgatggatttagtgattcgtgcggtatgtaaagtgcttttggcagacatattctgtatcttgcactaggatgaaat

SEQ ID NO: 23190 - DNA, 21210 bp, Oryza sativa
agcccgccgcgcgagcccgcccgcagctgttgcccgcctgccgcccggcgatactgtcagctatggatgagaaactgagagagagagagtagaaactgagagagagaggagaggaagagtcagaagagtagataaggttggggtgaaaaaaaggtggatttttttttcaatgtaaaaatcgactttttttatatgtggctctttaaaatgaattttaaggcattaaaatcaactcgtatgaaaaagttgtcaaaaacaaagttgtataatttattgatatctaccatttttattttggtcatttctccatccgagtttcattaaactatataaaatttgaatttaaaaatctaagaaactcaaataattattcgggtagtaactgatttcaaatgaaaaaattgtcaacaacaaagttgtataacacatcaacatttacaacttttgttttggacatttttcaatatgactttgtttgaaccgtttgaatttgaatttcaaaatatgacaacttcaaacaatattttgaaatactaagtgatttcaattgaaaaagtcatcaacaacaaagttgtataactcatcaagatctataacttttattttggttgtttcttcatccgacaaagtgatagtatcattgtttacaaaatttacatctatctcatctggttctataaactataagagagagatgtaaactttgtgaacaatgttactatcactttatcggatgaataaatgaccaaaataaaagttgtatgtcttgatgagctctacaacttttatgttcatgactttttcatctgaaattaattacagcttcaaaatattatttgaagttttgaaattcaaatttttagttgataaaacaaagtcacaagaaaaaatgaccaaaataatagcagtaataacacaataacatgatagagtatgattttagaaacatttagaaaaaagaatcatccaatttggagttcatatgagtgagataaactagtctcaaattttcaaatttatttttcataccgcttcttaagtcacccgtatggaaaaattgatttttccatgcgggtccttaagtggtccacatacaaacaaataaaaaaaattcaattctgaaaaataaacactcgaatttttaaaaactttcaattgaaatgttcaacccaaaatttaaaatattcatccaattttcagaaattttaatgtgcctgcgaaaatttcagtgatatacattaatttatctgtttcatgataacatgaatttgtatgaaaagtaaacataacattttctatctcccccttgcccttataaatagagataaaatttgaaaatactgatgttttgtttttgaaaactaatggctacatctctttctcgatttaagaaacttattttgaggggtcttgatattttgataattattcgttaccgtattcgtttcgattcgtattcggctccgtatctgtattcgataatattcgattccgttttcgtatccgggtttccgattccgatttcgattccgagaaaaaaatatgaaaacgaatatgatatagctagtttccgaccgtattcgatccgttttcatccctatcttgcactcgtcgtatgcatgtttcagtatacgggggatacaatactgctttcgattttgctatatctcactcaaaagattttttcttatctctcactcgattttctcactcaaatttacagtatattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatatatcggattttaatccaaagattaaaaatctgtgtgatacgatcataaaaatctttcgaaagatgtataggtactccctactgcttttgcaatgtggtgggcccccgtagggttggggaaagctgaatgtttcataccccctttaccctcccgaattgttcccaaccacacatctcgccagcgcgttcgacgtcacctttccgtctcgccccccctccccctccccccaccatctagtcgctgttttttctcgcccgcggcgatctcgtcgacgccggcgacgaaggagtcgatgccacactccgttttgtccacaccgcactctgattggacaccggcggcggcggacgttttgtccacggcggcgatggcgtatacgccgcacactgattgtacaccggcggcggcagatggaattgggtggagatcctcatcgccatcatgagtgtggagatcctccacggcaagacggtccagagcttcgtggaggatgagggcgccttcaactcctccatcgacggccgctttgcagcgcttgacactaacagcgagtccgcgacgtcctgctctcctacgtcgagatggccaacgagctgatgagccttcgtatgctggacaagcacttcggcgacgacgaggccgtcatgagcgccgacgagctcgtgaagctgtaccgcggcctgtttgcgtggttcgaccgtgatggcagtggcgccgttgaactggaggagtttcgggctgagatgaaggaagtgttgctcgctgttgctagtgggcttggattcttgctagtgcagatggtggtcgaggatggtcggagtgtggcgaaacacctaggcgggcgtttgtagagattcaaacaattggaaagacaaagggaaaggttccaggctcttcctgcaaactaattgatttttcgaaaaacaaatgtttgcactgtctttttttttttttgctactttttgtcctctgtgagtgataatgtgatatggtgtgattgaaggtaggaagggtgatctgcttctgctcatgatccgctaagagcctcagatagagagagagagagagagagagagagttcttccatagagagaagagagaaagaggaaagaacaaagagagtagatctgagatgttcttttatctatttgtattcggattattgttttgctagaactagatgaacaaaaaagattttgtttaagttcgaatcaattttcgtcatcccaaaaattggctcgcttggtcttaattataatcaataattttgaaacaaaatctcagtaatcagaatgtgcaaaaacaattgtgttgtaggtttctttctttcgcccggcaaagtgtaggggaaaaacaagcaacaatgggcaaatttattcaccactattgctaaaaagaattgaaactttaaaagccctggagttaatgcgtgctcctgcctcgtctcggcgtccgccaatgaacggatggagaaggaccccaagaagctcgtgttgtttcttcgtctcggctcgccggtgtccgctcacagcacatataaaaatcgtagtgtttgggcaggggaaggatgctgcttagcagcttgccgaagagctcatcgggacgggcgcgaagatggcgcgctttgaatccgaccacgaccgagagtcctcgtcggcgaggaacgccgccgcgtcgagcacgaacaccggctactggtcgtcgctgggcgtgaatgcctggatgcttctcaacagcttgcctcagcgctcgagcaggccgcggtcagtccggagctcgtcagggcgggcgtgaagatggtgcgctttgacctcgacgacgacagcgagtcctcgtcggcgaggaatgccgccgcgtcaagcacggacatctggcacggctgctggtcgtcgccagctgtgaacgcctggatgctgctcagcaacttgccgcaacgctcgagcaggccgcggtaagtccggagctcgtcggggcagcgcgctgctgcattgcaaagattttgttagatgattgagtttccgaaatggtggtcgcctttgaaggaggtggagggctcacctcgaagtcccagcgggaggaggcgataagtgtgccgctgctggtgccgtcggggaaggtggtggacgcgtcatcgtcgagagatagcgccgcggtgctgtgaccgctgcggcggactccggcggcgtcgccggtgctcggcttcctgagcggcaattggtaactcggcaactgcgcccacgagacatgtcgctgcgggaattgcgggccgcgtcaagcgggggaagccaaactccgtgcgggtgacgcgacgcggtcgggtgaggcgagcgttgtcggtgtcgacgcggactcggctgtggcgaaacacactctgtgcgacgccgaaggccaccgtccttccaggtcatggccgtggcttccctgcgcgcctcgacgtggtctctgagcttctttccttgctcggactccatggccaacctcaccttcgcctccacctcgttggccatgacaagctcttccagccatccctccatctccacgccgacgcccatgacctccatgagcaccgagttccaaagctgttaccagcaacaagcaaaggaacctggagggtcatggcgagggcgccgacgtcagacgggtagaactccatgacaaggactcccagcttcctcacggcttcaagggcatggccgcacgttgtgttgatgaggacggcgtggaggccctgcacggagcagaggaagtcgtggaggtgttcgttgttccgtcgcacgatgtcgaagtaattcttgaagaacttaggagccgagcgtgggagggtccgggatgcactggagcgtgtggaaggagatgatggagggctttggccggagcgtcggcgagcctcgacggagcaccgcttccggcgaaggagatgcaaaggggatgcggcggcggcggcgatgctgtgtagatggggctgagaccagcgcgagaggatggaaaacgaatgtgtgacgagaatagcgaggcgtcgtatacccaggtgatgaggtgatggtccctctcccagccttcctcccccgcgcatctgctggtgggcccatcattgtatttctcgtgggtaaaaaaaaaaaggaaatacgatgcccacctcttcagatactaattgatacggtagatgtgcgcgcgaatcttgatgccatcctgtggcatgcagcctaggtgctaaaaagactttccggacgtgtggtggcatggcgctgcggtgatgttgtggtaagcttgtcgcgacgccgcaaggctccaactctgctccaggtccggcgcgggtggcggctcctcgtcggcggcgagcaatgtttgaacgccttggaggttggtcggctccgccgagagcacggtgacctcctgatggagacgtgacgacagcgacatccagacatggacgaggcgttcgggctgagggtggccggcgacctgcgcggcgagcctgagcgccggctggaacgccttcgccgacgcagcggaggtgatggagaaggccatcatgccgcgcgacgcgacgacgaggcgcgcggcgacgaggaggtcggcgtcagcaagcagcaggtagcgcacggcatcccagtcggcgaggtaggggaagaagtagagcaggaaggcgacgaggccgtcgagggatcaccgcgcgagctcggcgtcgtccaccacggccgcaacctcgtcggagacagaaaggacggcgttgacgaggatgttggagctcggatcgaggaggacgacgcagcagaagccggcggagtggtcgacggcgaggcgggcgcaggtgtccgtgtacaaggcttggatgttggagaggaggcgcgacctgttgtggagcgcctcttgtggagtgggcatgtatcgttgctgcggcttcaccacgcgccggaggctactgccgccgcccgcagacgacgcatccattggagatcgagttggagaggacacggatcgatcatcattaattatatgtttcggtccaagaccgttgcaccgatcgaatccgcttcgatttgcgatcttcctaatgtccaagatgcctgttcatcaattcaccgaaggcgccctgttggcgaacggcttcgtcagactctcgcggcgcgctccacgcgcacgacgcgcaccccgcgcacgacgcgcagcgctcctcgctccgctcgcaccgctgcacgtccgttagaccaggggattagttaggcccaggcaactcccaagccttgttgtacatgtataaatgtaagctccattgatcaatgaaagttacggttgatccaaatctccttctacatggtatcagtgaccctctgatcctagtcttccgctacctctcccttgctagccatgtcgcacagctccggcgcttccgacgcctcgtccacctctgacgaagagcctgtgccggcgccctccacctctgttcttcaaaccgtcaacatccgctcccacgtcccggtcgccctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggctgcacaactccatcgccaagaacatcttcgacgtcgtctacaagccccgcgcctctgccttcaccgtgtggagcgacatcgaaggcgtcttccgcgacaacgccgtccaacggtctgtctaccttgagaccgagttccgctcgatcaatcaaggtgacatgaccatcacgcagtacaccgccaagctgaagcaactcgccgacggcctccgcgacatcaacatgcccgtgtctgagcccagccaggtgctcaacctcctgcgcggcctcaacaccaagttccgctccctccgtgccagcatcgccgaccggaatccgccgcacactttcatgaccgcgcgctcctacctgctgctggcggagcatcccggcaagtgggtcttcaagaccaagcttcatgctgacggctcactcgacaagtacaaggcacgttgggtggttcgcgggtttaaccagtgcccgggcgtcgactttggcgagacattctcgcccgtcgtcaaaccagcgaccattcgcaccgtgctgacgctgatttcctccaagcaatggccggtgcatcaactggacgtttcaaacgcgttcctgcacggccatcttcaggaacgtgtcctgtgccagcagcccacaggctttgaggatgctgctcgcccggcggacgtgtgcctcctctcccgctcgctgtacggtcttcgtcaagccccgcgcgcttggttcaagcgcttcgccgatcatgtgaccagcctcggcttcgtccagtcccgcgccgacccctccctgttcgtgctgcgccgcggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccaatgtcctcgaacgtgcaggcatggcgaactgcaaggccgtggccactccggcggacgctaaacccaagctgtcaagcgacgaggggcctctcttccaggactcctcctggtaccgcagcattaccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggatcaaacacatcgagctcgacatccacttcgtcagggagaaggtcgcgctcggtgaacttcgcgtcctaccgatatcgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcatgacgcgcagcgctcctcgctccgctcgcaccgctgcacgtccgttagaccaggggattagttaggcccaggcaactcccaagccttgttgtacatgtataaatgtaagctccattgatcaatgaaagttacggttgatccaaatctccttctacacgcccagtgcccctggccaggagggaggtagaggggaacacgcctcgtgcttgccttagcagacccagccgtcgccgccgtcaccaacggcgcccgtagccaggggggaggcgcgcggcgacgacggtagcaggcgagagacggaggggattatcggctagccgacgacgccgaggagatcgagacgatccggatagacggggaaggagatcgcggcggtgggggaaagaaaagcggaagaaaaggatgcgagcgagtcgctaagcgacagtcaccacgttcggtgatattagctctggcttagcgacatgtcatctgctgctcaccacgttgggttcagtgacagtgacatggctggggacatggatgataggaaaagcactaccggagtgttgaacaagttgggagaaagcttgatcagttggcagtctcaaaaacaaaaaggtagtggctttctcaaaaacaaaaggtactgctggctgaactgcttggaggagaacctaaccaaactgtgatgaagattgataataagtctgcaatcaatctctgcaagaacccggtactgcacgatcagagcaaacacattgacacccgatatcattttagtagggagtgtgtggagaagaaacaaattgctgtggagtatgtacgttctgaggatcaacttgcagacatgttgactaaacctgttggacgagtttgctttctggagcttcggaagaagatgggtttggagtagacacatcaagattggggggtggggaagagttgattggataatctttgtgccaaggaatttatcttaagtgagttgcgtgttttcattattagttgcactattttgtaacagcatcgtagctttggattcttttgttgcatgttttcattattagttgcactattttagaagagatcgagcgaagatcggatcgtgggatggcacggtcagtcattgatccggtgagatcgcgcatgtaacaacctcctccgtggagaggatatagcccgttttaaatgaaataaccaaaaataagaaacaagcaagtaaaaaaaatcataaatgtagggaaaaaaatgttctaaattattttggtgcacagagtgtaactgtaagttggatgtaaacaaacacgaatcttaatgcgagatagaaacccaaaaatctattgcaggtaaaataacaaaaaccttaaaaaaattaacagcagaacaactaaccccatctagcagcaagtgttggttcaaggctgccttgaccttggcagacgtcttgctctgctcagccatagaccgcatctttccgtgcacgacgagccagaaggacttcttgcggactacttgtggagatggcttctgctctgcgagcaacacgccggcgaggtacccgacatcctccggcgagagatagagtcttgtctccgttctcctgcaccagcagcgacatggcgaccggtgattcctgcagcctcgccttgcatgaggccaggaacgctgcttgcgccgcagggtcgtaggcttcttgcacgctggcgcacaggctttgttgctccgccttgatgatggcatcgtagaggtcgagtgtggttgtcttgcatgggcgacgccggcgttgatggttggcgccatctggcgccgccgtggcttcggtggcgaagaggttggagtcggcgagagacaggttgccgcagtaggcaacgagacactggacgatctcgtgctcggagaggtgatggtaccacgtaaaaatattaatcttaaggagtatcttaagttttcagataatcttcttcctctcaatataagcatgattaattaaagctaagtacatatagctaactgagaattgaccattttgatgaaaattccattttgatgtgtcattttcttctatcaaacgaatatgcacaattaaagtacataggttatgccaattgaccaaattctggcctactaaagctcttataaaagaaacatttagcagaacagaaatcataacatttgcaacgcgaagaatttctccttcgaactataaagttcaaagacaagtatatgtctgaagaatttctccttcgaactataaagttcaaagacaagtatatgtctttaaaggaagcatttcctatccacatgtcctcccagaatcttacttgttcaccattatttactatctaaaaatccatatttaataatttacttttgactttcataagtcctgacaaaaagggaatccccttgtttcctctcaacttgactgcttaattgattcttcaagtattttcttttcaataagtcttccagacaccttgctcatttattaactaaaacaaccatttgcttaataaacattgaaccccaagaccaccctggtcttttggttgacatataatgtcccaacttgtgagtctatacattttttttgtgtttattaccttgccaaaagaaacataatctataataatctattgtttgaagaaccccttttggaatctaaaaaaaatcataaacatgactgttggaggcatgtcacgagggcctttgaccggacctgccgaaactaccaaatccgctggacatcgactaagtccaaagggtgtgcccagggcgaagcgtctggcgaagccgaacgatgaagatcgaagggttcacccccaagctcacaaccccggggagaagccattgggcgaagctgggcgacgaaggccaaagggttcgccaccaagctcaccatctggccaaatcgccactaagggcgaaagccataaagcgaagcaaaaggccttcgcctgaactagaagatgccttcagctaagggctcgggaggccctgcggccatgggggcctttcgccattaatacaaaagatattgtatacccacactaatgtccctatcataagggtatccctgtaaatttctttttactaactaaaccctagagggtaggagtctgtactaagattataaatagccccccagggccatgtaatgggggatcccaaaaaaattttaccaattaatatattgcttttattattccatcaactcattgagtgatccacatctttctacgtgacgcagttatcttttgacaacaatgactagacttcaaagcacataattcatctaaacaaatctcccccaacagcaatatgctgacctttcccactacaaaatctcttttccatcatgtggttacttagtttccagtctttatcactaagctttctaaaatatacatagaaataccaagatatgtcagacaaatgcttataggcgctttcagggaatgacaagttatattcatttaatgattgtaccaaattctcctttcatagtagattgatttcatgaaataagagttattcatactccaacggaaacaaaattttataaatttataacgtattttggttcggttaaattgcctacgtaagataaaaggttcatatagaaaatatgcacattaacaaattaactgaatttctaggtctataaattgaactgacaaatttacatgtttcaaagttgcatctgtctagtggtcatgaaatcacataatttaattccgtgattagtataaatcatcagactatatattctactcaagatattcatgtcattctataggctttatggaacagacacccagctataactcacatttaaataatcatttgccaactgctaggtcctactcaaatcacttctaaattaaaaacacttacggttttcgccttggtcttaaacttcaatctacaaactttttttcttgttcatttatttcctccaagcaaaatttgaagcttccgcaaaactgcaaagaaaaatcgtaatgattatagcaaacaaataatattaatttgaaatcaaaagagaaaaaaaaatcccaaacctttttgtcgcaatcactatcggtgcaattatatgctgtcagcttgaagaataggtgttttgtaggtctactatcattagagctttaaagtcctggcccttcgcttcgccatgattataactatcaatgttaccatgtagtactatattataggtgcaattatatgctgtcagcttgaagaataggtgttttgtaggtctattatcattagagcttcaaagtcccggccccttcgcttcgccatgattataactatcaatgttgttgatgagttataaaactttgttgttgatgaccttttcagttaaaattatttagtatttgaaaatgttgtttgaagttgccatatttttaaattcaaattcaaactgttaaaatatgttatatagaaaaatgaccagaataaaagttatagatattgattagttatataattttattgttgatgactttttcagttgaaattatttagtatttgaaaatgttgtttgaagttgtcatattttgaaattgaaattcaaactgttcaaaaactgttatatagaaaaaagaccaaagtaaaaattatagatattgatgatttatacaactttgttgttgataatttttccatttgaaatcatttaccacccgaaaaaatatttgaatttcttatattttaaaattcaaattttatatagtccaatcaaatccgaatggagaaatgaccaaaataaaatgggtagatctcaatgagttcaacaattttatttttgacagcttttttcatatgaaaaactcaattccaaattcatttttgcctagaaagtctgatgtgcctcctcctgatgataatacttgctaaatatatatttgatccaattaacttggttttggtggtgaaatatgttatcaaaatagatgttatgtgaatgtggttgtgttaaatatattgatggttatgtatgtgaatgaatgtatatgaataggtgatggtagggtgtgacatcctagcccagagcttaataggattaatagtatacttatgctaataagttacagcaactttcttggaagctaatctccaaactgatcgggaaattcttcccaggtgcacacaagtcgggatgcccgattgagatattttctcacatcactgaccaatcacgaatccactacacaaagagatgatgctttaaacccgttaaagataaccgatcccgatcccgttctagtgacacggcaacaagagttttcgtcgtcaaatgcacgaagaaaaagtcttcagtggaactgcagaagctgcatgtccgtgcagcagcaagtcacatgacaattaggaaccgagagggtgtccagctccacgatcgtacctgggcgggcgtttgatcgaactgctctgacaacaggcagcctaggcaatgtcgtcatcgagtccatcgtcgtccgatcaaatgaggcccttcaaagtgcaccacgctggtgcattacttcatgctgttaaaaaaccggccccgaaatctcatcggaaaccaaacgcgaaagaaaacgccataggagatccaaacatgatgacaacaccgagacacgatatttgataacggagttcagccgaggcctacatctccagggcactgattacgggcgctcctccccgatccagcatatacagcgtatcagagttacaacgactcacggccggtcgccgccggcagccgctccctctcactatactaagtcgccattgtcgtcatgcagttacaacaggcacgcccctctatttatgagagaacctaggatagagtccgactcatactctagtcctacacctagtacaactccaagttctaaactgtaaccgactacgtacacatattcgacataaactctaacacatgcctccaactcaaccgcatgatgccatagaggagagagggtgtgggcccttgtgccttcgctgagcttgttgttcctttgctgagacgcgagttccacaccgaaaaaacggaaaaaggcacaaagcgcgaagccgtcagttcagttctgaaatgcatcctttgttgagacgcgagttccacaccgaaaaaatgaaaaaaggcacagagcacgaagccgtcagttcagttctgaaatgcagccagcccgccatgctagtccctcgccacacaccaccgcttcgccgttgggattgccgctgttgtggacgccgctccgagtatatcaccacaagctgccggatatgaagaggcagcgagagaggagaagaactggaacggacaagccagatctgagtagtggatcatgaggaggcctccgtgaccgcccgcggaagagctcgacggcggctgcagcctcccactccacgccgccgtggggagctcgtcgacccaatggaggggagatgctgtctgccgtggaggagatgccgtcgggattgccaagcttgccggagaagcttgattcgccgtcagcggtgaggaatagccatcgaactccatgctgcctcgatctacagctcaatccacgcctgtgagctccggaagaggagggtaagcgcagggacaggaggaagagaggcgcgacggcctgtggctaggagagatcgtcggtctcggactcgcggagtagaggggcggagcgcaatgcgccgatgggggaaggagatcgaagtattacgtgattcggggatcgttaataagtgggtccatggccttatctataagttattttctgtcctaaggggatttattgtaaaatatgtaatacgataaatgtatatggactgaagttaaaaaagggaggggctgatatgcaaaatatagtggggcccatatgttgctatatacgtgtcttcatctcctatttcttaggtgacagttggaaagatggactaggggttcggtgcactgtgaagggcctgatgccccaaatcaatttgctgcggctagccactgtgccatgtccacttgttgccggccactacatgcccccgatcgtattacatgcgtcgtcaccgttctgagtctcgaagggacaactgtagagagtacgtatctttacagttgataaataggtaatcttcagaattcaaaagtttatttggttataatcttcagcaaataatatactggtaccatttatttgtttataatcataaaaaatatttaattgattattacatataaaatacattttgtagagaaaattcagaattgttttatgagaaacacaatcaacaaatataccagtacatgaattttgatcagaggttatggccaaatacaacttcatttgggaattgatgctagcaaattacacgcatatttcatttagaaatagaatgacaaatagacattaggtatttagaagcaagcaacattttattgtagaactagtgtagataaagataaactaacagaccgatatactttatctggatacaagcacatcctccattcgcgcgcgaatcaattaagaaacttccgggatctaataatgccttgcagacgttctgctatatctgtcatctcgggcctttggtccacattattgtctaaacactctttggatatcacaacaagattatggagatgctcaatgtccttttcttcagcctccttaccaaacagcatcttatttgctcttatctcagttaagtatgtgtcaaggtaatttctgacaaagctactttcaccaccataaacagctttcttaccggtgatgatttcaaagagcacaagaccgaaactgtagacatcactcttgttagttagcagaccagtttcacgataaactggatccatatagttgttgtcgccaataacatcgttagtgtgctcggtgacatctcttgcaattaaccttgatattccaaaatcagatatttttgggttgaattgatcgtccaaaagtatattggcaggcttaacgtcaccgtgttgaatgctagttgaggtcttggaatgcatgtaagccaggccttctgcagattcggcagcaatggccaaacgtttgtctaaagtgagaggaactttgttctcaccgtgaaggatgtcttgcaggctaccattcgaaacaaattcatagaccaagatcgggacatctacctcaaggcagcaacctattagcctgacgatgttcttatggattacttgagattggataataacttcatttgcgaattggtccttctgcgtcttgtcaactttcatggacttctttaccgcaacaggatgctgttcatcaaggaaccctttatataccataccaaaggcaccatttccaagaacatgactataagtttttgtaattcgctttagctcctccttcctgaatatctttatgctctttgcattttccagtataggaccaccatttctaatgaaaaattccctcatcttttgtttctccttgcgaagaaggaaaacaaaaaccagagttgcgaggacaaggagacccgctacgactcctatatatatgtgagaaacaagaagtagtttcttagtaactagcatatatttagcaaaataattaatatagtatgtcaaaataaaataaaataataatctactagtttgtactatctctggcataaacgtttgagtttttactatctttgagttaccactttaaccatagattttactacacataagattaaaaataaaattaagacaaatctacgtattggtactaccatttttatgttcccaaattaagtaatccctctgtttcaggttataagatgttttgactttggccaaagtcaaattgctttatgtatgaccaagtttgtagaaaaataataataacatttttaacccaagacaaatttattatgaaaatacattcaattattgatttaatgaaactaacttggtattataaatattactatggccctgtttgggggagcttatagctgctgcagcattttccagaatcagaagctccccaaacagcctagcttttggtccaattctgagaatctgtagttgtagaatccagaaaataaactagaagccggaagctgggaaacccagctttttcagattctcagaagctggctaccaaccagctgtttcttagaatcttaagcttcccaacaggctctatatttgtctataaacttagttaaatttaaagtagtttgactttgatcaaattcaaaacgtcttataacctgaaacggagggagtatttttaaaattattgagaatcaaaattttgaaagtttgacccaaacattaaacgtaatgtaatctcttttaccagaaaacaggagtagcatgataaaataagtaggaaatggatgacgataacctattcggagatgggggctacacatgcgagcttacccacaatcactttggctaccagtggaaatttctcagtgcaagttcctgctttgccatcgcctttcatgccaggtttgcacggacagtcataacctcccggcctgttcttgcagatcccatcactcgagcacgggtacacgtcgcgaagctcaggaaattgtattcggagttggcactcgtcaatgtctgggcatcatgatctgctgttagtctatcaatataatatgtatgtatgtatatggtagtatcaatatttaagagagggaggtacaaatggttcacaatcaaaccttggcaaccatcagcgatgtatgggttgccatcgtaatgatcggagcacttgcagatgtagcctgggctgctggttgcgttgacgcagaagctgttgctgctgcgacaagcgtagttgtccagcggcggctggccttgcgcagggcaggagacgttggcgatggcgaagtcgagcacgaaggggacgccccttgggtgcttcctggacaaggtctggttgccgtagagatcctccttggtgaagttgtaccagttcttctggacaatcatcccgtaggagcaaggattggacgaccaaaagacgttcttcttgtgggcgaacgtgacggaggctatgcggaggccggccgtcacgttcgcctcgcagcaacccatccccgagcacgacccgttctccgccgtctcggggaacatcagccgcgacgcgcagttgagcctgtagcccgtgctggccagcgacgtggtgagctgcgcctccatgtcccagcccacgccggtgagcacgttgcgcgacgccgagaagacgaacggcgagccggagagcaccgtgagctgccgccggaactcgtggtaggtcccgttggtggcggcgcagtcggtggtgacggcgccgtacgcccgagcctcgccgcgcgacagcgtcacgtccacgagctccacggggagggaccagtagtccttcagagtcacgctgtcgttatcgctcaggtagtagccgtcggcgttcccctggaacggagagtccggcgagccccatgcgaggaaagcgcgaggggggtcgaaggtgcggttgcaggtgacctcgaagccgtccaggaagcatccgggcgccatgccgaatgggtacggtatgctaacgtcgccgcacctgtcggggcagccggcgagcgtgatcggctgcccatcgccgatggctcttgctgccaggatcagcgcttgctgcacgactactgctactgctattaatatcatcgcagccatttctctgccaaagttaagagccatataccattagttttgtgtacacttccccaaactcgccggacaagcgctagctaaatggagtatatagggttcatgatcgaggttcgtgaactttgagccagctattatcttggcttaatgtatcatttgagatataaatatacaggtgacgcagctcagaccatggtggcgtgaagttaacatttagagatttatgatcgtttctgatcattggatctaacaatgtccatcctgctcagctaaatccaacgatgagaaacgatttagtatcgtgagataccgatacctcgagatactttttgttggacggaagcaaatctctagcatttaagcccttccgatatatatggtatagtacgtataccacaaatctactcccaccactcctaaatcttctgctggtgcatgacttaaactatgaatttttttttcacgaataaactacgaatttctagatgctgagaaatgcactttttattgatttggggtacatgtccaatatcatcataattaatcaaggtctgagatattagtgaggttccccaaaaagtaagctagttgatctaagcatgactaaacatttcctaaaccaacatttaatcatatcaattcccaagttatcagttagatagggtaaacaagctatggctaagtacgtaggaaccatcccacttaacattgtaaaataatgcaatttaggtagaaatcgggatatttgcaaagtaggaataatatgctcaatgaggaatgcatgacttgccttgctctggtgctgctggaacctctaaacaacttcaaagtaaaccagagtgtcggaactactggattctacgcgacatacaaagtacacaagtaaaataggatacaagactaccgaaacatgaaacaaaaccattttttaatggagtctagttaattttatgaattttctacaatttgaacggacataaacagagatcggatgagttagttatgaattttagaagaatctctgtgtttttactagtaacagaaaacaccttaatattgatttgttgcgtattaaagcccgaggactgacgtcattggggagggaagccggtgccaataggcaggtcccactggttggtggcgcacggtgtacggtccactggtccggggagtccggggacaggtgcacctagggctggatatcgagccagctcggctcgactcggctcggctcgctccagctcgttaggataacgagctagctcggctcggctcgttatcctaacgagctaaaaggctagctcggctcggctcgtttgaaagctcgagctagctcgtttagctcgcgagctatacgctgccctcctgctcgtgtgcacattcgtggagttggagttgcaaatcaagcaaatggagcaaaaggatttggattttagatgcacatacacaccttgtctacacatatacagcagaagtggttgtcgaccaagtcaacaaagcttgtcgatttgcagatcctcgacttcacccgtcgtgtggaggccgacggcggcgaggacgccaggcttgtggtcctgaagctgtactccttgattcaaaacttggagtcttggaagcggtggatccagttgctccatgaccgagcgaagagagccgagcgacggccgacgaaggcgattgagacgacgaggcaaaggtggagtgggatggctggcactcggcggcgggctggggacctagagcggcgccacgagggcgtgggtttgccggcggcggaggggatcgggagagttttttttcttttgttttttacggaaagggatcgagagagttcggtattgatttggatggtcactggtatagggttgcttggttagtgttggatggagatgggctatgggctttttgcatctttttcttggtggattttattgcgttactaggcttgttgggccaggtgggctacactgtgctgagctcgtttggctcgcgagctgctctcgagccagctcgagctggctcgttatagataacgagctgaaaccttagctcggctcggtaacaaatccaaacgagccgagccgagccagacacgagccgagcgagctaacgagtcacagagcttttcatccagccctaggtgcaccacatgcacatgtggtgcc

SEQ ID NO: 23191 - DNA, 5107 bp, Oryza sativa
ctcccccaatcgggagggccagttattaaccgccgcctcccaatcatccgatctgcccaaagatggatcggggctgtccaactagccgcctgcgttgcagccgcatcggcaccacatgcacatgtggtgccgatgcggctgccacgcaggtggcaagttggacagccccgatctgcctttgggcagatcggatgatagggaggcggcggtgactaactggccatcccaattgggggagagagagaggggggtgggtccaggtgaatcgggggagagagtcaagggagagagatagggtcaccacccacaacgacagtgcgctgcatgtaaccctcacgagcaagctgggttcacgcggtccgccagattttagacgatcagctcatcctagatatcataggaatattcgtttttggatccaacccaaacccacctagtcctccaaccaaaaacatataaaaataggatggaccctcccaacccaccaaattcctccaaccaaacacatgccaagtgttagtaggtgggatggtaaagagatcttggatggagagaaaggccttgagttcaaatgttgcttgagacatatctatgaatatcagttgaaaaaaatcatatgacttggggaagtgaagtgtaaccatataggtgcctaataaactatcaaatatattttttcggtttttttttttggcttttgggtttttctggagtagttctttacgaccggggggcggggggcaaactgaagatgacttgactttccgtgataccgacaaatgacgaagaacagagaagtgctatatatcagacactatcggtaagtttatatatatgattatattcacggcacgcatcaacgacgagtacgtacgtcagttacgtatatataggtttttaacgaaatgtgccctactcggctgtgtcgcctagctggtttcacactgaggtgagctcagatgctttctgtctctactgataatatatgcatgactcgttagtcagtcctgtatagtagtagtatttggagttcacatacactgactgcattcttaattatttttctaataaaataaatcgtgtttctgccataaaagttaaattacaaaactgcatacattgtttaatttggttcctaccctatcttctagtcatgcgtcagggctaaactttttttcaattaaaagaaaagactttgcccggcgaataaagaaaagacttgcccgacaaataaagatattaatggacttgtttgaaagatcgacaaaatttccccgcttgcattgcgttggttcacaccttgtgtttcagttaatacgactcgccaagtcttcaaatatatatgttcgacaggtcaattactcccctccgttgttttatcatgcccgtgcactgggtaatggtagagcggatgaagtttaatctcaatgatttatcagagcactccagcatgatcatgagcatacatgacatagacagtgacgacagaggcatatttctgtattagatttcgctctatgagtaatgtatatggacgacgcccttaatatgtgagcccgatgattatagcatgagaggaattgaagtgaggaacatatgagtaaatattgctatcgcctctgcacaagagacgtctgatggaatattatgcgacaaatttatatctatatctatatctatacctaattaaaaaataagcaagacttctgggtaagaaaactttttcgtccgtccttttctttttcaccgctttcctttttcttttctttcggtttgttttttcgttgtttttccctttctttccgtccacttttttcccccttttttctcgccctttttccatttttatctctgtccgctttttttttcccgtttctctccatccgtctattttttccttcatctttttttcaccttttttcctttttcggttttttcgtcaggccaaaccctagcgatgtcgtcacgttgttctgtcttcccatgtgtttcctactcctattaattacaaaaatcgattcctcactactctctcgtcattttccccatgattttcaattccgctttaattcactgaatttaatctacatttgaaagtcaccttttttatccgagttttgcgaattcactccgatggtgaaacgaaaagaggagatcgagtgtatgaaaactcctcaaccaattttagaagatcaagaaaagattcgatcggatctatttgaaagtcactttttttatccgagttttgcggattaacttcgattttgataaaaacaaaaagaggagatcaggtgtataaaagttctcaactaattttagaagatcgagacaaaactcctcaaccaattttagaagatcgagaaagattcgactagatttgatggagaggatcggttttggcatcgtatgaagagattatcttttggaggttgaagactgtaagttggctatgtgagccggaacactacagctccacttgtgggttaggtctaaaagaggcaagccaaacagagggagatagcgggctgggctaggactgaaaatgaaggaaggaatgagtttttgtccaaaaccaagagtaaaatgtatagcgatccaaaaatattctcacccgttgcaacgcatgggtattttttctagtaaaaaataaagtcaatattaacttaaatagaaaactctctatgtacccctaaatttatccaaaccgttatatgcccataagttttcctcatttccttgtatactctcaaatttaatttggatatcttctataccctttccgtcaattgaccgttaaattcatgtaaaatagtctattttaccctttgatacaaagaaacatacaaattcatagagtatattgttggtgtgtaaaaattttttgtatgagactattatatttatgagtttgttatatgagattatttttaaaatttatgggtttttaagataggagcgctccctgccgtccaatcttcattacacttccccaaaccgttatcttggaagcccagccgttcgttacctgaacttcacttctccccaactactgcttatctctgaacattcgtcaggtcctcacactctgcaccaacgccaagctggccgacagccactggcgctgcccggacctgcacacatgcaaaaatcgataccacatgtatgtatgcatgtaatgcatgctacgctacagtacgtcgagtactgtagtaacgatgcactccaacgtgcacgaatatctgattccttcacgaacacgaacaccttatgaagttcattgcgaagatctcctcacatgtatgccaattggtatccaactatatcacccgatatctttgatcgttttgctttgcttcttcctgagtttagtcccgatcacaccattgaccgaagttgatcttcaagtatcctgactctagtcacattcttacattttttttctcgattgtaccagatctctgctcacccctaaacacaatcccagtcttcaccattatttaccaagactgacctcaataactcacgtgtacacaatcagacaaaacaaccgtttatagatacagatattataacctgaccaacattaatcacacacactcacaccctgggctgttcctagggcccatgaaatcagggggccccaaaccatgtacacatgtatatacctgtaaaaagaatgggccaaaataaaaatactgggcccatcagcccaggagggccggatcgcaggagtgaaggagcgtagttgtcctcagatcgctctgtaattcgcgatttcttcttttcacgaaacgcagccccaaacgtcggcgccgacgccaataatggagggggagagctcagttttgtggattcccaagaaatttgtctttaatttcatcgatatgcaacagatcctctcaaaattccctcataacaaagttgtatatatggtacttcctcaacttttccccatccttcctcctttcttatctcatcgttcctgaatcaggggcttgttgtagcttggctttcgtttgttcgcaagattcccattagctgttgtcaaaagaaggtgttcagcaattctttatgaacagtgttgaatagaataggaggagaggaatactgcgtaacgcggattcattgtattgaacctcaggggccggtatatataggttacatggattggatcttaagtaaactcagagagatagagatggaaactaatcctatcctaccataacaaaccggatacaatacgatcctatcaatatactctaacatccccctacggtccaagcgtgaacagcgcgggcacttggactggagaagaaaccagcaagatgctcaaaacggatgatagccctttgtgccgtagtcgacgtagccaaaacaaagggtgcgagaggacaacacagctgcagctccatgctgatgcagcggcaagaagtccatcaatgatgtagccacgctgaggagggtgcctgcaacaaccagtgaaggtgtggaccacaggcagcggcactgcggctcgaggggggcaacgcagcggcaacccgaagcttgatggcgtagtagatgtgctcacagacgatcaattgcagaaatcatcatgtttgtgtgcttgatcgggtgatcaggccgaagttgcacacagcggaatgacgaaatcgaagccggatgccgatgtcggagacgcatagatgtcgacgaggcggtgggcgacgcagttttcacgttacgcagtatttctctcctcctattctattcaacaaacagattagcttggttctcggctcaacccctcacggcccgtttggttggagggagtttttaggagggattgggagtttagagggatgaggctattaagtgttttgtttggttgggaaacataggaattttggtgggatggggatggggaattgaggaaggaactccctccttttcaatacctgggtaggggcaggtaattgggagggaattcctcctttactttttctaagcaaatctcagccatccgtttttattaatgacctaatctccaactaaactccctatcaatttccatcacctctaccaaacaagatattagaattaaaaatcaaattctcatcttaatttc

SEQ ID NO: 23192 - DNA, 7300 bp, Oryza sativa
  unsure (1)..(7300): unsure at all n locations
gtactaatgactaatctctaaatcatatctttgcacctattcctgttcctgaatatgctattcccttctcagatgtacggctgaaaatttgtagatctgaaggttccaggttctttgatctctaatttctacctattgtcttctttgcctagaaagtatttatcaggaagtgagaaaaggaaaaataaagaaaacgtgccgatgatttcatagaaacacaaagaggatccattgacaagttttttagaagtagtacaagtttttgtgtggaacaacctaatgatcatgattagatgaaatcgcttccggtaactaatgtagccatgagcccatatgatgtgaccatggctactatagatataaccgctgctcacaccaagataaagttgactaagttctggaatccaattcagccacctgctaccgtgctgaatttaaatggccgccaaatctgtatacgagctatgttttcggtccgtgagtacttgatggaaagctcttgtaatcctctttccagcggatccggcctcatcactaaatttcattcccgtcatccacaatcatagaaaaaaagtgttgcgtcgcttatattggaccaatgggcttgtaacttcgtttgaggtccatgtggggtgcgccccaactaggtggagcacgaccttagggacccctaggtcgtcctctcacttttataaatagctaggtaccccttcaaggtttcttgggttttgttgagattaaagtttagcttcgctactttgccgtgtaatcccgtgatcggttagatcgtcggtttgcctgttacgaaaccccggcttatcatttgtattcaattcctttttgcaattcaaattgctttcatcttgttattgtttgttttttcgatttgcttgcaggaataaggttgagtcacaccaacatcaacacatattctcaaaccaatttcattgaataaatcatttgcaaagctaattattcatcacaaattattaatcatgataatgattttacaagggtgacaacttcttgtaacgtgacgagcaaagcctccatttgctctattgcaattgttgagaggcgaggtatgaagcagtcttttaggcaattttggtcgactgaatgtgtgtatagtgcttcgaagcgtaccaacagggtattgtttcggagccaattgtccctgcagaaagaaccatgtgttccaacccctacttgtaccctcgactgttgttgggggataggcagtagcttcattctgaagagattgccagtgcggtccatatccaattggcccaggacgattcagtctgctacagatgaaaaatcctcttgattagtaattcattttgcattttgagatttttttttattccccaaaccccctgtccttcggccgacatacctgttcccaagccaccatgcattgcgagcccaaacatgtgtcttctcctggccagaggaacactcttgtctttttatccactgctaatcacactggccggaagactgaaagcaaacatgtcaaaatttttgttctcatttaacacccgagcccacatgtcagcctctttccccattcgtacaaatgagatatggggctgggtgacggaggaggcagacaagtgagcccggatggcaaatgagaatgaaaatttgaaagtgacatttgagcatgtgtattttgggaggatggtaaatagtaaattctcccgcaatcataggttgcagatcatgttagaattaaatgggctaggcccaaattaattctagcaaccccaaagatccataattaatgttaagagattaataccatcttggaaaccaacgagaaagacctcaacttaaatagattgctaattgagaacatctgttgattggttcagatggtggttggactgccacacgtgcatgcgccgagctgagccaaggcgagtcgaggcaaaagcataaccgttgggcatcaatggtgaagttactccggtaacggacgagaccataatgcgccatcaatcccataacgttatctcacatctccggggtagacagagggtacacttcctctattccatttcattggttgttcttctgttcttctcggttttgagtacctgcgtgcatgggtaatcgaaatgagtagggcctccggaactccgactacctgagtattttctacggtttgcatcttttccatttgaatcccaactccatagctttttttgagtattttctcccatctctgcgaggcatacctgagagtgccacccttcttagatctctttaggtatttctatgaaccgaggagacggatgccctttcctttgcaccttgcatgttcaggtacactcatgtcaacttcttggccacacagaagacagattctctatcatttccggtgctcttctttgccgagtttgacaacgagaagaccgagggtgaaccacctgtcttttgttgcaaggtggatatgcaactaccttgtgcaggtaattaagctttccatccatacatgttaattatgtatgcagataatttggaaagcatgtgtgttaaaaacattggtaatgttgagtacaataccaccaaacatctaatgactttcaaatttactcccaacaaagtagtatttacaagctaatggcatgcaaatgtataagataattatgattaaaaagttatttattatctacatggaagtgataagagagacaaaagacagaataatcacagagaaaatgattaactgaaaaatgcggtgccatatttttttagcaaacctgataatgataatagatatttcttttaggaaagataattagttatgctccctccctcgaactgagatatttcctgtgtattcaatcgtatacacgagggttgtcttctcctctgctctatctcctagacaggtatgaaagttgaattcgaaaacctggaatgagcgtagggatatagatccttcaacccaagagggtatgtatcccgtagcgagtggaatggaaaggttttggtttatcagttaggtttgtacacttttcctgtccgttaagggaaaggtaagtagtataaactaggatgaacccccaagaagttttggttcatggtgtgggatgaatatggtttcaagggcttaagctatataattaactagatgatgccccgcgctttcctgcgggatatatgttagataatggagaaataatgaaatgatttggaaatgataatttagcatgtgcatgtttaattttaaaatgaaataaattttagatataattagtatatacttttggttgcgtgcctatgggcagaggccggagatgtaatccatttccattatctaaaaaaaattactatatgcttgcatgtcgagttttgtgtgcttaatgggttgatatggcatgcatgcatgtagcttttagtagtgataataaatactatacttgtgtgttgagctttaagtatttagtgagcattaagtttataaaaagaagagattataccccttattcatactcattagtttttcgattcctttcatatacacattagataagtcaaagtcacaattatattttcgttgctcaacaattatttttagaaagtcaatacaacgattgaattttccgataatccgagtattttattttgaacagaacatgtccggcgcctgtattgtgaactgcaaggagcaaaggttgtgcatccagcttttcaaaaatttcaaggtggagacaaagaattcgaggaggctatgtgtgaaaaacattctcatcttgcaaatgatcaggttttgtgccgtaacgattatcatgtcctgagcctagctaggtgggcatgacgaggatttcatgtatgtggatactgtagcctctgaatgccctccttttgcagatgattactgagatggagtttactaattgcactttgcaaatattaattgatgcaacatttccttgagtatataacagccaagctagcatgaactccttgagtgtataacgtcaatgttaattagcatgtattatagttcaaaggttttttctactgaagatatcctatcttagtataaagttatcccccactaactccttaagcttaacatgcaaagatgctacaccatcatccactaacaagatgccacatcatcatacactaattaacaagatgccacatcatcatccactaacaatcatcacatttaaatatcatgcaaacatgctatatctttatagtttttataatttaagagcttttcaaatacaaacatgttaaattatcatccagcataattcatataatgtttcaatgcatatatttattatgttttatgatattctatggtccaaattatatttctcattttttcctctaattcagttggttttagcctttagatgattaatctacggtccaaactatctccctacttttcttcttccataaagtcataccaccttactttttacgtttgaatcatcattttacatactatttaaatttatattatcataaaccacattaatttacttaatctgatgttatctaactatcttacacttttttttattgttatcgtactaaattcctgcagcaatacgcggggtttcacatagtaacacaaacacttgtgtcttttctgccttttcctaattacgagatcagcaatttcaccattttggctgtgtttgtgctcaagatgccaaatttcaccatacaaatcaggcatttaccatattaccatccatggtacctccaaagcatgcatctttttttttaacaaaaatataaacaatgtacatgtacattaggaaaaaaaaacttgtgattgcaggttggcaaatctatcacataagttaaatgccctggtcttcaaaatctcccccatacagatcatggcatctgtaatttcaaaaattctgaacatattgattactattattgcagtccaaaatgaaatcatatgaagaaatcagatgatcataggcaagacgaaacggtggctcgtcagtcgtcaagctgtacgattaaactaatagagtgatgtgtatttcactttcatccctttagcatatacctaatgaagattctctaaaagccagcagatagatagcctggtaaccacagtatctgcccatgttgcttctcttttatatatatattgtccatcataggaagtgatgaatacaccgcatctgcataaaaaccacgtcaggattcactataaacccatatatgttgtgccaataaagtgcaaaacaactgacaaggcacgcagtaatcctgcaaaactgtgtgtgtctgattagtggagacactaacaataatacttgtatcttcttcagaaaccattcaatctcaagcacacctggatggcatattctctcttcaattttttttttcagtcttaaagaactctacttaagcagctgaacagatttcaagaaatacagactagcttgagttatcacagtgcagtgtagtagtgatcagccatggctgttgcactcgcgctcttggctgccatgtcggcgctctcgtcgtgcacaagtccggccaccgcagagctcacacggcacgagcacccggtggccgccggcgcgccgctgcgcctcctcgtcgtcggcgactggggccggaagggcggctacaaccagacaagagttgcagaacaggtgattttgctttctttgcatcaaacattcattcaacaattcaatcagagaatgttaatttgttggcaccgatcaaaagaagaaaagagaacaactgtatatcgatcagagaattttgtttgtttgtttgtgaggagttagatggggaaggttgcggaggagacggagatcgacttcgtcgtgtcaaccggcgacaacttcttggagaacggcctcgccggcgtcgacgacatggcgttccatgactccttcatggatgtctacacggctcagagcttgcacaagccatggtaccttggtaatcaccatctaaacctaattaatttccatttaatactatactattagatcatatggatttataaacttactatgtgtttagaactttttttttctttgacatggtgtgtttctacaactttagatggataaaacaagtcagaacaaaataaatgatatttacattctccttaataaaggagaatggtcgaatgtcccgttgaaaagtcaatatcattatgtatttaaaaagggatggagtactaactaaaggttatcaattgttttcagttcttggaaaccatgactacaggggaaatgtgctagcacagattgacccagctctgaggaagatcgacagcaggttcatctgcatgagatccttcattgtcagtgcaggttggttaacacatcaaaacccacaacaaaccttgtttcttttctcaacatgcagcaattaaaatctgtgttcatagctagaatctttgcaaatttacaatggaaatcttttctgattaatactagaatccactgaacaaatttataatgtccttttttctgtaaggaattgtcgatttcttctttgtcgacacgaccccgtttcagctccagtactggactgatcctggagaagatcactatgactggaggggagtcgcgcctcgggatgcgtacatcgccaatctcctcgaggtcagttcctctgatcaatatccactgcaaaaacaatccgctcgttgcatcagcaaaactctgtaatgagatgactgtctatatgattgtatcacctaggatgttgatgctgcaatgaagaaatcaactgcaacatggaagatagctgtaggacatcataccatgaggagtgtgagtgcccatggagacacccaggagctccttgagcttctccttcctgtcctcaaggtaacactgataaaaagtagtactttaatcttctaccaattggtttcgcatatgagcattcgatgaaatttacgatgatttcacaggaaaacggtgtcgatttctacatcaatgggcatgatcactgcctggagcacatcagcagcagaaacaggtgagcacactaataccttgtgacacaatagaggaaagaagggttcaagaatcttatgttcttcctcctctcttttcagtccaattcagtacttcactagtggaggcggatcaaaggcatggagaggcatttttcaacaaaacgaagacaagctccagttcttctatgatggacaagggttcctgtcacttgagctcagtgagaaccgagctcgattcgccttctacgacgttttcggtgnnnnnnnnnnnnnnnnnnnnnnnnnnnnnnnnnnnnnnnn

SEQ ID NO: 23193 - DNA, 6849 bp, Oryza sativa
gcacaagctgtcgattgtgctggattgtagcttcaatatccttgcactcccggcgatcgggtaatctctgtctggccttttccagcttgaattggtgttgctcaaggtagatggctagagtaagggcatcggctagttcatccgggagtagagcttggatatctgtgaaccttgcccggatcgagccacagttggtcaccaaattgtctagtgatgcttctagccgatgagagatatcctcaagcgttctctttacatcatcagacagaggagctatagctttactggtggtgtcttcctctgtttcatcgagataattcttgatatcaaatgagaacagatcggctaagacctgcaagagataatattgtggatggttaaggatcaaaacatgattggccgatctcagatttgtatcaacaaaaacttactggaatagcaggggcagctggttgttcttcctcttcgacgttgtggctgtctgcagccgatggagtacggttgcctgattctagctgcacaggaggtgaaggaggacgaggaggctgtaaaaaggacaaatgttagacataatcggccgggatcagttaatgagaggattgagaatatcttactggtggagccggtttgagagttggtgctaccgatttcttcttcatagcagttttcttcttctgtaactataagatcagtgagcagttggctataagtaaagtgattgcaaaaggagcagaggagagctgcttacccttgaaaaatgagtcggagcagaaggagttggaggagtttgcttgggcgaagccaatggtgttctctctgtatcgctcacttcagttgcagcctgatcaatatcatcttcaatgtcttcttcatccagagcttgttcgatgggtggatccaaggcaggcaggtcatcagctggcttggttttctttgatgtggttttcatcttgggagccggagctgatgtgtccacagccgatgacctgttttttctttccttacctgcatcggctggttccctgattaggccttggaggagggttgaagtaatgggggcgtgatagccgatgacagggggagatggtccacctccatttggaattagacctggagcatattcaatatccttgctactgttgatttggtgaggaggagaggattctgttgtttgcaggtcaaaagaaaagattagtcaaggttcaaatcagctaccagttgttcgagcaagattgataaagtaaagatttacctgagggataacatcagggaacagatctattatgttcatggaagctggttgatggaagatatgttgtttccattcaccccaccatctgtcaaagttccagctcctgagccttgccagctctatgttctcaatactgcccaaggggggtcctgggatgttgagtagccgatccatcatcagagttgatgaaatttctcctcggcactggattttgtcagcaaagaataagccgattgggagttgtcccaatccaagttgtctagctgagctcattgggtggtaaaattcataagaaacttggatgtttctgccctaatgaatgccaacaagaaggatgcatgggctgattgcagccgtaagaacttccctggatttctggtatttttcatgattgatatcttcaaatctgaaatctgatggaagttcaagatctgctgagtcctcataaggaaaccaaacccgggcatctttctgaaagccttcataaaagctgcagaaccaatccttaagcagctcagccgacaactttgctccagcatcagttggcgtatatgcatattctccatatgacatgcatctacgatgagtgcgttcttctccatcatcttccacaatcggctccaaccttgggaattcagcttctgtcacagatggttgattgacaactttcataactgccaagtttagccaggtttgcagcaaccaccatggtccacctgccccaactactgagccgacggctatcttggccgatgcattgttcaacatttgatatagatagccgaggaggattttgcccaagggaaattgtcaatcgtgattctagggcttcggctacaaagtgccaattggttgtggggccacagcttgatccacaaaagaggaatttctccagccacatcagcaaaaaggctacatgctctcggggagtgacaagccctttacccatatatgctgctacgtaactagaccaaccacctatgcttttggtcctgaaatcaaattggttcttagtgttcaagctcataggattggccgatgaagttacatctaatccggtgatcatagtgatgtcaatcaaagttggggtcatcggcccttggttgaataggaaggcgttgatggtgttccaccagaaataggtggcggcagccatcagggattcgtccttagcggaattggctatggtgagggaaagtgattggttgatcccgatctcatcccagtgaactgccttactagccgatacacgcttgtaccatgtggtccaactcttctcaggggtagttttctcaagagatggccaagatttgaaggtattcttccagtgacccagattaaggttggctaatctaaaggggattctgttggtttcaccagtgatgaaatcagtagggtcaaggttgccgattggaccaagaaagtagtggttctcgtgcgacagactcggaatcgcaaccagattggacatatgctacagttacagatggggatagagaggaagaaaacaagatgaggtgagagaaaatcaatctgctacaaaagaaagggatctagccgatgggtacttacctctacgtactcggccgatggcgcggtggatggatcggcggaagtcgacattgccgggggcggagatctaaccggggacggaatcgccttgaaatcgctggtgcaccgaggggatcgctggagagagagagaaaacgtggcttgcttcagtggtgaaaacggaggaaacggtgtgaagtttctcgggggtggcggttagtatttaaagggctagagtaacggtcagaaaacggcaagtgcgatattcactcggagtcgatatatggcaaatccgaaacattatcaaatattccggacttggggggcatgtgttaagaaccagatttggtaatatcagcatcggaaaagaagattagatcgaagtggaatcgaagacgaagaacgttgcggaaacagagcgagaatcggctgcaatccgaatcggcaacggtcaggatcggcagagttcgagtcagacagggctagccgatacagccgattccaagaatacgatttggtgtacatcatcgggttgagttgatatgcttcaagatgattgccacgcatggatagagtcctgagaaggcaattgtatctattaattaggatattttatgtaatttccttagagatatgtttgggcaaaagtctgccgcaaagacttatggtatcttggagtttgttagagataatagtcatgtccggtatagacatatcttgtaattctcaggtataaatagaccccgagccctatgtaataaataacacacgttcaatacaatttcggcgcatcgccacccttttacttttgttttgtttcgacgggttcttgcttccgggttgagctgcatcggtttcgatcttcaacaagaggtaaaacttgttatggcggcttgtattctcgggattagtgcttccatctttatgacactctaatcttgtttatgtaactcgccaagttatcatatatcttgtataatctttggtaatatcgtcatctaacctacaatcggctaacatctgttggtagaaggcggtcgattaggttaaatagcgatattagcttggattgtataaagtatctaccactctatgaaacatccagtggcttgattgtctagatattgttcttcttttcatacttaatgctgcatcagttgagtttgatctattaagtcgtgcttagaatatcaatctctagcgtgcttcctggttgccgattagcgtagcatcggggtttcagccgatcttaccttatttaacttcttttaccttacatgcctaattgatatgttaaatccgccctttgtgttaagatcttgatgcatttaagtatattatgcttctatttgatatattctacttgcttcaatatcttaatatgaagtggtatcggagtattagccgatacatgctagatctatctgatcggctatgctatgaacgtatatagttctgtcgttaatttatatttcgatctaagtgatttatactgtctcggcatggcgaccgatttatcccaatcacttgatttaagtatatatcgacataacagttatatattgttaatgtctacagccgatcgagtagaattagttctttcttaattattcatgactgccgatcgatctacacatgacatcggcctaaaataaatgatatgtcatcggcacctagccgatcggctatcatttataagattaatcgcggtttctttgtctttatttattgttgattgcaggatcaaatcaactggcacgctcacacatccgaaggcgagttttggacctgcactggagttaagcagatctcccaggcctcgtgttttctgtcaacaaaagtccactacccttggcctagttgtccccatgggcaaacccaaataagtaaaaggcattgtgcctatggtgcacccaagcagaccagcaaaaagcactgcattctcatgagataaattgattgggtagagacaggacttatggtaattcactttgaggccagtagaatgtgcaaaagaattcaacaatgccttaaaacagaacacctctctctgcaatgctttgagaagaattgaagtgtcatcagcatactgtattattgggaaacccctctcatcaagttcattaattgacttggtcaacagacctaaggagcaagctttgttaactattctctgcagcaactcagcaccaagaacaaaaagcaatggtgagagtggatctccttgcctaacccccctttagcatttaaaaaagtttctaggtaccccattgagcagtactgaagaatgtgccgaggaaaaaaaatcatcttatccactgcagccacttttcaggaaaccccatacatttcataatggatatcaaggtagagtgctctatagaatcaaatgctttctcaaagtcaagctttagtaatattatttctctctttgactgctggcattgatggatatattcaaaagaccatgctaaacaatcttgaattgttctgcctttgataaaaccatattggttttgatgaaccagtttgggcattacactctgtagcctatctgccatcaatttggttataaactttaaactgatgcccatcagtgaaattggcctgtaatcatttactatttctagagaagacttttttggcactaagtttatgtaagacatgtttatcgactgcagatcagtatagcaggcatgaaagtgagctgctaacctgtagaagtcctgtgatatgatttgccaacattttttaagaaaaaacccattaaacccatcagggccaggtgctttatctgatagaattaccttaataagattgtccttctcctgagtgtagaactgatccaccaaacaatccaagttttccggattggggaaaagatccctcaaattaaagtccattggaggcaagagagaaatccccattctgtttttgaaactatggaagaacaaatctgctttgtgattgtgaccagtgactatctgcccatgctgatcctgcacctgagaaatggagttcgatctatatctttcagtagcaatggcttggaagaatttagttttcctcacccaataacatccacctattcgtgcacctttttctccaataaagccttttaaactcaaggagcttaaaaacctgcattttgaaacaatttctctgaaattccattcaaggatggacaagggcctatgctcttctattaggtctaagaaattgatcacagtattacaattaaccaaaagagcagttaactaagacaagtttttactccaatgcagcaaacttttcctcaaacattttaacttgaagctaatgcattttgccggatcttcataaccagggtctattgaccatattctgctaacaagctcaaagaatccttccatttcaacccaataattctcaaatctgaaaattggagactttggaatcttggtatcaatttgaactacacagggcacatgatctgatatattccgggtcagggagtggacagtagtgtttgggaaaactaaagtccaagctggacttgtaaagacccaatcaagccgctccaggaggagactggtctgcatattgctctaggtaaaacttcttccttttaaagggatttctagcagaccaagagaactaattacatcattaaaaatgaatatatcgttcatgtcggctcccgacttatttctgtcctcaaccgatcggtataaattaaagtctcctagaaaaatcatgttatccattgtcccaaaagagatatttttcagccaaataacaaactctatacgttttgggccactacatgggccatatatgcaagttaaggcccaagcttctgaagattgccttcaaacaaagtttactgtaacagaaaaactgtttatttcccctggggttcctaaaaacactttagaggtccaaaccgctaagattccccctgaagcaccccttgagggcgcatcaaaacgcttaggagcagaagtcctaatatcagccaaagagaaattttgttttttggtctcttggacacagaaaacctgaca

SEQ ID NO: 23194 - DNA, 16577 bp, Oryza sativa
aaaatgtattatgtttataaaaagtacattactaatacacccaagtgtcatctggaatccatttaagataaattgagccaattaaaataataatggactagacagacttccaatgctgtgtgatgaaatccactcaatacaaaaacgaagcctaattaataaggaataaacatttccagcactgcatggatgtttatatccatcaagaaatcgaggaagtatatatgatcaaataagaaaccaaagacaatcttgtactgttgttatcatttcatcatgagactttttaaaagccatcctcaccttgcaaaaagaaagctaatgttgtctgggacttaaattaacaattagctgaatagttactcatgcaaacatatcaaaaaacttatgtcagacaaatgtgtgagatctgataaatcaaaaagaagcccttagctgtggataatctgtatcaaattggacttgcattcgaacgacatcaggctataatttaaaataaaaacctgcatcatgcatactacagtctaatgacacgtgtaaattgtttggcatttagttcggtacataagtattctatgaaataagttgaccagtgcatcatgcagtacaaaaagtttaaaaatatttcacagctgggggttgtagcgataggttcaccagacaaattccacgtcaaaataatagtaacatataaaaaaattatacatgtttaaaacccatcaggcaactcaaatttaacaagtagtttttattgaactaaaagaaatatagtttggaccaccacggaaaactaagacaaagcaccacctatcgaatcagaaggtactagaagattttcacactttgatcaatggagaagagctactaattaatagtaattagtaaattctatgacacaaggaccttttacctgtttagcgtattccactgaattggaagatatggagcaaacaatggcttggcgaggactcaaccacaagggccatttaccattgtaatgctccaaaagaatagcaaacatcctttcaacagaacctaggattgccctgtgaatcatcacaggcctctcaagtttggcttcatcctctgcagagtaagtcagcttgaagcgtaggggcagctgaaaatcgagctgtaacaggaaatgaagtttagataaataaccttctattctgtctacaattaaaaacaaaatgacattcaatataacctgtagagttgcacactgaaatttcctcttgagggcatcaaacacaccaatatcaatttttggaccatagaaggcaccatcaccttcattgatctgcatgtagacatctaaataagtacaccaataagggataaaaaaactgctaggaaacaaccagtaatcacaacttgcgagccagacttcaagattgggtattccgccagtattacatccaaacttcagattgagaatatgaaattatttgaaatttaaaaatgacaggaaccagccaattgagtcaaagaagaataatctctcctaagatgtttactgaaaacattaccactaaattatatttctatcaatattatccggcataaagaaatatatttgtatcaatagaaatcagtattaaaaaaatatatttctatcaatagtaatcaacatacagtacatgttgttaccaaaacgacattagagttaagccaaaactaaataaagcataataccttttgacaagactctagtgataatgctgagtgcaggtaaaattaaaaatagtggaagaaattagtgcaaactctcgttaaccatattgtgaaaataatgaatgttggaaatgcacttctaatagcatagactgaaacaaacattctgaggggagtgactgtcatagtacctgccatggctttccaaactcatttaaggcttctgtcagctgttgctctgctttgttccaggtttcaatatcacctaagtacttttctggtctctgcaaaaaaaaaaaaaagagaaagatatgcaacattacaaccatgctgaggatcaagccataaccatcagttattcacatattgttccgtaggatgctgagaatttcccaaacattagcagttcacaatagtgataggaaaatgggaaaacaactacctctgtccacaaatataagcatttctaggttgttcagcagatattaaggttgaggagaaagactttggtgcccctcattaaaggaggaatggaacaattagtactgtggaatgccttatatttgtgaacaaatatcaaacacatggaatgcttatatttgtggacagagggagtacatagatgcaaaatacaagtaacatgttcaacatctggcatgcttattttctcagcacatgtccaaagcccacatacaatgataaattatgattcgcctacaacgattgaaattaaacaaaaagtatgaaatgatctacgatgccaaaacagagactagcaggttcataggcctttcataaacctcaccaacctcaggttcacaatacacagtgcaaaaatggattgtatcgtaccaacatagttatacttcatagccagttcgattttccttctacgttgttcaagaaatgtgcacaggaattccagtaggaccataggagatgaaatgacttgttaacctttaaaaatttgtatagagataacctttttttctcttaaatgcaatcatcacaaagttacctggtatgttgggatttaggcaggagtagacatgggaagcagaaatggtaaaaagatacttaaccaacttcatccagattataacagcaacctaacacttgctaagcatctatttatgtgacttctcgaatacatattgaagttccaagaatcctagttcctgtgaaatttctagatgctattaatcatacagcaacaacgagatgattaccgttgatagctccaattcatatttaaatccaaatatctcgtaaacataattgatgaagtccaaaacagccttaacttcgtccttgatctgcacaaagaaagaactcttaagaaaagtaggcccttatacaatcaggggacactatttaaaattatccgaaccacagggcagctgttaaaaggaggttgtgattaacaccatctgaaacattgtgaaaacaaatgggaatacaaactagcatccatacagtatgcaagtcatgaacatctaaatattatgagcttctggtgcctaaactaatttatgtcacacagtgtaaatacactgttcagtagcatgtcattatgattgcaatggcaccccttccctactaaaaacagatatacagaatggtgcagaattcaaacttacttggctttctctgcaaaaaatatgggcatcatcctacagggaaaatgcatcagaagtggttaaaacaaggagattactaactggattgaattagtatagaaattaacaacccacaaaacaacattagcattacctgctggaatcttctaacacgtgtcaaacctgtaagtgcaccactaagctcattcctgtgaaggactccaaaatcagccatccggagaggcaattctgcagcattttaattaagttgttagtgttaagaaaaaggttgtcaaaacacaaaaacacaacacatcatatataaaattccccttgctataatattagaaaagggaagttcatcatttatatcaatagcaaaagccaatagttcaaaatgtacatgtggacaacaatttcagtactacatcattcaccaaaaaacaattcactaagtaattctagagccgttacttttgccgaattaggaatttaatttaggggtgggcattcggttcagttcgtcggtgttttgaaaagttcggtcatctgaaaatagagaccgaaacacattggaaaaaaaaatgaatactgacgaattcggtttcggctagttcagttcggtctccggttgtgaccaaactaaccaagatattacaactgctgttttacacatccaaaaagaaatcatagaatactcaaatcagccacagaatcaactcatataatcccaaaatcagccacagaatcaacagaaatcaacacaaattagatctatgcacaataccctacatagatgaagttcaaatcaacacaatttggagcaaagagcacgagatgtagccagcgggcatagacgtgtccaccaatccgctgccatcaggggaccatgggcagggaaccgcatgttcacaacggtggcgacaccagtgttccccagcaaccgccgccttgagctctccggcgtggcagagcaccgagagcctccttgagatctctggtgaaggtggtccccactgttgatggcgtggaattgcggcaacggaggcagagtgttgcagagacagcagcatgctgtgggggcacaggcgggagccagggcggggcggcaacagcagcgtttgccgtgtgtgggaggagtcggggtagtggtaggagaagtggggactggggagttaagagtggggaggtgaggggaagttagggttttctctcttgggctgaactggacaaggcttattgatatgtttcgatttctcaattacccgagcctaataaccaaaataacaggactaaattcagttattgagagctgaagcccgatatttttactggattccagtttgggtcatttcgggttcagttcttcgtcacggttaattatgcccacccctagtttaattgccagacaactaaggaactgtttttgctgcctacattttcagtttatgaaaattttaatgagaaagcacaagccactagataataaatgtgcatgcacaatatcaaagaaatagagggagaattaaatcatagaagaaaaacagttcatacaggcagaaggttgaagcgattactttgacagcaggaattttcacttgataaaagagatacattttgtgatacaactatgccattatgaaggagatttacctctgtatgaacgaaccctgtgctcaaacattaggcaatggccaggacaattcattggcttgagaccaaattcctgtttctcaatctgcaagaataagaccaacaagcacccagtaataaagatcgtaattcatccaaaatgtaatctataatatgtacagagcaaatcctctgcacactagacttacctcaaaaacaaacatattctccttgtagtttgcagcatgtccagaggtttcccagagttgcatattgtaaatatttgggctcaaaacctgaaaatacagacatcatgaacagagagaaacagtggaaatgcatgcccatgatctagtaatctaatcataatctgaacaaaagattgaccagccaatcaaattaatgcccacctcttgatatcctctatctctgtattgctgtcgcaaaaaatccatcaatttgttgtatattatagcaccatgtggaaggaagaagcagcttcctggactgcacagtcaaagtgaatcaaacatcctgaggcagaatagaagccaaggtaaattaagatatgaaaaagtcaaaccgaaaaccttgagttacctaagttgatggaaaaagaagagatcctgggtctgtcctaatagcctatgatcacgcttcttagcctcttctagcagatgtttatattcctatggattattgagcaggaaacatatatgaaaaccatagtgtaccagtgataaaacaaatggataaaaaagaacttaggaattagtaacttgtaaaatagctgacaagggttgcactgtctgaacctaaccatgtattaattgaagaaattcgtaataactgactaataaaaagaaaccatatacttctgtaatgacaattgttgttcagttgggcaaatcaaccccaacctccaccaaagcacagagcccatagatacacttttgagatatagttgtatattttgtgcaatttacatgccatgtagtgcacgctaaacttcctgccaaatcaactccaatcttatcacaatgaaatattaatactctagtgtctaaaatgcaaacatagagggtacattattgtgtccagtagcacagacatgatagcacaaaaacagactccacattaattaatgaacgcccatatctgaacaatagccaaaatcatatgctataccttgagacgtttagaatcaggaaaagaaattccatatactctctgcaggctctctcgatctgctttccctctccaatacgacgatgatgcctacatatttacatgcaagtacaaattggatagttccataaaaatattggcaagcaaaagcttaagacaaccaaagaattaccttaagacaagcaaaagctttaacaaaggaagtattggggatgtgtggcccacggcaaaggtcaactagaggaccacatctgtatactgtaatggtcttgtcttcaggcaactcattaatgatttcaacctagaaacacaattcaaacaaataaaaaatttaataaaatctcaaatgtgatataagcagaaatagatatttagggcctcattaattcgcttatgcttatgcttataagtcaagttttgaaatttagaacttaatttaatttaatttttttcttgtttctttcattatagtttattttacagcattttcttttgagtcgttttagtcacaaatgattttttttgtttgttaataagcaattcggataagcatatgaataagcgaaacaatgggactgttagagtacaagaaaagatcaagaacaagcataaatcaggaattttgccttaaatttattttctgcgaacatttcaagggcctctgccctggagacctcaattcgttcaaatggttgtttttcctgcaccatgttgggttaaaaaccaagagttagcagatagatgattccaattacgttacaaagaaaacatggcataatcatggaatccaataacgatatcacacttcatgacagattaatatcaaataagtcaaagagtaaaactgctaagtagcgtccacaaaaaagggtaaacacaaactttaaaatgagttcaaaataagagcataccgcaacagctttctgtgcttgggcatcaatgataccaaaatgtgtctcattcaatgtcagatcattgtagtaggcatcataatagaaacccttaacaggtaaaagtagaaacattatgttaatcactaagagggcttattatctttcttgcactgaacacgatttttgattaattcaatacctcccctcttgtagtacatggcccaatacacagcttgcagccatatgccctctcaagagactgcaaaagtgcatcttcaattagaaaatactgaattcaaaaggacttatagcagagagacatgcaaaatcactcgatgtgtaaacaaaaaagaaaaagagacaaccatacaacttgcttaaagaaaaaaacatgatacaaggaaattatgaagctttaactcacttctccaagaatatgagcacttgagtgccagaaggtgtcacgcccttcattgctatcaaacttgaacaacttcaattcacaatcaccttccagtggcctcgtcatatcccacagtgttccattcacttgagctatcaagcagctatttgctaatccacttgatatctccttagcaatatccataggggttgagatccatttctttccgtccttgactgcaccatctggcaaagttatcctgaagaaagttgcagggaaaaaaatcacatgagaagaattaattgccattgccattgtgctgcacattgcaggtcacagtgtgccacatttgtattgtaactagcaaaggtacattgagaaaaggaaacctaagcaccatataatcaagggttttctatattagaatatttaggcagaagaaatgcttgccgtctctattttcttattaaagacagatggatgttaaagttgaataacattatggcattattatgcagtttgcgcagcgcccattttgtcgtcgcatcgacattcaaatattcccaacactcaaaatccgactccaaattatgcagcacaaagcatggctatcgaggatattcccttggtgtgctatatgcctatatctacatctcaatgcctgagacatctgccatccatgtagtatctaactccattttcatctataacgcgccgcaagcattacggtttccgaatcaaagccctcccagtttcttaactacatcaaattcacaacgaatcgcagaacggggctcacctgatgggctcgcctccgatgttgaggcgctcgagggcctgcttggcctggatctcctcgaactgccggatccgcttctgcgtcaccgcctcaaggtaggccacgtcgggctcgacgttcggtgccgaggccgaggccgaggtcgtcgccttccccttcgcttccttccccttcccggcggcggcggcggagttctcccccatcgccgcggcggagagggggcggagggaggcgacgcggggtgggctgctgcgcgggcgcgggagaggggggaaggggcggggcgggcgctgccggaggagcgagaggcctcgtcgccggaggcagacgagcataaagtggcggcggcggcggcggcggcggcggatggattagggtagataggggtttgggccgagccgaagagggttttgatggttttgggcgtttgactcccctcggtgggatgacgacagcatgggcaggtacggtagaattaccgtgggtgccaaggctgcaattggctaatcgccgtgggtgccaaggttgtttgcagtctaatttgtttttttagaagcttgggcgcttggcactgccgctggtcaagtttgcgtttggcacctcactctgatttgaaaattgtatttgggatttttgttatgctttaatatttttcttacactcgcaaagagataggaatatctataagtgtaattcttaaaaaaaatgtttgaatacatgattatgtgtatgataatttttcaaaggcacaaatggataaattaactacttcctccgtttcatattataagattttttagcattacctacattcatataatgttaatgaatctatatatatgtgcgttaagattcaataaaatctatatgaatgtgagtaatgctagaaagtcttataatataaaatggatggagtattacagagtttaaaaatattgttttgaaaaagtattggaagaaatactaatgaagaaagattttttgcaaaaaaaaaaatcggagcactatgggcttttggaaagtgtgcttactagtccaaattcctaagaatggaaccttacgattctttctcataattttgtattaacgctatagctttttttcgctaagacctgtaaaagttgaattttaacttacgtgtttaaagagtgatatatcacatattaatatatctttctatttttttaaaaaaataatataactatttgggatatcttctcgagagtttagaatccacttctttatcttagataaatgcatccccttccttactcggcaatatagtgcgcgtgtatactatctctctctaaaaacataatctctaagaacttctaaaagaaggccttgtttagttcctttttaaaatttttttaagtatatgaacacacatttgaagtattaaacatagacaaataacaaaataaattacagattccgcctgtaaactgcgagacgaatctattaagcctaattaatttgtcattagtaaatatttaccgtagcaccatattgtcaaatcatggcgtaattaggctcaaaagattcgtctcgcaatttacatgtaaactgtgcaattagtttttttcgttcacatttaatgcttcatacatatgtacaaatatttgatgtgacggaatttttgaaagtttgaaggggactaaacacaaccaaagatatattttctctttgtaaataatatccctatgatatcagtacgttgtttaaagtataaacataatccccatcactatctaaataacaaaggagcagtagctgcatcaagtatctaaaatcaccactactatactgtttgactgggtatattttaatcttctttagtcgcttccaccgtcttgttcctccgcatcaacgccaaaaatccgcacaacgattgatggaggcgccaacactgtccctgctccatctccatgtttagccacctccgtttctgtctcagccagtggcaatgccaccgccgcggcgatggccgccgaagctggagcaagtgtaggcggcgccgcaagttgtccgcgtggcgcgaggagagggtaaggtcaaggtacttattgtagtgctccctcttgtggccgccaagtgccactcctgtcagttactatttcccgcacacattgcacgggtgcttgccctccgtcttgccggcaccggcgccgccactgccgccggcggcagccagcttgtccctgtttgatgtggccagccacgtggccacccatcccctggtgtgtcttatactccatgccgcaaccctcgtacttgcacctgtacggtccacctgatcgtgatactctaggtaaccgagccaggggatgaacccacgctgccgccgcaggcagcggcagcggtggctctcctttctcgttctcgttgatgtgaaaatacgaggcctgggagatctgcttaactccagtgcaggtcaaaaacttgtctttaggtatgctagcgtaccagttaatttgatcctgcaatcaacaagaaacaaagacaaaaaaaaaccgcggttaaatccataaacgatagccgatcggctaagtgccgatgacatatcatttatctttgagccgatgtcataaatgcatcgatcgacagtcattaataagaactagatctgctcaatcggctgtagatattaacggtatatagtccttatatcgatatatacttaaatcaagtgattgagatagatcggtcaccgtgccgagacagtataaatcacttagatcgaaatatatattaataacaagactatatgtgtttatagcaaagccgatcagatagatctagcgtatatcggctaatactccgataccactctatattaagatattaaagtaagtaagatataccaaacaaaaagcctaatatacttagatgtaacaagatcttaacataaagggcagatttaacatgtcaataaggcaaataagataaatgtagttaaatcaggtaagatcggctgaaacctcgatactaccctaatcggcaaccaaagacaggctagagattgagattctaatcacgactcataagatcaaactcaactgatgcagctataagtatgaaaagaaagaaaatatctagacaatcaagccgttggaaatttcatagagtggtggatatcatatataatctaagtcaacgtcggtatttaacctaatcggctaccctcttctgacagatgttagccgattgtaggttagataacgatatcgtcgaagattatgtaggatatatgataactcgacgagttacataaacaagattagagtatcataaagatggaagcactaatcccgagaacgcaagccgccatagcaagttttacctcttgttgaagatcgaaaccgatacagcttaacccgaaaacaagaactcgtagtaaaaagggtggcgatgcgccgagattgtattgaacgtgtgttagtttgattacatggggctcagggtctatttacacctgagaattacaaaatatgtccatatcggacatgactcttatctctaacaaactctaaaataccataagtctttgcggcagacttttgcccaaacatatctctaaggaaattacataaaatatcctaattaatagatacaattgccttcttaggactctatccatctgtggcaatcatcttgaagcacgtcaacctaaaccaacaacatatgttgcgtcatattgtcggatggctcaatcgactaacccagtccgactcgaactctgccgattttagttgtagccgattcggacttcagccgatcctcactctgtttccgggacgatttccatctcgaattccatctcggtttcttcttcatctccgatccttggattaccaaatttggtcgttaacacatgccccccaagttcggaatattagataatgtttcggatttgccatacgtcgactccgagagaaatcctctcgtgccgttttctgaccgttagtcagtgctttaaatactaaccgttgtccccgagaaatctcacaccgtttcctccgttttcaccaccgaagcaagctccgtcttctctctccccggcgatcccctcggtgcacgaagcgatttctaggcgatctcatctccggccagatctccgcctgcggcgatgtcatcctccgccagcccgcctgccgcgccatcagccgagtacgctgaggtaagttctcatcggctagatctccttttctcgcaacagattgattttcctactccttatcccgctttccccttctcggttcttttggatttgtagcatctctccaacctagttgcaattacaagcctatcgcacggaaattattacttcctcggcccagtcggcaaccctgatcctaccgagtttatcatcggcgaaaccaataggattcctttcagattggccaacccagatctaggtcactagaagaacacctttaaatcttggccatccctcgagaaaacttcacccgagaagagttggattacatggttcaagcgtatgtcggctagcaagagggttcattgggacgaaatcggaatcggccaagcgcttgaccttaccatagctaattctgacaaggatgaacctttaatggctgtcgcctcctatttttggtccaacaccatcaatgctttcttgttcaaccaagggccgatgaccccaactctaatagatatcaccatgattaccggtctagatgtcacctcatcggccaactctatgagtctgaacatgaagaatcagtatgattttaggaccaagagcatagacggctggtcaggttatgtggcagcatatgtgggccaaggttctgtcactcctcgagagcatgtagcctttctgttgatgtggctggaggaatttctcttctgtggattaagctgcggccctacaaccaactggcagtttgtagccgaggccttggaatcaaagagacaattccccttaggcaagatcctcttcggctatttgtaccaaatgctgaataatgcatcggctaagatagccatcggctcagtagttggggcaggtggaccatggtggttattacaatcctggttgaatctgatggtcatgaaattcgtcaatcggccatctgtgacagaagccgaattcccaagactggagccgattgtagaagatgatggagaggaacgcacccatcgtagatgcacatcttatggagaatatgccacaccagccgatgcaggagcaaagctatcagctgaactgcttaaggactggttctgcagtttttatgatggctttcagaaagacgctcggatttggttctcctatgaagactcgactctcctggaaaatccatcggactttagatttgaggacatcaaccatgaaagatatcaaaagtccagagaagttttctcgcctgcaatcagtccatgcatcctccttgttggcattcatcaaggaaggaatattcaaatttcttatgagttctatcatccgatgagtgctgtcagacaacttgggatgggacaactaccaatcggtttgttctttgccaataaaattcaatgccgaggggaaatttcatcaaccttgatgatggatcgactgcttaatctccaagggcctcctttgggtagtattgagaatatagagttggcaaggttcaggagcagatcatttgacatatggtggggtgaatggaagttgcatctgttccaccaaccggcctcaatgtatatgacagatctctttcctgatgttatacctcaggtaaaccttgatcttattaatttcatttgaacaattatcagccgattcataacttgactaatcttctcttctgttttgcagagaatggaatcttcccctccacatcaaagcaatagtggtagagatatcgaatatgccctaggtctaattccaaatggaggtgggccatctcctcctgtcatcggctataatgcccccaagacttcaactcttcttcaatggctcatcagagaaccagccgatgccggtaaaaacagaagaaccaggtcatcggctgtggatacatcggctccagccccaaagaagaaggccaaattaaagaagactaagccaaccgatgatctgcctgccctggatccatctattgaacaagctctggatgaagaagagatcggagagggtattgatcaagccgcagatgaagtaagtgatactgaaagaactccatcggcttcacctaaacaaactcctccgactccctctgctccagctcacttctctaggatccatcttttataactattttatcctcagccgattattcactaatcttgtctttgtagaaaaaaagaattgctgtgaagaagaaatcagaaacaacaactctcaaaccggctcctaagtcacaaaagttcccggatcgatggaacgaggaactagaacgtggagcgcgggacgccattttccaaaaacatggaacgaaggggtatacctcttccaaaagtacggaactataggtggaacgtgttcctagcttttttggaacgataatccggaactctacggaactatggatggaacgtgttccttggttgttcggaacgattatctggaacgggtataccctactagaggaacatgttcctatatttgttggaatgatagcatggaacgtggaaccttagtcaagaatattgtttcaatgatttttttaacaagaaacttaactcaagtttatagcaaagtgtaacaaaagctcttagaataaattattacaaattgagcttcatatatagattatagatatgggtggctgctggcagcaagcatcatgaattcatgaatcacaacagcaccatgaaggtcttttctgtagtagcagtgtagcactcatatgatctttccatgttcctgtaaacacataacatatggggctgtttggttcccagccacactttaccattacttgccaacaaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaaccaaacacaccctatatatgcacattattgccaaggtatgaaaaataaataaataaataatcagttaacatatgcttattaccacttagatggtggagtcttcgggatgtgcatcccacatggcgttaggccctgatttatagctttcagtaaatcttgattgaagacacaagtttgagtggataaacacaagcttatccgcgtttgcagcgtttagtttgtttctctttgcattatggatgaactgataagtcccccaaatcctctcagcggatgaactgctgataggttgcgagagaacccttttggcaacctctgccaattctggtgtctcagatccatagctgcaccaccactcaattggttccatcgatgctgcatcggcctgcacatattctagtgcaaaaaatcccttcttcataataaagtcattgagttgctcgcgaaggactttttcctcttctttattatctgctattctctcaaatgcttttagcacacctgtcatgacctcaacatcttgattcggtgctctccttaatgtgccaccgggagcaggtttttgaagataattttgatcataaaaccttgggcaaacagcataagccaaacaatgaagtgggatactcatcttttcccaacgttcaatgactatgttctctatctctggaaaggaacttttgtatggattgtcatctttcatcatgatatcctttatctctccaaccatacaatccattctctcatagatctcacccatttttggaccctctccatcactgaaccttaatacttcatatataggacctgtgatagcaagaatattctcaacattattccaaaagtcctcacaattgatttcttgaacaatggctcttgcttgctgccgcagatcattggtgcaacctttcatccaatctttccattgattggtgactatggtggtggcaagtgcttcttgacatttagtgagcctcaaaagcaaaaggtagtgagaagcaaaacgagtttttttaatcttctgtaggtccaactttgaattacttctaaacattgcaaggcaatgtgatgattctgaaaaaacttgacaatagctttccctttgctgtatgtatcactcatccagtcaaatttttttgagaaatccttgaatataaggttcaaggtgtgagtgacacatggcccccagaaaatgtgctcatgcccggatgca

SEQ ID NO: 23195 - DNA, 14118 bp, Oryza sativa
  unsure (1)..(14118): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgcgtgagtgaagtgaaatgagctcctctatttataggacaggtatgacggttatgcctatgcgaaatgacatttttgccctgcaaccgccatcaggagaggatctagaccgtgcacaccaaaccctaaatcggacggtgatcaccagggttcagtcgaattcctccttcttcctaatgagaaacggttctcttgcttacatacgcacttatacattttattccccgccacccccccctcccaggccagcaacaatccctctcgaaataaaacatgcaaaaaaccattaaaattttgaaaataaaatcatcaatttcctttcaaaatccgtcaaatttagaattcatgttctagaatcaaaatctcaatcaaaataatacttctgaaatcaaattccaagaaaatattacggaatttgtccacttacgatgacatttcccttattttcatctctctcatttccttctcacccggtacgctcactcccctctttttagccatatattattatagcatgaatgcgcagtatgccttcttaccagattgaaccctcctttcagtgcttttttttttgttaatatatattcatttgaattgaagtagctcattatttgggctttcttaaattcctttaattaaattcatccaaacacaacatctgtccctccaacttgtctgtgaaggaagtgaccatgttttgcaaaccgtccagattatttcgaaatgttttactccaaacgcttaaactcttctcagaaagcttttattttggcaaaataaaatgcaagactgtcattaaattagaaatttgtaaactagacatgaagaaccttttcaaagaaaccttcgtctttcctggacaaaaaattttcaaatctgaagatgtgagcttgagttacaaattcaaatttactattagtgaagtttgtagagaattaaactaataattaaacacatccaaaatttactatgggtgaacatgaaacacattcaataaataaaataaaatagcatagttgaattttttttttattgggcttcgcatagaccatgacttctattatttcattgttgttgtccagatgaaacatttgaaaaagggggaaaatattctcagaagcacgcggctaagaccttctctcgagttggaacaactgtactgtcacttatccatgtttacccatgagtagtgtttgtaagatcagatgtcagctgatcatctcgcagagatggaggtgatgaggtgatcgtggaaaaattcctgcatgccatcggattgtaagccactgcatgcaatcactctccatttgcactaagtatcgcaaaattttccatgcagcaattttcactggctgataatacttcgatcactgggaggcaatcattgttgatcggctagcttaattgttggcagatggggcactaccaccatcgtccatcttctttcggcaaagcttctttaacgcacttatgaattgcgcatacagccttcccttctcaactttaatatcatcaatctccttcacgctcgccaacagcctactcgacagtgtactcggagcattcttctggagcctccatatcttcctgttgagtcgacgtacctacgatatgacaagttaagaaccaaatgtcacataaaataaaatggttcctttaacacgtacacacagctgatatatacctctgtcatcaggtagcttaatgttccgtcgttccggtaaattccatcgaaggaggacagagtattgatttccttctcagtctccttcctcgccaagctcagatactctagaacatcttttgcattccttctcggtacctcctgcttcgtctttccccttctggcttgcaagcttgggtatatgatagctctacctccatcctgctgctgggagacatgagaagattccaatatctctacgtctgagtttggtacaggccgactggttgcggcgacatagaattcttcaactgcaaccagcatgctagcataatcccgatccttgcgcgcttttcgcggcgccgcctttggaggtaatgctactggaggagctgcagagaatggttgcgccgctggggctgctacctgatctgcagctgcagtgcatacaattaatatcaaattatatatcagtacaactaattgaaatggttcctgcaaacatttcatgcatacatttttacaaactcaccattctgatgatgatcagccgatggggcggacatgatcgtctggagcaagttcacttccaccgccgtgtgtgggacattcacattggtgcggacggattcaactaaattggagtagccgctgtccagaagctgcccgtttgtattatttctcatcgtgtcaatgtttctcgcaatgaactcgctagcccattcctgcgtccacttgctgaggctgtaaacattggaacgaaccgatatcacatacattctccgtattctgattcaatatcaggcagagatcggttaatttatcatggtcaaatatcaggcagggtgtatatgtaattatgtataaggccctctttgattattcaaaggaaattcataggagttttagaagattttatttctataggatttttttcctacatagccctatgaatcaaaggactgaactctatggagtccaataaaatacctatgaaatgcctcttcccatacaagttttagagaaaatttaacataaggtagaacttcatgaaaataatcttttaattattatctcttcttaaattcttgtgtttttcctacggcccaatcaaacggacattcatatgtttttcctgtgttttataattctctattcctgttagaatcctatgttttttcaatttctccgttttttcactcgtctgatctaaaggacccctaagaaagagtagtatagatgaaaaaaaaatcttaccagcgacgtgcatgacatgcctgacaaggtggcagcgggagcagtccagttggccatgccggagcggcagggaaggcaccaggttggcatcttgctcgacggggagcacttggacgcgagccacgccaccaccactgtcgccgtgcgcggcctcatcacggaagctgcttaggatagcatcaagctcgtcatcgtcaggccggtcagggtttgcggcgccgagcaaaccttcaggcggtgacgaggactgaggatttggcggcggacggcgtcgttgtttcagggcgtgaatctcatccgagcggagatccagtccccccggcgctggatgaggttgctgctgctggccgccgggaagcatcctcgccggaggcggaggagagcagggatcgaatcgcgagatctggacctgagcgggccactcccgctcgacgacgtgaatcgccggcgtgggatgggactcgatggcggcggcgacgggcacgaaccaccggcggctcggagaacatcgcgatatccgtggtcgggtcgagcaggtagcgcgtgacatcgccatcggcgtcgtaccagtcgtactgctcctcgttggccatggaataaatcggccgggggcgtacgtacgtacctcgccggagcaagaagacggtagtgaagctgaaactgcaaaggcggcgccgccgcggtggaccgggagagactggtgatttgtagtttcaagcggatcgcgagccaaacgcgtggcggcgacggtgaggagagagggagtgtttgtggagtaaacgagggcgcgaggggggggggcaagttcgaatggaggcggcgattggtgcccgcgagtttggaatttgggttttcgagatctactagatttttaagatgatgtcggaatttatttaaagagaaaaaaaaactgaattgaactcagtaattatccgaataaactccaaaaaaattccgttaaaaaaatcaggatattcacatccaacaaaaaaatatatttcctacagaaaataaaatatgttcaacttataatcatgattttatttaactggattgaatattttattttgttacaacaatattccaaatattatttttgttcataaataatttaactcaaaaactagtacgaacttccaaggagaaaacaatatattttttttcatatatacaacgatgtttaacacaaacgaatcttctgccatattttttaaaagaaaaaagatcattttactcccccaaactatttcactaaagcacttaaccccttaaactattttttgacttattttacaccctgaactatcgaactataattacattgtctcatctatacttatcacacgttatttctatatgtctaattaggtgcttcgagcaagagtattacgtcataaatcataggtaaataacaatcacagtataatccaaaatattttagcttcgtttatgcgtaatatataaattgtattttattgctggcgtacagcataccccttgcggccttacccacttctctacttggtacctttccccttcattacatcctcttcttccgataactcaagccagcttctcctctcaatctcctcctaaatgagcctccacttctcctcacaactgttgacggtccttaagttataatatctgaccgtcaatacctgcatataatgaaataaaatatggtattcaacttagtggtaggatttattactaatcatttcaactagtgttggtgaaatatatgtatgcaggtattttaaggaggaaacacacccgtcatgcgacacgatgaacctccgcacgatcaggacgcgtttacatggattggaggccccataagactatcaaaaccacttagaattgggctttggcatagtacatgatgttgggggcccattaagctacctactggccataggagaggccaggatgatatttttctagttagaccgaaccaccagttcggacaaaccagtgttgtggccgttgatcgccagcattccacatgtacgctgctaatgaagtcccaatgatggttggagggcacattgatcatttcccatacttgtaaccgtcatttggagcttataaaaggaggagctctcactcacttcaataaacacaactttgagctgaattacaagaggctctattgtatcttttgtacattagaattaggtggagagaggggagggaagctctgaaggagtgcccggaagtttggcgctcatccgacttctacctcgatgggtgtagctttctaggaagaattctggaggagtaccggagttgtcggtacactctgctccgggttcggagaaacttcttctataaaggaagcattcatgttcttttcttatgttatttaaatactttgtttaagtaagatagatttccatctttgtaggttcattatttagtatttgtactaagtgctttagtactaggactccggatagagaagaaagttcctacgcaagtattagagtagtaattaataacttaggcgtggtgtctaggttagagattacctttgtttgttgcgtatcccacggatttgtcagaggtagacagcaggtggtgacagccctgaatcccgtcctagtaatcctccacgttcggttacatcatagagctatagccgaaaccacgctggcaaactagcaggagtcggtgcccgaagcaacagatagaaaattaccttcaacttagcttagataattaaaacacatagaaagtcctctcaagcctagccagcctacctatagttgttgtccttggatagtcttatgcttacgtagattacacacgttccctgagttcgatatcctttaggggtcacccgaaggtgaagtgctatagcggtattccgtacgcttgcggatttatctgtggtcgtaacaaataccaacaacaacacggagggaaccctcctatggctgcacctgatataatggataggtttccttctggtttcactacactgtcgatagtcttgacaggttttgaaattgtgtgtattggattattaattagtttgtaacacatgtaatggcaatatatgactttgtacacatgacctaacagggtaaacaacatttaatgaaaagaaaattcacatgaaatattgctcttattcttctccaagtctttgacctgtcaccaccaaattagaaagagaaattggcagtttctgccataggttgttcttacttttgctagccgggaattgagggagaaaaagatccacttttgtgcggtcaagtagatgatcatctcttgtatgtggttttgcgaattcgttgtgaaaggtgcgttacataggcaacatgcatgtcgttcatctagttcgtcaagttgtatggcgtattctaatctaagaaagtcaggcaccccgtatcacaatgaatcaagggagatgatcatgaggcttcccaggtagtcaagggcagcaacttctgctcgttctaaacgtcactatcactaccacagatcccggtatctgtgatgggctaatgcaacccgttctgatgactcatgtctaacggatctaaactatcccacgtaagatatgactaagatatgactacctaggatgatatctattttgaaaaacgtaattttaaatttttcaaatgatctcggttggagacatatcctatatcagagtgcaagggttcgatgagatctacaactttccaattgacaatattttcatttgagattgtttacatcaccaaatatgtgttataagtaatgtgatctattttcacaatattttttgaatttttcaaacgagctcaatgagatctacaactttgtacttgaaaagttttctttttaagtcatctagagagtcaaattagtatttcatatttggaccagaatagccaaaataacaatatccaaagacctagcaacatgtggctgagaatatgctttatgtgctttggaaggtcttcggttgaaatcccaccatagtgtgcttgtaaatatctcttaaaaaatcatgaatttgtggctagtgatgtacgaccatggttgaaataatataataatattttgaatattttaagggtttttttgtttattataatttaaaaatcataaattctcatccatgaaggttcataattacgaaccatcatagataactctcatatgtgacgggagtcatctttggtgtgtgataagttaaaacctatcatcgatgggttattggtaacggttattcactcatcacggatgaggtttttattggtgatatgccctagaggaaatcataaagatgattgtatcacatactatgtttacatatttatccgacattgttccttgaaatagataactcattatttgttaatgaatatgtgattctttcttgagactctttatattatatgttgctatttctaaaggatccctgatcaaatatcatatgtggaacaaatatgtttagatgatcagcacatgtattaattgatgatcatgtctcatggatcatggtatagagataccaaattaataatgtggacacatgttggtgaacatgtgttagatagacccaacatgagacactgcaagacccgtatgtgttgtgtcatcagtgatcttatttagtgttggtattgaatccttagacctgagattatcatggttcccaacatgtgtagtagcttacttagggactgctaaacgctactccataattgggtagttataaaagtagttttcgggtatactataaaacatgtagtgggatatgaataatcaagatgggatttgctcctcctatggagagatatatctgggccactcgatgttatagattatggaagtgcatagtcatgccaaaggtgattgaggagttaatcacaagttatataatctatcacaagttcgagtgaatggttgagctattagatgatggcacatatctagcctgagcttaatctatatcgtgaggcaaaggggtccatacaagtttacactagaggttcaaccgatatgatctttatgtatgctcggtgggtcaatacgttctgctagggtccgctgttgacacgtggaccgaaaaggagttttcaggttgcaaccgagtgtatatgaacctacagggttgcacgcttaaagggccggaataaagggattggatggagatctaatatgcactcaatcggatagggatccgagtaggactcatatgggcctcgaaggcccagtcgtgtatcctttatattcgtgaggggatgtgaccggcggaattaacacaccacgtgaaaccctagttgtcactcccctccccgagcaaaccctaaccgcgcgtggatgctagcacatctacgcgtggtgttcctttgtggataccggtagaggccccgctgctttgcggtgctaatcggcgtgggagcacggcgaggacaacgcacgagggggagaaggtcgagccggtgtgatcgactacttcctctacatcgatgcgcactacatcacgcgggttcctcgccttcttagcgcttaattacttccgctgcgcagcgcgtcgagtggtaacgatctatgatctaatatttatatggttcctggtttacgcggtgaaaaatttttagtttatgctatcgtagcctacgtgtatcctaacagttttctcatattgtccaccaatcattgacgaggttaccacccattataaatgagtggttctgttgtagtggtgtgtggtggatctttcatgccgggcaccatgatggctggatggtctaccagcaccctataagaaattacagagctagtgttgttcgcttgtttgccttgcgcctatgcattcggtagagcttgttgatttagctaatcagtcgcacgtaaaacatacacaaataaaaatagctaggtaattactgcatatttaattaggtagtactccctcctttgatcattatataatcaaatctaaaatttcttaaattaattatcatataaccgtatgaacacgaattccattgaaataccattaatacagcatgggagaatgtgtgcatggtaggatgtaattagcatggtgatttaatcgatgcatacatagtaggagaatatgtgcatagtgtcttaattgatgcgatttaaattatccttaatcttgatgcataaacctatatgatgatcaacttcggatggaggaagtattaactattgtaaattttcaaaaaataatttatttgatttttgtacagaaaattttgcacaaaattgatacaccgtttaatggtttataaatcgtgccaacagaaaacaaggtaatagctcaactaagcgcatatggccaatgtttattgccaacctaactttaaggtgaaccctcaaccctatgccagttaacaatagacgtgaaccctttgacaaatgaaaaagatttcaaaccaaccttttattcggtggagcgagaagagagattctcctctcttttttttcgcttgtgactgatcacaaacatatgcttaatttttgttatggcccagcttatgattaaagccacaatggttatcgtccaacttatggcctttaattatggttattaatttacaatattatggatgccctaagccttcctggatgcaagaaagcacggaagaagaagatatgtggcttaatccaatccataggaaacaaattgaactgccaaggcctcctttgatttataggaatttcataggaatatgtaggtattcaggatttggcactatagcagccttcgattcattggatccaggcatagggaagttggaggaaattttcctttgcaactcatttcacaggaaaaacatgagagaaaacatctactataacctcttttttccatcatgtgcacgtaggattgaggtaaatgatagatgtatacatagtttctggtcttttatatagtagatactctgtataatctaactcaatgtcgatatctaaatctatcggccgttttcgatgatagaggctagctaatgaggttagatgacgagatcgatctagattatacagcgtatatgataactcggcgattcacatggacaggattagagtgtcatgaagatgtaagcactaattccgagaacgcaaaccgccataacaagctttacctcttcgtcggagatcgaactcgatgcaggccaactcgaaagcaaaaacatgtcgaaacaatgaaaatagaaaagggtagcgatgcgccgaagtattattgaattgtcgtcccttgtttacaaggtgtcgggccatatttatacccaagtacataacatgtccttgctagacacaactctttctctattacaatttaaaatacgaacaagtcccttaggcggactcttatcaaaaatatttctaaggaaactaacaaaatatcctaattaatagatacaattacattttctggactccaatccctgcgtggcaatgtctatgaagtgccttaattgatcccgacgatagttgcaggaccgtctgttcgagactggttgtatcggcttgtcttcgtcggatttggtgtcagccgatgcatatggcagtcgatacgcattctgcttcccctaaacagaattcctcctaatttgttttgaccctggctttgaacccgatccatggccttaccaaatttagtcgttaataattgtcagacaactatgatttaggggactgaaacaaatgtaaggagcgcacggtgatttggaaagatgcagtgagcaaagacacgggacgattcaagggaattattcctatgccccaacttaaaaatggtgttctcttatggaggatgggagcggtcctgacaagtcggttttgtgccctgataacgggaggacaggtaacaagaaaaaaaacgaagaatattagtagtacattcgcaaaaactaaatcaacagtatgtagccatataattccgaattttattccattattaaaaaatataaattccgaataaaaggaattcgaatattaagtacatgctccaaacacggacaaatataactcctaaagaaaaaaaaactcaaatcccagaaatacacaaactgaattcaaacgacaacaaaacagaatttatatagatagtcaaaacatagacatttttatttcaaaattttcattaatctaagctttgacaaataaactctgatctaaatttctgaattacggaaaaaattataactgaaaaaaaaaggaatgtttggccccattcaataggggtattagtgtatattactacatagctagggaatgggtgtaatatttttcctatggacaggcccgagaacgtagcgagcagcagttgggtaatatttttgcctataggtaacacatgtccatgtccaacccggtacctatgtattaactaaatttggctcatctcttaattatcatacccttttctcttgacaatacacacacttactcaactaatagaaaccctaacctaattcccccactcacctctcctactcctacccaaatccccacggcagtggcggctgcgtagggcgtgggcaagcaatgacgccagcgcaggcaaggcagtggcggcccaggcaaggagtggcagcatgggcatgtgacgacggtagtggcacaggcaacagacaatggggagcagagcgagcaggatggcgtcacaggccgatgacggcggcttagctcaacgcaagcggcgaggcggctcaaggtgacgacggcaggtggcacagctctggccaacaccggcgggcagcgacgcaagggaccatcgggtgcaaactgggtatccaccgggcatgcccatgtacattgggcatgggtatggacaccaagttttacacgcttaccctatcaggcatgattcaagcgggcattctctggtgctggatcaggcatggtttagctctgcccgtggccgacccggcctgttgccatccctatacggaacaaagggaactcaaatgtacaaatcatagagggtattattaagtggcaaaaattctccacatgctacagcaattactaccaaacgaagcttttggttaattgcaggcataatttaaccccaattgaatcgaatttctacagataggatagtaaaataacattacaaccgatccgcaggaaatgggcaaaaaaaaaaagatggtgccttgactaatgaaccggatgccaactatacactgccaaataataataatccactgccctcaactctgtcaagacattcatgacagtccatcctcgcagtgagaatcggcaaaattctcggcttatcttgcaaaacggtgaccccggaggacatgaagatctttatcactcacttgttctgaaaaaaaaatgttccaaggcatgtaaaacaattaattcacatatcattctattgataacaaaacagaaagcaaaagtacagatctgattccttgtcctcccctacacccctacttttctaccaaaaaagagatagtttggactaacataatgaaattaattggtagtatgttatcataagaaacatgtacatgcgtttgttgcatgttgaggttacctaaccgaataaatatgcttaaataaaatttgtgactaaatttgaacctcctacagtaccagacgtaatgcaagaaactagtatatttgtcagtcagattatacacacctttgccttttagaattaggtccatcaactggatcacggttatgttgatgtgaactcctggaatgacttggaccagctcttgcagtattcaagttcccatgtgcagcctgccagtactgattagtccatcatgagcttaactgtatttacagccataataagaagaaattgcagttacctgtgaaggggtgctgctactgactgctgaggcactttgatgatgtgactcaacttgggaaataaatggcataatttggcgaactaagctagcgaaccgtagaccctcatcactgactcctgacacttctggtgctccatgatttctaccatctacctgctcagcagaagccggtgcatgctgatttgtgccatttactcgagaattttccccagaaaagagtgatgcaatccaagggatactatccatcaactgagaaaaaggcccctggccattctgctccccaggggaagtctgagtgccgttttccgcattgatatcaacaggagatcctagagtacctattagacaaatacttcagtggtaagaaaaggaataatatgtcaaccatacatttgttatagaggaaacatgagtatttgccacagaaagatgaattttatgcacttggcaatatgccactgatttgtcattagtgaccacatgtccatgacagatcaagtggcaaatcctcagatgccaatatttgcagtggcaaataactggtaacccattcttttgatgcgcaaaaaacatgagcctgtcaacctggagtacccatacgtaaaaagaatgaagaatcattgaaacaaaggcatgcagaaatcattagacaaattctagaagatgaagtacgcaaaaggcattccagaatgagttaaatgtaaaaaattaaaaaaaaaaacagatacgaatccagacaggcatcaatgctaatacaattgcaaatatattgaagttcaataagtttgcatgtaaaatgctagcctaaatgcttaaataatacttataagaatttgagcaaataaaagtgatatttagtgcacctgaatgtggcaagttcctcatcacttggaggaacactacttagcacttcaaaaaggcaaattgaacatacaactcaaacaaggaaacagggaaagcagtctctagcctcatcctctccttcctctggcttaacactggcaggccaaccaaggcattgctaaccaacctacggtgaagaaacgtgccatagacttcctgcaacggtgataaatccatttcacttctctcccct

SEQ ID NO: 23196 - DNA, 1336 bp, Oryza sativa
gcaaccactgttctatgcggcaccagcctaactccagattcaacagaaaatggagcaccagctgtaacccctgcaaatgcttcactactgtttgcaggtgaagcatttgcacttctatctgtacgatcttgtgtttgatgttcctcaacccgctcaggtgggttagtaccagttaaagacacagacccacctaacaaccaaaaaggaccgcatttaaccatcatcaaccaaagtaacagtaggaaaaatgtacactcaaactaagtgtggtcatggatgccataataagtttaagacatgttctgtatggatgattggacagataatggacagttgcttacagggatgaggtaaatattataattgagtaattataattataaacctaataaatagcttagaacaagttatctaagtaatgctgatgtagaaaggtgcaaaatccataagtccagaagcttaaaaaagaacacgttctagcattcaatcggcattcattggttcaaatgtattattatctaaaccaaccttaccaactgggacttgcactcattctaaactatcaactctgaggtattagcaaactggtttcagttgacacaccagtttgttatgattaattttagtatgctggactatgcctccaatcaaacaaccttctaatctaaattagctcttatcaactcgtatttcaacaattaattgtcatgataagatcagagcattgatcattgatcagactaatcgtatatatcaaagctaacaatagacatggtaatcctagatggataaatgtgacatccaaactcccatgctggtcaatcctagatggataaatgtgacatccaactcccatgctggtcaaactacaatagtcagactgaagaaacaaaatatagcaacatttactcactcgtgcggacatggatgtcaatatctcttgggtgcagaacagagcgatgtgaagtaagactagaaaatattgggcccacttgaacagatcctgttcctggaacaaaaggagcaggctggactaaaatgagttagcaacgacggaaataggataaatgggttctctacctgttaatattaagagcaaaatttcataatacccccccccccagttatggtccaagcttcacaataccacagaaactttggcatgtggcacataaccacataaccctaggtgttatggtccaaacgtttcataaaactacgttacttctcattttgactttgttctaccatactattttagttctacagtcccatcttaaatttttgagcattgtatccaccatataaatgtacatccgttttttatttatatagg

SEQ ID NO: 23197 - DNA, 2613 bp, Oryza sativa
ctggcttctgcaaacctctgttcatgcaaggttaccttctgtgcaaaatgtgacaaactatcaaagtcttgagacgagaacttctccctgatcggagcaatcataccctaaaagccaaatcggctaactgggcatcagttaaactcaaattgtagcacttattccttatctctctaaatctctgaatatactcatacacaggctcatcatgtctctgcttgatcgctgttaaatcgaacagtttcatctcgtgaatcccactgtagagatagctatgaaagtgcttctccaaatcggcccaactattgattgatccacatggcaaagaagaaaaccaagtgaaagctgatccagacagagacaatgggaacaacctaaacctcaaggcatccacagccgatgcttcaccacactgagctaaaaatcggctaacgtgttcataggttgacacactatcctgccctaagaattttgaaaagtctagaactttgaatcggttaggtagagggactctctcaaaccactcagggtaaggatgccgatacaaatttccaacgtctttcggcatgagcccaaacggctccttcctcacatccacaatcatatcggcccatagtcgttgctgaggtactccttgaggttgttgtggcatgagctcgaattgattgtattgaggaacaaactggggttgagcccgtcctccctgctgatattgaacttgcagtgaaggaggctgatattgataattcaaattgccccctggtaattttgaaaatttggctgaatattgcacaccaaatgctaaggaacaacttgaggtatcactgtttgatctggctgtacatgatgaaccaagtgctctgggccaacttgattcgcagcatgctgccttggctgattgtcaggtgttgcaaacccagccgatgcattcatcaaaccttgctgttgaatcggctgaataacctgttgccttaatggtgtctgctgaattggttgcaaaacctgccgccttggtggtgtctgctaaatcggctgcacggcttgttggtttgatggcgtttgttgaatcgactgcacaacctactgccttggtggtgtttgctgaatcagctgctgctggactgggtccacggtaggtgaggtggtaaaaacatagctgcaacctgatcttgcgttagccgattcacattctgtccactatgctgtggttgttctctcaccaacaacagatgattaactaattgacctggtgccgacgatggtgcagcgggtgcaggagccgatactggtgccgtcggcggagccgatggtgcattaggaggaattgattgaacagctggctaattatcggtgattaagggctgataattcgggaaaacacctcctggaaaataaaccggtcctgtagcctgatattcagccattgaaccgtcaaccattgtcttcaccatgtttgacaaagtgttgactaatatcccagattgattgatcaaagtatggtgcacggcatagtcaacctgatcctggaagttgttaaactgtaactgtgctgtgttgccatcttggttaagacctccaccttgaaatccctgaacaccatcaccttgaattccttgaaagccatctgcagcacctttattactcggttgagccacgccatctggagcttgtttcacttctccatccttagaagaacctgtcccagaaacatcagcaattacttttactttgtacttctgaacaagtgttcccttgcgggtctccgtgaatgagctcaagaactgattccgtgcttgttgcatcattgcctcaagatccttttgctgctcaggtgtcaatttatctagagtgatgagcacaatgttgccttcatcaacctcagatagacccagcttgtggatcttagctttaacagagcgaggctcaccagccaaagacggcgacgctggcggtttctaggccatgaggaaaaacagctgttgtgattctgacttccgatcggtcccaccgggcgtgccaaaagcgtgttgatgtgaaaacacaaggcctgggagatctgcttaactccagtgtaggtccaaaactcaccttcgggtgtgctagcgtgccagttgatttgatcctgcaatcaacaagaacaaagacaaagaaactgcggttgaatccataaacgatagccgatcggctaagtgccgatgacatatcatttatctttgagccgatgtcatatatgcatcgatcggcaatcattaataagtaagaaataacaaaatctactagatcgactatagatattaacgatatataatccttatgtcaatatatacttaaatcaagtgattgggatagatcggtcgccatgccgagatagtataaatcacttagatcgaaatatatattaacaacgagactatatatgttcatagcatagccaatcagatggatctagcatgtatcggctaatactccgatactactctatgtaaagatattaaagcaagtaaaatataccaaacaaagagcctaatatacttaaatgccaccagatcttaatataaagggtagatttaacatgtcaatgaagcatacgagataaatatggttaaatcaagt

SEQ ID NO: 23198 - DNA, 19289 bp, Oryza sativa
ggaatcaatcttcttctttgatttcgcttcgatctatttttcatcttcgatactgatattaccaaatttggtcgtcaacacatgcccccaagtccggaatatttggtaatgtttcggatttgccatatatcaactccgagtgaaattcgcaccttgtcgttttccgaccgttattccaatgctttaaatactaaccgttgccccctaaaaaatcttcactccgttacttccgtttttaccgcctaagccaactttgtcctttctctctccggcgatttctccgacgcacaaggcgatccccaagcgactccatctccggccagatctccgcccgcggcgatgtcgtcctccgccagcccgtctgccgcaccgtcggccgagtacgctgaggtaagttctcatcggctagatctcttttcctcgcaacagattgattttccaactcctcatctggttttcctcctctcggttcttttggatttgtagcatctctccaacctagttgcaatcaatcttcgtctttgattccgcttcgatctaatcttcttcttcgatactgatattaccaaatttggtcgtcaacacattgcagtataaagcaattgaaaaatcccttcttatatccaccttgaccttgatctacttcttcaagcccaggactagatcgatggcaactagctcggattgaagatgaacaacattggaccacttgatgtcgtggtcacaccattgccgcctgtgcctgcgccttcctccgccgcaacctacaaccagatccagagaagatgtggtcgtcgccagccttcgcattgctcgttgtcctccaccaatccaccaattgccagcctttgccttgctggctgcaccctccgccagatccaccgtcgccatggacactgctaccgccttctcgtcctctttgtcgtcgttgttgcgatatccctagcgctgatggggataaggagagatgcaccgcgggtggctgatgtgatgtgtcttggcattgagcttgatgtgccacatgcggccgagcggggcgcggtcgagcgacaccacgacgggcaggaggagaaggggcgctcgaggcggagaatgagaggaggaggaaaggagaaggcaaaggtgtggtggaggcaaaggcggaggtagcgaactggcggaggcaaaggcggaggtaacgaaccggaggctgcttgctcggaggattcgagattgggacgaggagtagtgggttggtggcggctgaggttggtggagagtgcggacggggagggattaaagactatgggcgctttggttttctcttttctttttgttttaatgtttttcgagcttctttcagttgatttttctccaaacgattcgtctcttgtgggcacacatcactgttgctacgtcatcatttataattgtaaactaaatgatactagcgctttgttgcgggatatatgtaaggtattgtgaaatggttaatgatttgggttgaaatattttaaaaatgatttgagaatgatgatttagcatgtgtatgtttagttctagaatgaaataaattgtaaaaataattactatatgctttgcatgtataactttgtgtgtttagtgggttgacgtggcatgcttgcatgttaggttttaggaatgctaataaatgttatgcttgcatgttgagctttaggtgtttagtgggcattagctttatagaaagaagagattagaaataagtagatatagtactattatatatttgacaatatattcttcaggtactaataataatttatatcttctaactacttaaaaaaattagtaatgtttcaattgtcaaaaaaaatcaaacggaaaaggtagttacttaacatgaaaattaaatagttgaatcggtttattcagtattttttaaagaaaaaaaaggtttattataacgtgattgattagctgcagaaattgttttcggtattgctaaaaatatgtcgccacaaattacgatagatttcagtcggttgtttcaaccgtcggatgcagaaatcgcgcatgtgtacgcatatccctccgattctgttctcttctgttctcttatgttgttttaacgtttgtatttgctaagtaggattactaattaaacttaaaagctaaatatttgtgtcatcacaaatttatagttttgggaattacatcaacttacacatgtaattttgagaattacatatgtaattttaggacttacatatgtaattttggaatttacatagtaaatacactaaaattacatatgtaatttaggaacttacaatgtaaatacatagcgactattttttggtgaaaaatatggcgccataaatatagctactccctttgttttttattaaactgccgtcaagtccgatcgagtgacgtcgtctgtccctgcactgattaacacatcgcgtaaggctttccaaaatttttttcttgggctttccttgcgctaaccctgatcgaactcttccaaaaatccctaagggcatcagcgatgtttattcccaaaccaagcagtaagtgtgggcccacctccaaccagcctatcacaagccttgttgtgacttaaaaaagtgaggtgggacccatcatattcccttactaccagcaataagtttgtaatctggtagtaactatttggaaggccctaagcgtcgggcgcccgatttacgtgcaaaaactactttcaagtgatttttctcttaaattacttattcaaatcatgatccgattgtaccattaaattcgttgcaattaaatcttcaaaacaagaccacacatggatatattccgacaaaaaaattttagcttattattgaattatttttaaatgttgcacgatgctccaccgggtatatcagaattgtttcactaagtagatcgaaactgtttcactcgtttaaatcgggtgttgtttcaccttatataaaaacaatgtttcagcaaatagcgaaataatgtttcagttcactgtaacatttgatccatacatagtgatatattataagtacactaggtgaaacatttttcggtggaacaaaaaataaaacgaattcccttaatatagggtttccaaaatatgtgggttttttgttacaatgaagtatttcagttcactgcaatattagatttatacatagtgaaacattgtgagtacactaggtgaaacatttttggtggaacaaagaataaaccgaattcccttaatatggggtttctaaaatatgtgaatttttttttgcaatagagtatatggtgaagatatgtggcaattagtatgaacacatagtggggtcctaggagaagcacatggacacgttgtggagggggggagcgtccgattttctccccctcccccgggcgaccgagcggcagcattttcgcaactatttactactctcacaatgtttattacctgataataagcacctatttaatgcttactcctactctagcactacattatcggcgtggattctctaacgggcgagagcaaagtcagaggctgacttaccccctctccgatgccgtccgaactccatccaagggctactgagtccctcaacgtttacagtgtgcatcagttagctcaggcattgttttagcccaaataagggcccagtacgggacacaaatgagcccagctcgagaaagaggatgcagagggttcagaaacaagcagcgcttggtacagaaagaattaagcaagcatttcagtttagaacttggtacagattcatgtcccaaataaccaaaataatatccaccaatggccaaaatggatttgtacatattaccctagagttttgatggtcactgaatttccatcaaaagcactgaattttcgataagtgctaaacacattcatgccaaaagaacaaaagagccttcctcatggagcagaaactaaatcagagatctaaacaagatcttggacagacatatcatcaatctcactggcaccctacaaagacaaaacaaaaaaattaaatacttattactaataagcatctggatgcaatcggatgcaaacaaaatccatgaatttcgaatgtaaatccaacttacttgtttggttctgcttgtgccatcgaatctccactggaatctggttccaccacctgcgatggcctcccttccaggcacggcaaccacgaaccctccggcgtcccggccacaccgctagccatgcgatcgacgcgcgcaacttcgccctttcctcgtcgccaagccgcgctacgcacgcgttccccgccaaaaatattctgcgcgctctgttccggcgccaaaatggcctctagtggcggcagaggagtctaattgggctttatttgggcgttgggccaacaagcgaatgtgaacagacttgctctgatagctgaacctgggcacgcccttggatggagcacggacggcatcggagagtggtaagtcagcctctgactttgctctggcacgttagagaatccacgccgctacattatggatgtcctaacgaaacacacacgaacatatcctaaaatcccattaaacaatcgaatctctggaaaaatcatgacttcacctggcaaaaataggcaagtaacttcaactaaacaaacagatggaggtgagaaataaaaaccaaacagactgctccttatcgctgcccggaatgatccacgtcgtcggtcgctgttcccaagctctgacgcgcggcgttttgatgggcccacaagccgcgtgatcatctccgccgccgctgtcaagcaaccgttgcctcccaagactagatccggcaagcctcaggacggatctgacgaggagggggcgaggagtaatcgtcggcagagaaggtcgaactgtcgccgtcgccgccaccgttgagggggtggcattggcaaagggggaggaagagcggcgccatcgctgactcggtggggggagagagagcagcggagaggggaggaagaactgcagctcgcgatgggggaggagaacagtgctggcggtgggggagggagagtgaccctggtggtgggaggcagggggagcggcggtggtgaggggaagggttggagggagtgagagcaaccgtatgagggagggtgaatttattttgtttatgcttttagggtgtttgaagtaaaattttggatttctctacaaattacaaaatacgaggactaaaaatagaaaatgataggggttgacaagcaaaattagaacacccctagagccactttgcactatggaagaaactgatttgagtccgcagtcttcatcttatgtgataatctgacggagccattgtacgttatatttgcaaacgaaaagtaatttgtgaataaaccttttatacacgtgttcttagcgatttaaaagcaaaaactgaaaaataaatttcgatgaaaaaacctcaaaataaactctaaatttaatgttaaaaatttaaattttggttgataagtataaatataaggaaaaaaatgaggccgtgagacttctcatagcagtgtcttttgtactgtgaattgtgaatggcctgatggagcactctaccactacggatgcaagatttcgtggtgccatagatatggtctatggaccgttggcattgacacatcgaagctttgaccataaaaccggagggcccattgcacaccgcggtgaaaagtactatctaactttcaggttataaaattttataatattgcctatattcatatggatgttaatgaatctagacacatatacatattcattaatatatatatatatatatatatatatatatatatatatatatatatatataaatgtggacaatgctataaagtcttataatatgaaacgaaggaagtaacagataacacacacgtacacgtttatgttcattggttatgccccatccaaggagctaagacaaaattaggctacaagatcaccggtgttgtatgcttgtgtacatgggtttgcctattcctctcccggacagatcaaagttttggaaattacagtaattttggtttgaattaaatttaaatgttaaacaaaatttggtcacatctatataaattttgctaaattcaactttaatgaaagattcaaaaaataattaggagaaatagtttcttgtcagaaggggtgacaaaatccagaaccttgatggtttagatcttgctgacgggtgggaatcaaccatacattttagggatacatagaaatacaaaacagtttgaattttttaagttattattatccaatatatataagtgaagaatattgtaacgccccgcaataatgtgaatccactttgaatttgataaatgtattgcttgtgaagtatgtgttcgcgtttgaggaaaaagaaaagagagaataaaagaaaaagagcaaagcagcccaacagcaggccttgggccttggcccatgggtgcagccagctcccagcccagcaagcaaagctagctagcagccaagcagcagcaacagcagcaaagcagtagcagcagctagctagcgagcacatgcaaggcaaccggcaggagctgtagcagtttagtgccaatctccaaaaaaaaaaaaagtttagtcccacctccgctagtttggagagatggcgagcacattaaatagaagggctgctcagtgattgtaactccaattctgaaatttttgcataaaagcgaggaaaaaaaacacagtgagttgtagtgctaggtgtggtccaactgtacgagatggatccaatatcgtttttgggcccggtgtggtggccgtcgcagattaggtaatcgttaggcttccaggatctctccctgcaacgtgtggtgacgtcgcaaattagataatctctaggcttccagtgatctctcccagtggcgtcacatattaggtaatcgtccagtggcggatctaggatttaggacatgggtggtccgactcaattgtgttttcaaacaccgtaacgtcgcagattaggtaatcgtcaggcttctagtgacctctcccagcagcgtcgcagattaggtaatcgtgaatcgtcaggcttccagtgacctctcccagcagcatggctgaaacgacgcagggcggcgtggccgaaacgatgcagggagaggcgtggccgaaacgacgcaaaaaccaaaatgacacagggagagcatggccgaaacgacgcagaaatcagtcgagggagaggcgtggctgaaacgacacaaaaaccagccaaaacgacgcagggagaggcgtggccgaaatgatgaaaaaccagtgacctctcctagcggcgtggccgaaacgatgcaaaaaccagttttctctctgaaagaactaaatgaagttagttctcaaaacttatctatgaaacaagttttttaaaaaatactaccaacttatcctatgaaaaaagattttttttaaaaaaaaaatactacctcccctatataaaatcggatgttattaagtacgattccgtttcgtttttgttgcgaatgcgcgcgcacggtgacgtggatcgatcactcgacttaattagcgcccacgcaccttacggacgcagccattgtgtgctgtcctatataacttcactgctgccgccacacccacaacataatctccccctctcttttccagcggagcaaaaagcctagcaaaatcttgcttaatcagtgagcaaatcctagctccttacttgcttatctccatcatattgatcggagcaagaagaaggggaagtcgatcgatcatggagggcaataagtccagcagcaacgatagcctttgtcgccatcatgccgaggacatcgaggagggggagatctgcaatccgggtggtggtgatgggtgctacgttttgggctccggcaccgaggaggacaacgaggaggagaaggtgggcatgcagccagtgacctgcaagtggtgccgtctcaaggacatcctcgcgctgccttcgcccatgccatcttcttctggttctgaggggacgatcaacgaccatggtgccggcaacgctgccgccgtgttgcgactggaggcatccccgtgccacttgtgcagcagggagttcggcaacatgaaggcggttcacgggcacaagagagtccatcaggtagagaactgttaacgaccaaatttggtaatccaaggatcgtaaatgaagaagaaaccgagatggaattcgagatggaaatcgtcccagaaacagagtgagtatcggctgaagtccgaatcggctacgactaagatcggcagggttcgagtcggactgggttagccgattgagccgaatccgacaaaatatgacgcagcatatgttgtcggtttaggttgacgtgcttcaagatgattgccacacatggatagagtcctgagaaggcaattgtatatattagttaggatattttatgtaatttccttagagatatgtttgggcaaaagtctgccgcaaagacttatggtattttagagtttgttagagataagagtcatgtccgatatgaacatattttgtaattctcgggtataaatagaccacgagccccatgtaatcaaactaacacacgttcaatacaatctcggcgcatcgccaccctttttactttcgttttattcgacgagttcttgcttttgggttgagctgcatcggtttcgatcttcaacaagagataaaacttgctatggcggcttacgttctcgggattagtgcttccatctttatgatactctaatcttgtttatgtaatacgtcgagttatcatatatcttacataatcttcgacgatatcgttatctaacctataatcggctaacatctgtcagaagagggcagccgattaggttaaataccgatgttgacttagattatatatgatatccaccactctatgaaattttcaacggcttgattatctagatattgtctttcttttcatacttatagctgcatcagttgagtttgatcttatgagtcgtgattagaatctcaatctctagcctgtctttggttattgccgattagagtagtatcggggtttcagccgatcttacctgatttaactacatttatcttatttgccttattgacatgttaaatctaccctttatgttaagatcttgttacatctaagtatattaggctttttgtttggtatatcttacttgctttaatatcttaatatagagtggtatcggagtattagccgatacacgctagatctatctgatcggctttactgtaaacacatatagtcttgttattaatatatatttcgatctaagtgatttatactgtctcggcacggcgatagatctatcccaatcacttgatttaagtatatatcgatataaggactatatatcgttaatatctacagtcgatcgagtagatctagttcttattaatgactgccgatcgatgcatttatgacatcggctcaaagataaatgatatgtcatcggcacttagccgatcggctatcgtttatggatttaaccacggtttctttgtctttgtttcttgttgattgtaggatcaaatcaactggcacgctagcatatccaaaggcaagtttttgacctgcactggagttaagcagatctcccggacctcgtgttttcacatcaacacgcttttggcacgcctggtgggactgatcagaagtcagaatcacaacaacgttttctcatggctgagaaaccgccggcatcaccgtcttcagctagtaaagatgattcttctaaatctaagacccagaagcctggtctatctgaagttaatgagagcaacatcatgcccatcactccggacaagttgaaacccgagcaacagaaggatcttgaggcaatgatgcagcaagcatgaaaccaattcttgaattcattcatggagacccaaggttcagaagtataaagtaaaagtaattgttgatgttcccgcaacaggttcttccaaggatggagaggtacaacaagttgcagatggtgcagctcaatcaagtgataaaggtgctgcagatggttttcaaggggttcaaggtgatggctctccaagggttcaaggtgtttttttcaaggaattcaaggtgacggttctcagggatttcaaggtgaaaatcttaaccaagatggcaacacggcacagctacagtttaacaacttccaggatcggattgattatgttgtgcaacatgctttgattaatcaatctggggtattagtcaacacattatcaaacatggtgaagtcgatggttgatggctcgatagctgaatatcaggctacaggactggtttatttgccaggaggggttttttcaaattatcggcccttgatcactaacaatcagccgactgttcagccagttcctcccaatgtaccatcggctcaaccgacagcaccagtatcggctcctgcacctgctgcaccatcatcggcaccaggtcaattaattaatccttggttgttggtgagagagcagccacagcatagtgggcagaatatgaatcggctaacctaagatcaagttacggctatgttcttatcacctcaacctactgttgacacaatccagcaacaaccgattcaacagacaccaccaaggcagcaggttgtgcatccgattcaacagacaccaccaaggcagcaggttgtgcagccgattcagcaaacgccactgaggcaacaggttgttcagccgatttagcagcaaggtttgataaatgcatcagctgggtttggaacacctaacaatcaactagcacgctagcatacccaaaggcaagttttggacctgcactggagttaagcagatctcccaggcctcgtgttttcacatcaacacgctaaggcagcacgctgcgaatcaagttgtcccagagcatttggttcataatgtccaaccagaccaaacggtgatacctcaagttgttcccgaacatttggtgcgcaatatacagtcaaactttcaaaattaccaggggccaatttgaattatcagtatcagcctccatcgccgcaaactcaatatcagcaaggaggaccggctcagccccagtttattcctcagtacaatcaattcgagcctgttccacagcaagcacaaggagcgcctcagcaacgaccatggtcagatatgattgcagatgtaatgagggaacagtttgggcttaagccgaaagatgctggaaatttgtatcggcatccttaccccgagtggtttgagagagttcctctgcctaaccgattcaaagttccagacttttcaaaattctcagggcaggatagtgtttcaacctatgaacacgttagccggtttttaactcagtatggtgaagcatcggctgtggatgccttgagggttaggttgtttccattgtctttatctggatcgactttcacttggttttcttctttgccatgtgggtcaatcaacagttgggccgatttggagaagcattttcatagttatttctatagtgggattcacgagatgaaactatcagatttaacagcgattaagcaaaggcatgatgagcctgtgcaggaatacattcagaggttcagagagatgaggaataaatgctacagcttggccttgactgatgctcagttagccgatttggcttttcagggtatgatagctccgatcagggagaagttctcatcccaagactttgatagtttgtctcaccttgcgcaaaaggtaaaccttgcatgaacagaggtttgcacaggccaaaaagaactttaaaaaggttaatcatgtctgtccttacatatatggatcggatgatgatgatgatgatgactccgaaatagcaacagccgaatgggttacaagcaagaaggttataccatgccaatgggtaaagaattctggagaagaggagaggtatgactttgatatcaccaaggctaataagatttctgatttgctacttcgggagaaacagattcaacttcctgctggtcatacaatcccatcggctgaagaattgggcaagaaaaggtattgtaagtggcataattctggatctcattctactaatgattgcaaagtcttcagacagcaaatctagccggctattgagggaggcaaaatcaaatttgatgattccaagaggccgatgaaggtcgatggcaatccttttcctgttaatatggcacacacggttggccgaacaacagatggaggaagagccaaaaggtttcaggggaattcggctaaattatcaagaagtatcacaagaagtctgacaaacaataaaagaggcattatgaagaagatgatggcggttttgatcctcaatggggctgtaagttctttagattttgctggaattaaggtatgagggtgccatttattgaagactgtccttaaggcaagaattgtgcaaaaatttccagtggatccatttaatagaagcaatcggctaaagcaaacaagggttcctgtggatcaaaggttgggcccagtgaaccaagatcgtaaccaaaaggacaatgaagacaggaagactcaatggtgtccttctggtatctttacaaaaaatcagaagagaagggtttaaaggttgaggaactggaagcgctttcaggaggttgagcaagaaatcaatcatcggttgaagaaggcgaagccgagacaggtgtggcgtgttagaaatcaagctcctgtagccgatgaagccgcagccgatgaagcgaagatgttggctaaaggaaaaagtgttgtgaccgcatcggttaacatggttttcatattgcctgctgaatttggggtcaagcaagccgatgtcgatgaagttgaagaagaatcggctaagttgattttatcaccagagcaagcagtcttcgagaagccagaaggaacagagaatcggcatcttaaaccattgtatataattggctatgtcaatgggaagccgatgtctaagatgatggttgatggtggggctgcagtgaatttgatgccttatgctacatttaagaagttaggtagaaatgctgaagatctcatcaagacgaatatggtgctcaaagattttggtggtaatccatcggaaaccaaaggagttttaaatgtggagatgatagttggcagcaaaactatccctacaacattctttgtcatcgatgggaagggttcttacagtgtcacgcccggaatttctatcgaaaattccaaacgcttacatgtgtgtaaaccctcatccaggaatcagccgaggcacacaataacaaattgataatagagtgcaattattactctaattaataagcgaatataaagtcattacagtggtagatagttcctctcaaacaataaagttctaagcatcggaaaataagataaacggcgcagacgactccatcccacaagcagcttgaccagggctacacctaatccaccacaccttcggcatcactgtagaattcctcctctgatgaatgattgcaaggtgagtatatgacatactcaacaagccacgcagcaaatatgcaaatgcaagggataacaagggatggcataatatagtctcatttgcataaatggcatttaataaatacttcagaatttaataaaacaataatgtatttaattaagcaatattaatccatcgctatacaacatacccgttgcataggcccaaccattccgaacaaccaatcccggctgcacagttctatctccaaaccaggaacataccattccaaacctggagctaaacaagttattaccaagtacaacatcatttattatggtgagaggtgtgaaactaatcacgaaagacattgttagaccggcccataaccgcgggcacggctattcgaatagttttactctggctagaggtgtaccactgtacccacaagacacaatctcaacgtcatgtcaaccatgcgtcgcgatacttaacaagtacccgaatagagattgtgacaataccctctgcataacacaattcaaagcaatgcaccgttcctggatcataatcacccccttaaacaaggcatggactccccagcgacccccgtgggcttatctctgccacttcacagtctggtgctctacaatgaaccatactatacagaaagtaaagccgttgcccacgctggcttgtggttggcacggttaatgtttcacaaccaaaaatcgtgaaccggtccttaattgtcatgagcacgaccatcaaaaccatgtgctcacaacccaccattatcagttttagttggcaaattaattaatcatcctatcatgattaaccatcatgagctatcattaagccatcattaaataatagtgaatcataagttatcccatttatatgagctaatgtctctaagcatggctaagcatcctaagcactttagctaaaaccatataatgttctagctaatccaaatattaaccaaacgataaagaataggtaatcaataacaaaaaggctataacaaggcaatgggttattcccacccaatgacattcaaaaataaatgcaatagttgaatagaaaaaaaaagctttaaacgggatcaacatgctcaaagggttgtttggaatctgtgtgacttgccttgctggccttgaaactcttcaaagtcttctcctgcaaattcggactctccgggaacgtcggaatctaaggataaaagagcaaaatcaccaaaacagcacataaacaatcaagaacagtacatatggatatttttaacatgtagctctcaattttagaaaaatttagagacttgaccaactaaatccgagctaagatgaattagttatgaatttttaaagattaaatcagattaaatcatttatatagattttaattgaattatgacgcaataaagaattatttttgagaaggaaaaaggatttattgcgtcagcgggctcggatttatggtggaccgggtgcacggagacggtctacggaacggacggccgagattgaatctaatccaaaacgaacggccaagattgaatcagtctaccgcgggtctacgggtgacgcggcgctgacatcggcgatgacgtcatcaccggcggcggctcacgctcgccggcgaacgacggcgcggcggcgcaaatggagggcacctacgcgtagagggcgatgcggcgaactcaccgaaggctcagacaacggcggacggcaacgaacggtgacggctgcgaggtcgaagtggcggcggcgtttgcgtcgacgacgacggcggtgctccggcgatcttcggcggaaatggagggcgggacgaggacgacgacttggcgatcccaacggcggccttcccgagcgatgacgacgaccgtagcggcggcggcccacggctgaactcccctcgacggcggcggcgcacgggctctagtggctagggtgctacgggcgatggcgagctaaagcgagggtggtggcggatagaggaggtcccgggagtccttttataggggctagggggcggcgatgaaggcccacggtggccggcggcgagatggaaagtttagggttagaggagagaaaacgaatccgaatcgaactcgaatccaccgatttccaaacaaaattagcaagagattccaaaagagaaaaggaagaggggatcggggaaggcgtgatcgaattttggaaggaggcggcggcggcttgcgcggctagggcacggctgcggcggcgcgaggtagacgacggccctgacaggtgggccccacctgtcagcgggagagaggagggagagcggcggctcggctcggcgagctgacttgggccgggcgcgcttgcaggccgaagagagagagagaggggttttgggccgactttcggcccaaagccaaaagagggattttaaaacctttttctatttaaattattcatgaaatgcaattccatttattaaaaatacttccttggctcaaataaatcccagaaaaatctaggaactatagaatcaaatgaagtatttaataaaattttatctagcccatttttgtattggaatttattatttaaaattagatcttttcttctaggcttttaaaatcatttctaataattccaattaaacaaaaatttatacatttagggatttttagggtgtgacatacagcttgttgcttggaagggattagattcatgccaattgttgtattccttcaaccatgcatcaatgcttgattcagtggcaaggcgacaagattgaaattgtgccagctgacaggtcagttaatgttgccagtgacgatttagctctttgggagatggatggtcttgattgcttatctggaaaagtttgggatggacatttttttaatcaatttttttgagggtgtcgtggagggttcaaacgtctacaccaaggacacagtagatgatctcgatgacaaacaaggacagggtttcatgtcggccgatgatttggaggaaattgatataggtccaggcgatcgaccagggccgacatttatcagtaaaaacttatctccagaatttagaaccaagttgatagagcttttaaaagattcaaagattgctttgcttttgtatattgtgagatgccaggactcagccaatcaattgttgaacatcggctacctatcaaaccaggggttagaccgcaccagcagcctccgagaagatgcaaagccgatatgctcgaacctgtcaaggctgagattaaacgtttatatgatgcttgttttattcgtccttgccgatatgctgagtgggtttctagtatagttcctgttattaagaaaaacgacaaggtccgggtgtgcattgatttcagggatttgaataaagctaccccaaaagatgagtatccaatgccagtagccgatcagttagttgatgctgcctcaggacacaaggttttaagttttatggatggtaatgcagggtacaatcagatctttatggccaaagaagatattcataagacaacttttaggtgtcctggtgcaatcggcttatttgagtgggttgtaatgacttttggtttgaaaagtgctggggctacatatcaaagagccatgaattatatatatcatgatctgatcggctggttggttgaagtctatattgatgatgtggttgttaaatctaaagaaatagaggaccacatagccgatttgaggaaggtttttgagagaaccaggaaatatggcttgaaaatgaacccaacaaagtgtgctttcggtgtatcgtctggccagtttttgggatttcttgttcatgagagggggattgagataactcaaagaagtgttaatgcaatcaaaaagattcagcctccatagaacaagacggagttgcaggagatgatcgacaagataaattttgttaaaggtttatttctaatttgttcgaaaggttagagccttttacaccattattaagattgaaagacgatcaaaagtttacttggggggtagagcaacagaaagcattggataatattaaggaatatcttagctctcccccagtgttgattcctccacagaaaggggtacctttcagattatatctatcggctggtgagaagtcgatcggctcggtcctgattcaggagttggaaggaaaggaaagggttgtattttacttaagttctcgactcttggatgcagaaaccagatattcccctttggagaagttgtgcttgtgcctgtatttttcctgtacaaggttaaggcattatctattgtccaacgaatgcactatcatatacaaagccggtgttgttaagtacatgttatcgcctccaattttgaaaggaagggttggaaagtggatattttccttaacagaattcgatcttcggtatgagtcactaaaggcagtcaaggggcaagctatagccgattttattgtcgatcatcgtgatgattcaattggctcagttgagattgtgccatggactttattctttgacggatcagtatgtactcatggttgtggtatcggcttagtgataatttcccctcggggggcatgttttgagtttgcttatactattaaaccttatgcgaccaataatcaagctgaatatgaagcagttctcaaagggttgcagttattcaaggaagttgaagccgatgctatcgaaattatggggggattctttgctagtaatcagtcaattggcgggagaatatgagtgcaagaatgatacattaatggtttataatgagaagtgccaagagctaatgaaggaatttcggctggttactttgaggcatgtatctcgagagcaaaatattgaagctaatgatttggcccaaggggcatcgagatataagccgatgatcaaagatgttaaggttgaagttgctgcaataacagccgatgattggagatatgatgtacatcaatatttacagaatccatctcaatcggcttctcggaaattgagatataaggcgttgaagtatactttattggatgatgaactctattaccggacgtatgatggggtgttgcttaaatgtttgaataccgatcaggctaaggttgcaatcggcgaggttcatgaagggatttgcggcactcatcaatcggctcataagatgaagtggttgcttcgacgtgcgggatatttttggctaacaatgctggaggattgtttcaaatattacaaggggtgtcaagattgtcagaagtttggggcgtttcagagagcaccggcgtcggctatgagtcctatcattaagccatggccatttagaggttggggaattgatatgatcggcatgattaatccaccatcgagtaaagggcataagtttatattggtggcgaccgattattttaccaagtgggtagaggcgattcctttgaagaaggttgattctagggatgctatacagtttgttcaagagcatataatctatcgatttggtattcctcaaaccattacagccgatcaagattcaatttttgtatctgatgagtttgttcagtttgccgatagcatgggtatcaaattgttgaattcttcaccatattatgcacaagctaatgggcaggccgaggcatctaacaagagtttgatcaaattgattaaaagaaagatttctgattatcctcggcaatgacatgctcgtttagccgaagcgttatggtcttatcggatggcttgtcatggatcgattcaagtccctccttataagcttgtttatgggcatgaggctgttttaccataggaagttagaatcggcttgagaagaacggaattgcaagatgatttgacagccaatgagtattataaccttatggccgatgagaggga

SEQ ID NO: 23199 - DNA, 13018 bp, Oryza sativa
ttcatattggaatcggttgtcgtttgccgatgtacaatggtcgatattgttatgtcgcccttagttcaagctataattttatcaatgcttttgacattgtaaaattaggggggcacatatatgaaaaattgcaaatttttgacaaaatatggagttatgttgaatcggcatgaaagttattaagataatttcaatgaagagtcaaagttttgttagccgattacaaaaattcctaagacctattatacaagatatcactgagacaaatattgctggatagcccaaatagctctttgcctgatttgttgtacttcttcaatggcttgggtatcttgagcatcggttctaaggatgacttttaaagacttggtcagatcaacaacattcttgatagccgattttagtcttgccttctgctcttcgacaaactttgggagattggctagctttttatgttccatgtccaactcggcgttgcattcttgaagttgtgccaaaagctcaatcttgcgagcttcgagccgatcaatattagatttgatcaggccctcagatagctaatcaagcttggccttctcttcatgaacaagctgccgattggcttggattgtggcctcgatatctttgcgctcccaacattcagctagtctcagcttggctttctccagcttgaattgatgctgctcaagatagacggcaggagtaaggacatcggctagttcatctgggatcagagcttgaacctcatgtagccgagtcctaattgatccgcaatcaaccactaagctatctaacgatgatgcctctagccgatgagagatatctttgagaattttcctcacatcatcggataagggggctaaagctttgcttgtggtatcttcttctgtctcatcaagataatctctaatgtcaaaaagagaaaagattagctaagacctgcaataatgatttaaagagagttagagctaaatagacatagccgatctaaattcttgtatcaaaaggaaacttactgggatagcaggagcagttggttgttcttcttcctcaacatgatggctccctatagccgatggagtttggtcactcgacgatggttgtgcaggaaaagagggaggaggaggaggaggttgtaaaagagacaaatgttagacaaaattggctgagatcaactagtgaaagcattaaagatatcttactggtggagccagttttagagttgttgatgccgatttcttcttcacagcaattctctttttctgcaaggatgagattagtgagcaatcggctgaggataaatagttataaaagagaatcaaggaaagatattcaccctagagaagtgagctggagcagagggggtcggaggagtttgcttaggtgaagccgatggagttctttcagtatcgcttatttcatctgcggcttgatcaacatcctcgccgatttcttcttcatccagagcttgttcaatggatggatctagggcaggcagatcatcggttggtttaggcttctttaatttggccttcttctttggagtaggagacgatgtatccatagccgatgacctggttcttctctttttactggcatcggctggttctctgatgagcccttggagaagagttgaagtctggggggcatgatagccgatgacaggaggagatggcccacctcatttggaataaggcctggtgcatactctatgtccctgccactattggtctggtgaggaggggagaactctgtggtctgcaagtcagaaaagaaaattaattaagttatgaatcggctaagcaattatttaaacggagttaattaaatgaagacatacctgagggataacatctggaaagagatctgtcatgtacatagaagccgattgatggaatagatgcaatttccattcaccccaccatctgtcaaagtttttgctcctgaactttgccatctctatattttcaatgatgcccagaggaggtccttggagattgagcagccgatccgtcatcaaggttgatgaaatttcccctcagcactggatcttgtcagcaaagaataagccgattgggagttggcccattccaagttgtctggctaagctcatcgggtgatagaattcataagaaacttggatgtttcttccctgatggatgccaacaggaaggatgcatgggctgattgcagctgagaaaacttccctggacttttggtatctttcatgattgatgtcttcaaatctaaagtccgatgggagctcaaggtttgctgaatcttcataaggaaaccaaactcaagcatctttttgaaagccctcatagaaactgcagaaccggtccttgagcagttcaaccaataattttgctccagcatcggctggtgtggatgcatattctctatatgacatgcatctgcgatgagtgcgctcttctccatcatcttctacaatcggctctagtcttgggaattcggcttctgttacagatggccgattgacaactttcatgaccatcagatttagccaagtctgcagcagacaccatggtccacctgctccaactactgagccgacagctatcttggccgatgcattattcaacatttggtatagatagccgaggaggattttgcctagaggaaattgtttctttgattctagggcttcggctacaaattgccaattggttgtaggaccacaactggatccacagaagaggaacttttctagccacattagcaagaaagctacatgttcccgagaattgacaggccctttgcccatatatgccgctacatagctagaccaacctcctatgcttttggtcttgaaatcaaattgattcttggtgttcatgctcatagggttagccaatgaggttacatctaatccaatgatcatggtgatgtcaatcagtgttggagtcatcggcccttggttgaacaaaaaggcattgatgatgttggaccaaaaataagtggcggcggccatcagaggttcatctttagctgaattggctatggtaagggcaagtgcttggccgattccaatctcgtcccagtgaactttctagctagccgatacgcgcttgtaccatgtaatccaacttttctcgggtggagttttctcgagagatggccaagatttgaaggtatttttccagtgacctagatctgggttggccaatctgaagggaatcctattggtttcgccaatgatgaactcggtagggtcagggttgccgactgggccaaggaagtagtaattttcgtgcgacaggctgggaattgcaactaggttggagagatgctacaaatccaaaagaaccgagaggaggaaaaccagatgaggagttggaaaatcaatctgttgcgaggaaaagagatctagccgatgagaacttacctcagcgtactcggccgacggcgcggcagacgggctggcggaggacgacatcgccgcgggcggagatctggccggagatggagtcgcttggggatcgccttgtgcgtcggagaaatcgccggagagagaaaggacaaagttggcttaggcggtaaaaacggaagtaacggagtgaagattttttagggggcaacggttagtatttaaagcattggaataacggtcggaaaacgacaaggtgtgaatttcactcggagttgatatatggcaaatccgaaacattaccaaatattccggacttgggggcatgtgttgacgaccaaatttagtaatatcagtatcgaagatgaaaaatagatcgaagcgaaatcaaagaagaagattgattcgggaacaaagtaagaatcggctggagtctaaattggctacgatcaggattggctgagtccgagtcagactgggtaagccgatatagccgattccgacaatacgactcggtatacatcatcgggttgagttaatgtgcttcgtgatgattgccacacatggatagagtcctgagaaggcaattgtatctattaattaggatattttatgtgatttccttagagatatatttgggcaaaagtctgccgcaaagacttatgatatcttagagtttgttagagataagagtcgtgtccgatatggacaagttttgtaattctcgggtataaatagacctcgagccctgtgtaatcaaaaaacacacgttcaatacaatctcggcgcatcgccactcttttaacttttgttttgtttcgacgagttcttgctttcgggttgagctgcatcggtttcgatcttcaacaagaggtaaaacttgttatggcggcttacgttatcgagattagtgcttccatcgttatgatactctaatattgtttatgtaattcatcgagttatcatatatcttatataatctctgacaatatcgacatctaacctataatcggctaacatctgtcagtagaaggcagccgattaggttagatagcgacgttggcttagattatatatgatatccaccactctatgaaacacatcttgattgtctagatattgtcctttttttcatacttatagctgcatcagttgagttttatcttatgagtcgtgattagaatctcaatctctagcctgcttcttggttgccgattagggtagtatcggggttttagccgatcttacttgatttaaccatatttatctcgtatgcttcattgacatgttaaatctaccctttatattaagatctggtggcatttaagtatattaggctctttgtttggtatattttacttgctttaatatctttacatagagtagtatcggagtattagccgatacatgctagatccatctgatcggctatgctatgaacatatatagtctcgttgttaatatatatttcgatctaagtgatttatactgtctcggcatggcaaccgatctatcctaatcacttgatttaagtatatatcgacataaggattatatatcgttaatatctatagccgatctagtagatttagttatttcttactttttaatgattgccgatcgatgcatatatgacatcggctcaaagataaaatgatatgtcatcagcacttagccgataggctatcgtttatggatttaaccgcggtttctttgtctttgctcttgttgattgcatgatcaaatcaactggcatgctagcacacctgaaggcgagttttggacctgcactaaagttaagcagatctctcaggcctcgtgttttcacatcaacacaacgctaattttattggagtggattggagttctcccatggatccttcaccgattttatgtgggtgaaatttggctcttgtttctgccttatgggttgtatggaactatcaaagtctaagtttggtaggtgcttcatgagattagattattgtcaggattatcttgttatgagattagattattacccgggacaattttggtaagtgttttttttgtctccgattggaaaaatcggacattgacgacacaaatgcacgtacaaaacggattgacaaacgaaaaattttggtggccaacaaaagttagtagttattaagattagctctgattatatttacttttaacactttttattggccataacaatttaatttttattggacataataattttaccttcggtatgatcatttagcttgctagtgttaaggacgtctatagaaataatcaacaaggttgagtgggagtgaattattaattgtagggacaaaatggaattttttgtattaaatatgtgtggtgacaaatgtttacaattttttttaaaaaagtaacaaataaatgagaattaagagatacgatatgttataaagagtacacaataaactgaatttaggcaacattttggaagcgcattaccacgtcaaatgatatggtggttctcaacttttagttaatacccatggtttcatggtcaactacatttgattagacacacaaaacacaaaattaggcaatttaacatttgaaacaagtacgacatgtgtcatgcgaacaactcggacgatagatactttcaagagaaaattctttgtgtcctctagagtacgggcctatcctttccatactcagttttcgcctcatcttgctacattgctatcatttaggtcccaattgagtttttgtgattaatgataacatggtgtataagcattatggttctgatgacaagatgttctacaattttgtttcgtcctaattgagagatagcatggtgagattaaaggctatatggcactatatgagtttctcgcattcaaggagttcgaaggaatacggattagcctaggttccttttttcatttttaaaggaaaaagtacgaattacccctctaaactattgtggttgtatgatttaccctcctgaactgtaataccggacattcgacacctcaaactgctaaaaccgaatgaattaccctccccctccgcagcactattttgggcagttttgggtaggttggctgacgtagcatttccaacgtagcaaaaaatattttaaaaataatgggtctacttgttagtgcttcatatattctcacctcttctcttctacctcttttcacctcgatctctgtctctacccttgaaccgagtagggaggaggaggaggaggaggcagcgacagcggagactagtcccccgtgacgcttgaggcggaacgtagtcggccagaaaagcctagggtgatgacggtgcatggtcagcggaagaataatcctaaagcggcggcggcggtggtctcaaatccaagacaagggcattggcgcgccgtccttgccagtgcacaactccgtgacggccttcccatgccgcaacaacctctctaacttggccaggtcaagcattggccgcccgtgttgacgacgaccaacaacaccccgaggagaggcgaggacgttgccagcataggaggaggccgagccgcacgctgacatgggaggaacgccgagagatgcaaagaagggggagagagaaaaagcagcgctcacaagtgggccccactggtttttatttgtttttgctgactgtatcgccatgttgacgaaaaatccgcgctcgccgatggtgccggatttgtgttggctcgaactaagttgacgaacataacaagttgggagatctgcttagctctagtgcaggtccaaaatattgttgagatgcgggtgtgctagtcattttgattctgcaactgacaagatatgtaaacaacagatcaaatagccaatcgactgacaagccgatggaatggttccagccgatatcgatagggtttgagcaatcggcttatatatccaatgtatattctgatacctgagtaaataataatataaagacaatcggctgttgatgataaataacaataatataatccagtagaaaccaatcgaccaataatgatataatagaacaaatgatgatctggaggttaaagcatacatcgcctggaggaccaatatcgtaaaatccaaacgattaggtaaatagtgaaacctttgttgagatcggctaaatccaacttgtatgtaatctttataagtcgatgcaacattgagataactcatcggctgaatcctcgataaaatccttactggcaatcatgaagcaggctagagattatgattctaagcacgacttagtagatcaaacttaactgatgtaacactaagtatgaaaagaaatataatatctagacaatcaagtttttgactaattttcagggtggtgaataccttggctaatatagaacaatgaatcaatttaactaataccaatgaaaccctagaaaagatatggccgatataggtaaattgaaacatcgatttagattaactataagatgtatgataaataggtgtttacatcaacaatattagagtgtcatggccctaaggtgctaggttaggccagcaaccctgataaatccgctgatgatattagaatcaggacccttgagcagatataagctttcccatgaatgacactggacaactgcataaaggaaaaataacgctttcatgccgatgtaacaactctgaacaaacaaaaatattcgtgctcagaaataaatttgtcattgtaccagaagatccagatgcaacaacaccaaaagagtcaaagagatgaattttttacatctgaagagataatctcacctataaatgtcataattatacaaatagcacgtccatggcaatatgacattggttgggcagttcacgcagatggttctgctgtaaaatgataatacaaaagtttagttacaagcaaagcaaggataaagtgattttgagcagtttgcaaacagtaccactttcaatcttctaggcttctagcaaagcaaggaaaaattttcagaaccactcaatcactttcacacgttcataatctagagttggtgatttcgagcaccttgcagacaacagccctttcaatcttggcattcttacatctctaaaaatatcgagaagcaaatacaaattagttggagtgatcagtgatagagggagatcaagagcaaaagacatggagctagtggcatggcagcaaaagctataagagacatagcagcaaaatcattattgttatttagattgaaatatcttgaagagcttgtcctacttggtcagagatatgattgcaaaaattaaatttgaaatattgtcgatggaaaaaaggttatcgcaaaatttaagttctgtacaaaaacaaccatctgcagtctcttgagcatcatggagaaaattttaagcgtcttttgatcattagcttcatcaaaaattacaattcaaaacaattgttgagcatagcatctgttactggatttacaataccttgatgatgccccacaatactttcattgtaaaaacatatacactcctcattggcaggagaggaactgaagtgatttgtgttgtcagataaataatccaaggataacgaatacaactaattaggcagtgtaaatccaaaactgcaatgccgtcatacactcatacatgaataagtagtaatgccaaaaaagtcataaaagcccccagtatcttggaaactactttgcaattttcttcaaactgagtggcgatggattcatgtcagtcaccaataatggcgtagcatcaaacttggaggactggatacttttgcgttctagcctcttgtaacactgcagcattcaaaaattcgatttagttgaaatatgccaacagaccccatatgaacacggtgcttgcctttcactctagtgtagtgcagaactttccactgatgatattgatctttgatggaggctagtcattagtacattgagtaaatttcgacctaagttgaatgaacaacttatgtttcaggggaaattacacgcaaacatctcttaattcagcttttttttccctcctaaaagatagggaaacaaatgaaactaacttaaactgatttttttacattttggttctttttgaaaacttattttacaaatggacccctggaaaaacttaaaccggaaatggtcttttttaggacgccagaatggctggcgccgtcccccaacatggcggcgccagcaacactgttgctggtgccgcgctcgtgccaccgtggcaatagggcgtacgtggatggtgtgacgtggtaaaggagggcgccagccacactggcgccgccccttctatcacggcgccagccaggctggcgcactcgtcctgtgtgggcctcacccataaagccgcgcgagccccactccctttctcctctcccactcagtttcgcccctctcccagcccgagcagcagcagcagttctctccctctctctccccctcacctctccatctctaatccactcaatttgaagctgtttttcgcgggaattttttgtggaaatcgaagagaaaggtagactcctccatccccctatttttttcgtttttattggttgaatttgtagatcggagggtaaccctagaaccccttttttgcccaaatttgtgatttttagaatttgttcttgggattggcttgttgtagtgctacatgtttgcaatgtactcattggtgtcatgaatttttgaaccatatatgtggtaatgttaatttttggatggtttagttggatggatggatgaaaaattatggttgaggcatgaaagtaattttaatttgatggacttgatgctatagcctataggttaaacttttaaccattaattatatgaaggggagaaaattttggttgcattatagaaattttggttgggttgtttgacggagtatttgtaatattttgatgtgtaatgcactagtaaacttgttgatagttgtaggtggattaaatatttttttggagtagtagctttgggacaatttaagttatgcattggttataatatgtcggtttggactacgtttaggaagaaagatttaatttttgttgcaaagttacatttgattttttggtgtagatggatagacttgttcgtgtttactacggtggtagagtggtggaaccttatgttggtgcacatgttgagtttgaggatatgtcattgaagaccattttgtttcctacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttacatcaaagttggtacgtaccgtagaaaatttggatctaaacaaatctccttcttatcattacgttgagaagaattttgtgacatattcttctcgtcgtgaaaggggtgcaagtaagactgagttggtacgagaagacttggaggaggaaggagagaagaagagacctttgtttggaaatgaattaggggaggcaggaccatcaaagagacattgcggtagtgatgatatggatgcagcgagaaagatgaaaagggagttagtacaagaggggcttgatctaagtgaacatttgtcggagagtgtgcattggtcgttgtacggaggcaaccctgaatacccgacgcaagtagcaggccaatatgtgaatccagatgattactttgatgtcgaattgagtggtggtgcaaatttagttgttaacaggtggtcacgattctgtctcagtagaagtcaatagagaggaggttgacgaggaggcaagtgttgagcaatatgatgttgaatttgtaaagactctgatgatgaccgtccattccctccactaactaacaatgacaagttagcattagagaaatgtcgtgcgtttgagaaggtgtttgggaggaagccggacattcctgagtttagggacctaacacatgcccatggtgcaatactagatggcggcatcaacctagatcaattgccagaaccattccagatggatggtctcagaaagggtttagagttcccatccatggtcgcattgaagctatgactccaggagtacgccatcgtgcaccatcgtccataccgagttgtcaattctgccgcaaataggaggtacactgttaaatgtgaaaacccacggtgcaaatggaaggtccatgcaactaagaggtctagtggaacgtggaggatatcacaggttggtaaggcacatagttgtgctactgccaaaggttcagggagccaccggcagctgacatccaagttcatagcaaataggttatgcaatgccataaaactacaacctacactctctgcttctacgttagctttgtatatatttgaagttttccagtatagggttaagtatggcaaggcttggagggcacgagaggaggctatgaagctcatttacggtgaatggggtgaagtgtacgtccgtttgcccactttgctacaagccattaagcagagaaatcccagtatggtctaccacatcgatactcatcctgataggattgtcaacattgatggagtgaccaagaaaatttttatgcgtgcattctggtgctttggtccttccattgaggcttttaagcattgcaggccagtactagctatagatgcaaccttcctagctgggaaatacggtggtgccttgatgactgcattatcagctgatgcggaggaccaacttgtacctttagcttttgccttggtagagaaagagaattcatgagactggtgctggtttatcgatcttgtccgacgggttgtagttgggccgcacagggaggtttgtattatctcagatcgacatgttggtataatgaataccatgaggactcctgttccaggattgccaccggtttaccaccgatagtgcatgaggcacttcagtgctaatttccacaaggccggtgcggacaagcatcagacaaaagagctcctaaggatatgtcagattgacaagaagtggatatttgagagggatgttgaggcactaagacagcgtattcccgaaggtcctcgtaaatggcttgaagatgagttgttggataaagataagtggtctcgtgcatacgatagaaatggccgacggtggggttacatgacaaccaacatggccgaacaattcaatagcgtgctagttggtgttcgtaagcttccaatgacggccatagtatcatttaccttcatgaagtgcaatgattactttgtgaacagacatgatgaagcagtgaagcaagtccagttaagggagcgttggtccaccaaggtcactagtaagatgaagatgcaaaaaagtaaggcgaacaaacacacttcaaggtgtttcgataagcagaaaaagacatacgaggtcacagagaggggtggtataacgcgtggtggtgttagaatcggcgcaagagtcttcaaagttgaaggtgaggggaactcatgttcttgccaaaggccattgctctaccatatgccttgctcacatctcatccacgtgtatctgattcatgcaattgatgaggaatctcccaa

SEQ ID NO: 23200 - DNA, 1249 bp, Oryza sativa
tggagcattgctatctgtccgtgccatttttttattttttctcgttatgaattagctaatataacagttatgttttagcttcatgaatagtttgatctcttttctgtttgttcttgctgagttgagaatactatgcatgtagctattattcttcaatgatagggaaagtattagtgaagttagatatatcaatttgagctatttgattgagggtaatatggtaaatgtttcattgggtacaacatatagtttggcaggtccaatcaccctccattgtctcatagattccgacattcatagttgcactcaattaaaccctgtttcttataaattatccagctaatgttcatactccccaccaagagtcatggtactataaccttgtaaaatgtacaaaacgtgtacacatcatgtctgttgagtttttcatttctaaactatctttttttttgtgttagtatataacataatattgaggaatacgcggaataccattatactttattttgttttaagtggagaacaagtgaaatggaaatttttgtaaccattcatgtatgcaattaaaaactaattgcaggataagttcatctcctgtgttaattatattattgtgctgtgatcacttcattatgattacttggtagtcaatgacttcccatagatgctgaaatttgtttctttagtttggtttgctgcttatctgctttgttgagttgttaacttcggttttatacgttactagcgtgtctgaagttaagatgagttatttcaatgcagcaactaccaaaccagctaggagatattgtgaatgtaactgatgctacaacacggaggaaccttcaaaacagtgtagtcagatatggagttctcatccaataccttggttcattacttctagaacttggccgcacgacaatgatgctgcgtataaatcctgcaactgtaggtttttctgacagcttttttttttacctcgtttcacattggaatgattctgtactgctgtactgaccagtaagcattttactttcagtcagaagcggttgtcaattctggaccagctctttttatctctccatctggaccaaatcctcttatggttcaagtgagtaatttataaatcttataattttaatgagtaaatttcactaaacctctacctattatgatccaagttgcacaaagccacgggtattttggcacatgccactgccacatatccctgggtattatggtcttaaagttt

SEQ ID NO: 23201 - DNA, 7236 bp, Oryza sativa
  unsure (1)..(7236): unsure at all n locations
ttaaatttaatggaaaacttccgtccattcagggtacccgaatcaacccttgaggggagactatagggaaagggcactcttggaaggagagcaattatgactacagacaacgatttattccgtaaagtacatttcacggttttgcaacaatcttcgttggttgctccttacatcgaggagcaccaggcgattgttcgctcagaaaacattggcaagtccgatgcctggattacatgctatcatattgatactttccccgcttggctgcgacaacacctcatgggtaacgagatgattgaccgacaactagccttcttggctaggggaccatcttgctcggtctcgacattccaaggatatgaaatcaatggaaacacattttacacaagagccaaagacaaaaagagcacgaaccaaaacaatgatgttcgtatcaatgccataagatatgatagtacaactagcatgtattacggtgtcatcgacaacatatgggaactagactatggacccctgaaggtccctctgtttcggtgccaatgggttaggctgactggtggaggcgtaacgattgatgacagcgggagcagtgtagtaggaccaatggtctagaacaactacacgtaggtagccaatgcgggagcagtgttgatatttcttatgccctcacaaaaatgttccgcgagtgcacataatcataaatatgtttcacctcgaagtattctggagtatcgtatttatattttccgtaaaggacatactgatggcataaaacatttcatttgttttaccttacatgtctatgaaatttatactaagaaagaatggggcataaaagatcctatattgtcctcagagattcgtcactttcaattgttgaaaacattgaagatcctacattgtccacgtataacctcactaccggaggaaggcatgccgtcttcgctagaggaaatggacatatatcggtgcagcagtgagttaactgaactgcgcaggagtatgagtgaaaataaaacgttccgtatatataataatgctaattttgaattataggttacatcatatctggcctattgatcaagatcgatgctagctactttcccttttgtctctaagtttcgagctggtagctagacaacttttatgttttattaagattatgtttttgtgctgttgggcttggtttcaagctgggtaatggaagttgcctgttgtaaaaaaaaaatgctcgctacttgaccaaattaactagcctttaccgatttgatttacctttctcattaactgaaagctggttccatcaaatataagaaatgtcatgtccttttcacccttgagttttgccatgccctgaggagattaaaaatgaaaaatgaaggacatatataatgaaatttttgtacttgaggtactttccggtataaatttggtatctcaagctacttagtatctgaggtaccaaaattctgtgtacaaaacatggtacctgtagataccaaatgttggatggtaaaataaatctaatattgtatggtaaaattgctctataaagcttaagtttgtattgaaggaatactactaaattaaaatgcacataaggaattttcttttttatttctgtctgttcctccgtttaaggggagctccaatgtcatactaaaaccgaacacattttgggagtcgaatagtgtgtcattgaaaaattgacattcaaaaagaaaaaaaaggaaatatctaaataccccctacaactcactagtgttttgtctatttcccccctacacctcaatctcatacacttccctgcaaatcaatttatcttataactttctaataccccgttttcatctattttgtctagttacttcaatttgtaaggaccgatgggcctcccgcgtcatgggacaataagaactcatatcacctcgagagattggtatagtataaattatagctagctcacaacttagcaagttgagccatcatgttttgccatcattacctcgcttgtacgggatttgtgaaaggtttccaaagacccaccacaaaggtatatggggtatgaaaagttgaaataagaaagttaaacaatgagaataaatcaacgaaagcaagatagggggaaagctagaagagaaaatgacttgcatggaagaaattaaagtggaaacacaagagatgtagaggatatttggatctttttcacaagacccaataaaatattctaggttcggttgtgcacgagagaggtagacgcgggcgagactaatagtttctctgcgtggatcccacatatcgatttccacatggacgaagatcaaactgaaatttgtgcgcttgccaacagtattagagttccccaagaagatatggtagttagtgctgggtggattggcgagtcttcaccttcacttatcaactatgctagcaacagctagcagccactactagctgtagctagcatgaaaagaaacgtgacaacacgcgcgtatgtagctatgtgcaagttggcgcataatttaacgtgactacctctcggctgtgtgtttgacctgtcaatgcctcacagacctacagtactcctgtcgtagtatctctctatggccttgtgttttctgtacatcgctgtcgtctcctcagtcactagccgcgctctgtgttcttcggtgagtattcctcagcttctatacggaaaatatagcgatgaattagtgtaggattaattatatattagttaaagaaacttaataagtaggttagtttaattgtttaaagtaatttttctacagattttttttaagaaaatacacggtttaaaaacgtgcgtagggaaaaggaggagaggattgtaagtttgcaaccagcagagctttgccccggggcgtcggcacgcactgccacctcgccctcgaggcctcgacggcgccacagtgccacacccattctctgttgatccctagctgtagttgtagctggcagatggacaaggcggcggttgttccacttccaatcaccggaggagtcaacgacgatcgtactgctgcgctgcagcagtgggcttccaccgtcggcttcggaggcgaggtggggcgcctcgtcgaagcccaccgacgcctcgactcggtgctcgcggagacgcaggggaaggagatccggaacaaggagctccagcggcgcctcagggaggcctcgcatgatgctgcccgcgcccgtgacctcctcggcgagctcgagtactaccgcatccgcgaggaggtggagcgcgacgaccacgataaggtcagcgcaggttttgttttctggatttttttttattcacctgaggtcctggttgttttgttccccaatcctcctatgtacttgtactacaaatcgaaggcaaattactgcatatttcaaccatcacaatcccactaaattttggcaatttcagagctttcaactgttaaaatagcaacaaatttgataattgctcaagtcaaacatcgccttaccaaaatttttgcgggaatgccaaaaattggctttagtgaagtttgataagatttactttcgcaatacaaaccaaacatgcccatggtaccttcgtgcacgaagcaggctgtggcatgttcgtgggctcgatatgctttctttcatttctcacccaatcagaatgcagtatccatactttggttttgatgtgactagtgaaaaatgttatgccggttacggtggattacaaacctatgccatgaatccatgatgaatgatcataagtccatgcctctttttgcgataattgaaattaatccagcatctgcatcaaaagatgcatctgaccctattttattacagctttgcaacatgagttgctaaacataactactgactatatgagaatatgaaaatcaaacacaaatcctactactaaatctccaaccatgtgtagagttttgatgacgaccatctcaattttgctacatgccatgatgatatctgatttgtcatcttcattttgcagtagataacagcaatcataatggcacataatcttcgataaagcctcctcatccttaaaaaggcccttcctatatttacctcgatattttgtatcaaaaaatagtcagatttttcaacatgcatatgtatgaagtaaaccacaatcaatcttccagccaacagcacacctgcttgcaatcaaaatggaacaaggcaaaaagatttgagctcacaggcctggaaccaaatgagaaaatggctggttggaaaacacatgttcacacaaaattagcaaaactgtcctaagaatgcactaactcaccaaattggttcactagattgctcagtgtttagattcttgtactaaatacccatttgcaaattgcttttgtgatgtactccctccgtttcacaatgtaagtcactctagcatttcccacgttcatattgatattaatgaatctagatagatataatctagattcattaatattaatatgaacgtgggaaatgctagaatgacttacattttgaaacggaggaagtattggttagtcctcaagctcttgcactaaaccgtaagccacctgccatacttgaggcacaatttactcaagtaaatttgaaacaaattttaatgacagtgtaaaacactgatttactttttagatactagaactaatatcctggcctgtgtgcctggagatacacacagctaaaacactgattaactaattggggaacttataattttgttgagaatgatactgcaggggaggcccttgcagttaaaactattattaaaacaaataagatacagaattacaacagttcaagccagtaatctgtatctttttaccagtaataggaattggtatttatccatattttgttctctcgctatccgtttacttcaacgactggatttgcaaagtgctgtcttgtgcaaatgctctgtttcatacattatgatataataatgtatgtattcaatgcagacaaatttctattatatgtgaaatacttgacactactttgtagtggactcttcaactgtgacgtgtcaaaccaaaatataaatacaacttcttttagtgacatgctttacagaattatcgtttcttgtgggtacagagttatactaaattatgatgcatagcaacttttgatagttgtttaaatccacttttgcccctttttttcagctattgcatgacaatgcaaatggaaatttgcttctctccatgcctcaaagggatgttgagttctttaacaatgatgcagcaaaagatgacaaagacaccacagaaagttctcttagcaacacagattcatctgcatctgctcttcaggttactacgtacattgctagtagcagtagtccagtaccctatctggagactcttaacaagtgcatctcgaatgagataagtaaatacactgaaaaatgctacaggatagccaaacaggtgagtgaagctcttgagcttgaaagtctggattacctttacgcgcacaaataccagagaacaagaacagatcatcgggagacatcaccatgccaaagtgaacccaaagttcatgggagggaccaacagcgtgacttgataataagcaagttaacaagtgaggaatgtgctaggaagaaactctctatccttgccatcatcggtgatggaggtattgggaaaactactctggctaagctagtcttcaacaactcaacagtgtcaaagcattttgacgttctgttatgggtttatgtatctgttcactttgatcaaaataagattatgcaggaaatgttggactccttttgcggggatgagcatgatgaaatcaagaaatcgaaggagcttcaactccaagacaaacttgactacttattgaagtcaaaacgagtgctacttgttatggatgacatgtgggaggatagcacaaaggaaaaatgggatgagctgttaaatccattgcttaaaaacgatgttatggggaacagtgttcttgtcacaactcgtaaaccatctgtggcaacaatgatagaagcagcagatcacatcaacctggatggtttgaaaaaagatgacttttggtgtttgttcaaggaatgtgtatttggacatgagaactataaaggagaaccaagactggaaaaaattgggcagcagatagttgacaagttaaagggcaatcctttagccagcaaagactgtaagcaaagtattgagaaggagctttgacgttgattactggaggagaattctgcataccggtgaatggaagtacaaaaatgatgagaatgatatcatgccggccttgatgatcagctacaaatatcttccagctcaccttcaaagttgtttctcgtactgtgctgtgttcccaaagtatcataggtatgagaaagagcgtctgatcgatatgtggatagcgcaagatttgctatgttccgctgatattcacacacgacctgaggacattggaaatgaatactttgatgatctacttgattggggatttttcgaaaaacagtttgagcactcaaccttactcatcatgcatgatctaattcatgatctggcacagaaggtttcatctgacgaaagctttaccatagagggcaatgagcctaggaatgcaccgccatgtgttcgtcatgtcagtgtaataacagagtgggagtacaaaacaaaattgaatggcactgtgtatcctaatgattctttcctccaagagttctctaattccttccgtgagttgcaacaaaggagcttaagcacattgatgctgtttgggccacatgacttggattttgcagacacgtttcggcaagaactcaatgaggtaaggtcaatccgtgtgttgaaactggagatggtcttctttgacttggattcattgataggcaacatctcagcatttgtcaatcttcgctatctagaactgggctgcttctacaagggccccaggctggagctaccagaagctatatgcaggctgtatcaccttaaagtcctggatataaagaagaactggggtcctagcacatctttgccaagagaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23202 - DNA, 969 bp, Oryza sativa
ctacatatcaaagagccatgaattatatatatcataatctgatcggctggttggttgaagtttatattgatgatgtggttgttaagtctaaagagatagaggaccacatagccgatttgaggaaggtttttgagagaactaggaaatatggcttgaagatgaacctaacgaaatgtgcttttggtgtatcggctggccagtttttgggatttcttattcatgagagggggattgagataactcaaaggattgttaatgcaattaagaaaattcagcctccagagaacaagacagagttacaggagatgatcggcaagataaattttgttagaaggtttatttctaatttgtttggaaggttaaagccttttacaccattgttatgattgaaggccgatcaaaagtttacttggggggtagagcaacataaggctttggatagtattaaggaatatcttagctatcctccagttttgattcctccacagaaagggataccttttagattatatctgtcagccggtgagaagtcaatcggctcggtcctaatttagtagttggaagcaaaagagagggttgtattctatctaagtcatcggctcttggatgcagaaacaagatattcccctgtggagaagttgtgcttgtgcttatatttgtcatgtacaaggttgaggcattatctattgtccaacgaatgcactgtcatatgcaaagccgatgtcgtcaagtacatgttatcggctccaattttgaaaggaagggttggaaagtggatattttccttaacggagtttgatcttcggtatgagtcaccgaaggcagtcaaagggcaagctatagccgattttattgttgaccatcatgatgattcaatcggctcggttgaggtagtcccatggactttgttctttgatgggtcaatatcctcttatgggttgaggtatcgggcttggttataatttcccc

SEQ ID NO: 23203 - DNA, 4018 bp, Oryza sativa
cgagatataagccgatgatcaaagatgtcaaggttgaggttgctgcattaacagccgatgattggagatatgatgtacatcaatatttacataatccatctcaatcggcttctcgaaaattgcgttacaaagcgttgaagtatactttgttggatgatgagctctattatcggatgattgatggggtgttgcttaagtgttttagtgccgatcaagctaaggttgcaatcggggaggttcacgaaggaatttgtggtactcatcaatcggctcataagatgaagtggttgcttcaacgtgcggggtatttttggccgacaatgctggaaaattgtttcaaacattacaaagggggccaaaattgtcaaaaatttggagcaattcagagagcaccggcatcggctatgaatcctatcattaaaccatggccgtttagaggttggggaattgatatgatcagtatgattaatccaccatcgagtaaagggcataagtttatattggtagcgaccgattattttaccaagtgggtggaagcaattcctttaaagaaagttgattcgggggatgctatacaatttgttcaagagcatataatctatcgatttgggattcctcaaaccattacaaccgatcaaggttcaatcttcgtgtccgatgagtttgttcagtttgccgatagcatgggtatcaaattgttgacttcttcaccatattatgcacaagctaatggacaggccgaggcatctaacaagagtttgatcaaattgattaagagaaagatttctgattatcctcggcagtggcatactcgattggccgaagcattgtggtcttatcggatggcttgtcatggatcgatccaagtccctccttataagcttgtttatgaacatgaagctgttttaccatgggaggttagaattggctcaaggagaacggagttacaaaatgatttgacagccgatgaatattatcatctcatggccgatgaaagggaagacttggttcaatctagattaagagcccttgcgaaggttaccaaggataaagaacgagttgctcggcattacaacaagaaggtggtgtccaagactttttcggaaggtgaacttgtatggaagttgattttgccgattgggactcgggataacaaattcggcaagtggtcgccgaattaggaaggaccgttccaaatctataaggttgtgtctaagggagcttacatgttgcaaggactcgatggagaagtctatggacgagcgctaaatggcaagtacctgaagaaatattacccaagtgtttgggttaatgcatgattggctggtgttgccgatacatgatagctgatgtgtttacatcgctttgagatggccgatattgttatatcgcccttagttgtctttctattgtaatcggttgtggtttgctgatgtacaatagccgatattgttatatcgcccttagttcatattataattttataaatgctttcgacattgtaaaattaggggggcacatatatgcaaaagttgcaaaaatttttgagcaaaatatggagttatattgaatcggcataaaagttattaagatgagttacataaagagtcagagtttcttcgccgattacaaaaaattcctaagatctattacacagatagcgttggatagccgacaaagctcattgcctgatttgatctatttcttcgatggcctggatgtcttgggcgtcggttccggggatgaccttgagagacttagtcatgtcagccacgttcttgatagccgatctcaatctggacttctgttcttcaacaacatttggaagatcggctagcttttgtttttcaagatccagctcggcgttgcattcctcgagttgagctattaaatcaatcttgcgagcttcaagccgatctatattcgactgaataggcccaacagagagttgatctaacttagccttctcttcatgcacaagctgccgattggcttggatagtggcttcaatgtccttctgttctcgccaatcggctatccgttgcttggccttctccagcttgaattggtgttgctcaaggtacacggctggagtaatggtgtttgccagatcgtccggaattgaggcttggatttcagcaaatcgtgcccggatcaaaccacaatcagccaccagattatccaatgaagattctagccgaatggatatgtcttcaagtgttttcttgacagtgtcatccaagggggctagagccttgctcgtggtttcttcttctgtctcatcaaagtaatctttaatatctaaagagaacagatcggctaaggcctacaatagagaaatttgaagacagttagatgtcaaacagatatagccgatccaagacttggtgtttaaaagagacttactgggatagcaggagcagctggttgtacttcttcctcaacatggtgactccctgcagccgatggagtttgattgtttggtggttgctgaacaggagagggaggaggaagaggctacaaaaagataagtgtaagataatatcgactatgatcggctaatgagaaattaaggacatcttactggtggagccggtctaagtcacaggaaacgcggaacgtgggtgcgttctacgttccgggaatttcgtctcgaaacgaggaacgggaacgaagcggaacttcgttccaaaaacggaaggatcgtcgacccaacacttggtacgtcaatggaggaacgagaagggtggtacgatggaggaacgaggtatgttgagcaaaagctagtggagagtggagactcacccggatctacattggtggagacagggcgagcagcgcagttgttccttcgctgctcgccgccgccgtcgaacatgggaggttggaccgttggagaaatagaagggcgctggcaagcggcgcgccgcgcgccgctgccgcagccgcgtttctccctccatcacgcagctaggttggagtggaccgttggagaaatagaggggcgccggccggccagcgagcggcggcgcggcgcgccacaaccgcttttctccacagatggcgccacggctgatgaagccatcgcgcagccgtcgtcgttgcatcgagcttgtggtattggagacttggactacaggagacggcggcggtggctgggggatagggaccactgacgaggagttgaggacgaacgaagtgctagggctcacttttacgttctcttgatgggcttgtttgcacgcatggcccaaaaattttctaggctggtctgctgtcacatgaatggcaaaaaaatctgctgtcacatgaatggcaaaaaaaaaaaaatggtctgctgtcacatgaatggcaaaaaaaaaagaaccagagggtcgaccacgcgacgtcgtcttcgcctatgaggcgccatgaccagtgtgctaacaactacaccttgagtgaaatgtgtatgttacttaaataacttaaatagaaacgtgtaaattattttttaacaatttttggttaaacctttagtttttttattttttatgatattataacaagttttacttaatattgttgtaaaataatactttttaagtaaacaaagaactatgttaataaagaaaatgataaaaaaatagtatttatggcaaatttttctcaaggtatgacagcaaaacgcccgttgttacttcttcaatatcaagatatatactagcccaatcttccggagatgctcataaaaataaggtgtgagtgttgtggtcaactacatttgtattgtgctttagaataaaaaaaaaaggtcatgtgtatatatccgtgaatatacccatttacttggaggataaggttggataggaatcatgggatagccttatccaacatctttatagaatatttttatgtgggcggccatattccacctttaccatgaaccaaacaccatacaaaatgtggcgaccatatcccatcacccaaatctcccgacactcatgcatatatcagcgaatgtgttttgtaacacgct

SEQ ID NO: 23204 - DNA, 1710 bp, Oryza sativa
atccaattctaagttgcccttttattggacggagggagtacatgataggctatgttcgatgtgaacattaaccgatcatgctccactatacctgagtaacacatctatacatcagcggtagtggcatctataacacactctaagagatgaaaaccatcgataaattcctaacgtcaacgttcgaacgcaccactatgcacactaggactcggagaatgcaaactatatatagtgacatcaacgactttcggtaaaacctatagcgaaaccaaaccgtcggatcaccggatcgtacggcccagattgccacccgcatccccagattagcacactatgacactgatagacaccaacgaatcgatttttctggatccgtcattgtgcaccactacgcacagtatgactcaaagaatgcaaactataaaatgatgtaaatatggttcaataatccaatatctgtacgtgctaatgttctatgttgttgagaacgtgacaggatcacaagatggtgtctcttcgtattttcagtttcctagacttggtcattagagcaagtacaataagcctaatcagcaggctccaaaatattccaactcagactattcttacgtggaggagagataactagagagagggaacagagcgggcgctagatgtagcgccgggcgatacacagatacacatgcatttgtgggtcccgcagccaccccgccgatcccgtgtatcgttttgtttctgatgtgcctcttccgatccgcccgacgcattttgctctgcttcacgccgcctcccctcacccctgtctcgccggaattttctcccgcgacgtgaaactctgccgtgaaagctccagtgcacccaaaaagttagtaatcccagttctcagctgcaaagaaagcgagaggaggattgagaagcgcttggtgcgggcatgcagctggcacccaaagcaacaagcaacttcttgatttgaattggcttggtctaattcttttcttttcttctccctcggtctgttgaatgcttgtcgtctatgtctgttctaccgattcttcgtctcatctgttgcatctagtccgttctaatctcttcctatagctccttttattttcccttttgttcttctccttttttcatgtatagattatagattatgcagttggacggcagtggattgtgatatactatgtgaattatcaagtgtgttgtcgttattttttcaggtagagtagtagataacccatgtttattgcataatacaaatggccatataggccacagagttgagggcgtttctgatcatgcacatgtaaagtttattgtttgaataatgagatcatgttgatataatagccaacctattgtactagttagttttgatattggctataaaatgacatggatattattggagctagtagctggctacactattgaccttgctcttaatatgagtgtggactgtggactgaaaccaagaaataattgaaatacgaggcgtcaccttaagcactatattaataggagagcttgttggtcacaggaagagtcacctcaaaggagatcaagcattactgcattcctgtttgctgctgctgatccagtccagggttcaagctgtcaagcgctcagccgcgctcacgacgtcaggccggccgccggcaaactcaacccaggtaccgtgtttcagtttagaaaaatataaggtct

SEQ ID NO: 23205 - DNA, 710 bp, Oryza sativa
  unsure (1)..(710): unsure at all n locations
ttactaagtgcagaccaatcgttaatggtaacgaacagcaacgctcgtaggttaaatttctcatgtttgtcctcatcccacacagggacgccctctttcctccacatcactttcagatcatcaaccaatagccttaggtataaataaccaatggtcttaggtacaaatcaatgtcgttaccaggttgctttgggccttgaataataatcggcatcatgatgnacnnnngcttcatgcatagccaaggggggaggttgtagatgcacatggtgaccggccaagtgctatggccgctgctcatctctccaaaaggattaattccatctgtacttaaatcgaacctcacggttcatgcatcctctccgaagtctttaaatgttgtgtcgatatttcaccactgcgacccgtaggtgaggtgtcttagcatcccgccttgtttacgttcttctgcatgccaccgcatcattctagcatgtgatttgttcctgaaaaaccgcttcagccgtggtattatagggaaataccacatcaccttagcaggaactctcttctttgaaggctatccgtcaacatcacctggatcatctcgtctaatcttgtatcgtagtgctttgcaaacatggcatgcttctaggttttcgtactcctcaccgcgatagaggatacaattgttcagacatgcgtgtatcttctgtacttccggtcctaga

SEQ ID NO: 23206 - DNA, 7206 bp, Oryza sativa
ttactttgtcatttttaatttattgtaattatttctagctgatttaactattttccaattaacttagttttcaattattttatataaataatcatataataattccacatagtattcattttttcattattttaaaatttctaaacatactttcattgtttttcaatatttatatatatttttccttttttcctataacatatttatccaaattattttaacctaattttccctctacaagttttctctctcatcatttcccaccatataccttattggagacaatattgaatacaaacaaagccataaatgtaacatgctaaacatacatcattagatggtgttgctaaccttttcgattcctccgatttgtatattatcaataaaaatttcattaaaaattttggtagcacctccctccctcaaagctccattttgcagcaatggctcgagctagaggaggaagaagggatatataaagttgggtctaaagatctctaatgtctttagtcccggttccttggccccctgacagggggcacgcctaatgggcgggcagcgatcacccatctgtccccctactcccccctctctctccccgcttcctcctccccttcttctcttcttactacagtaaaccacaaaaaaaaatctaaaatacaaaaagttagaaaaatttatgtatagaaatactatgtataaaaaaattgaattcaaattcaaatttgaatcgggtatgtaaacttttgacttataaacttcaggtctataaactttaggtgtataaactttagatgtatagaaatactatatatagaaaatatttgaattcaaattcaaatttgaatcggatataattaaaattcaaatttgaatcgggtatgtaaacttttgatttataaactttggatctataaactttaggtgtataaactttagatgtatagaaatactatatatagaaaatatttcaattcaaattcaaatttgaatcggatataattcaaattcaaatttgaaacgggtgtataaacttttgacttataaaatttaggtctataaactttagatgtatagaaatactataaaaatatttgaattcaaatttaaatttgaataggatatataaactttcgatttataaactttgggtctataaactttaggtgcataaatttactaaaataggaaagtaatgcggtgccaaaaaaaggaaacgtggagggagggagggggggagaggtggtgatcgctacccgatcgctccgcgatcgatcgcgcattagacttttcgcctgacaggggtctagcatgccctgttagggggcgaactgggactaaagacgattggtgttaccaaccgggactaaagatcacttagtcccattggagtaataaaccgggactaaagaaacctctttagtaccggttctttatagaatcgggactattgtgcttttcggccgacccagcaaagatcagttctccagtagtggtagttgttctagactattggtcctactacaccttcgtattcaactactacaactcattgccatggtggtctcctacctcgcctgccagctatatattagaaacatcgttacgcgtgttcatcctgtgttgttgccaggcctagtaaacctattacatgatcttgtcctccatggtttgacaacattggctcttcgaaatcatatttctaaatgactatcatgatcgtatcattgttttcagccttagcacgtccgtgtgcaaatatgatccgtggcaccaccctgcgcgcctgcgaccatgccatggtgcattttggacgcctcacggcttagctagcttgcttatcatcggctatattggcgacgactactctaagcactgttacttcagtatgactctattgtgtcctttatttttggctatctcggcaacaacataaatggctgtcagattctctcgttgatttatttttccagtctaggcatgctgatcatgtttggactattagtatgttaaatggtatgttaaagtatatataaaatataatagttataggaatatgaggatatgattgatttatttaaagttacctttattcttatattctactagaaaattggtcacgcacgttggcgtgccaactatttagcccgtgtgtgctggttagactaactttagaatgcatgaaagacataatatttgaaccgattagctaaataattgttggcatgttttttttttttgaaacggacgatttgtcagccatcagattcacgtcgtaaatggcaaacctgagttacatatagataacatattatagatacactataattatactataattatactatgatgattgcgttggaaagtttaacccataattgaaaggattttcttttatcaatgatcattgcaagaaagtttttgcacttaagaaaatgaaaaacatcacattttccattcacgtttgttttttcaaattttcatagcttttcatcaaattcatgaaaatcaaaagatatattaattaggtcatgaaggaagatacttatgatgtcgtccttgctggttgaacacaacatccaccaatcgatctcctttctaactattcttcagatggaaagactaatggaaggagaagtatgatttggaacgttctgatgtctaataggctaatatttttttctagattcgcttttttctcttatgaataacttggagatttatttgaaaaatttaattattgcgccacgtggaacaagcggctggcggtaaaaaccgccggcttcagtaaagtaagatagatatatatacacaccataaatttctgtgtaattctttataagtgatacaactctggtaggataaacatactttggatgctgatcaaatactatatgcctctaaaatataaaatattttcccacatagactaggtaatacacaatctttaacaaaaaatgtaacattataaaaaataatattaaaataatgtacaaataaaatacgactaacacagacaattaagataagtggctgttttattatctgtttggtagatgtatagcttcaactctacctctaaagcccaactaaatagttttaactctatctaaacttaaaaaaatgccaactaaaatgctctcgtaaaataactcgcttgttatgtctaatatacttagtctaacctgtaacttgggtacgctcttttcttttgtcgaagaatcgaaaaaggatattatccaataaaacctgacatgttgaactttttgcttttccagctgtatgaaataatataccgaatttaggctgcttcctgatttcactctgtatcatcttggaattaaatttaggatttggtcctgccgacaatacccataattagtccaactccagcacgccggattgccggaaggttggcgacgcgttatcattgcccaggcctgctgccccttctcccctccttctccttggtgaatcgtcggcgatggatatcgctcttgcttctgcggcggcgacatggctgatcaacaagctcctggaccggctgagcgactatgccatcaagaagctgctgggctcggagggcctggacgcggaggccagctccctcagggatgcgctgcggcgagccacgctcgtcctcggcgccgtgcccgccggtgccgccgcaggggtcaggattgggaacgaccagctacttccgcagatcgacctggttcagcggctagccaccgatttggccaggcacctcgacgagctcgagtactacgacgtcaagaaaaaggtatctacactgtcactactgttgcaatttgggcgattcagtttcttctttcagcactcgaaatttcatctcttttttttttcatttgcagactaaatttttttttgggagcgtttagctaaaactctaaggttgtcctcgcaaatttttttttaaaaaaatctgttaaggttgccagactaaatgttcgtgtcacagactagcagtttttaggaacgaatagttgcagcaggaaagcttggttgagtttaagcttggctaaaacaaaaaaaaaattggggcaaccgtaactccaataaaataccattttttatagttttataaaatgtaaaagatctgttctgtcttctggctttctcccaaaagccgggtaatagtcattacctgttgtaaaaaaaaacagagagtaaaagctaagtagctagataaattagaagatgttaacatctgggttggtgggggttgattgtgaaaggagtactatgagtcttaattaactattactaacttattagacacctgatcctagggcaaagccgagtgattagctttccagtgaagcttttttgacatctctacatgtgggccatgagccatcaaattgtcaaagtgtctcaaaatatgcttatgcttcatattgcaaaactttgtttacatagtaatcggaggctctcttgagggctacgccccttaattatcggaggaaataaggactgcaattcccatatagtagatattcctgcatatggactcgcaatcagtacttaagtcccattcaactcctattgtagagtccagaccatgtccaaacagaatgaaacaaaactatgcataaaaaaataagtgagatgtggagtccaattcaatataaacaagaaaatgatcatgccatccagcacatatggttccacaaaaaatatgtaaaaataacaaggcacttctatgactacaacgtgcgattatattaaccaaatgttgaaatttaaatcacactatactcaggtggccaaatattcaaactcgacaaaaatcagaattaagtcacttgtttgtaagagaaatttttttataaactgtattgttaataaaaaagaaatcttagacttcatagtgttcacttgagatctaattttgtagcggaaggtgaaatctagttggactgtgaaccaagaggatgatatgcttgtgcaggaaaataaataaataaatataaaaactttaacatgttaagttagtggtaaaaattgtaaatgtagcaaatactaactcttgatttgttcaatatataaacataatgaaatgggaatttcaagtatatcgaattgacatatattgcaagacttcggatgcaatttttaaccaaactaatatatatagccttggcaatttagtttattgagattcatacgtttaattataaaaaatgtgataaattttatgtacagatgtacgtataagaataaaaagacaggacatgggcactcaaacctttaccaaaaaagaaaccagaaaataaccgaaaataaagaggttgtaggtagtcacctgaccaaagggttgcctcatgatggcagtcagcaatgtgtatctgcgtgctagaactcctggatggcactttgtcagtgagcatggtcacatgtggcagttgttttaggattatcatgccacagctaaataataagctgttctatgtgcattttagatccggttagtaaggtggtctattgtaggcttatggatctcccaatcggttgacttcagcatgggaaaaagccccttactgttccagtttaagcgtcctacagttaatccttgcacgctttatcaaccatcctctcataagtgctagcacagttctattttcgatttcgactgtattaatgcttctgtagtctgtaaaatcttgatctgaatttcacccattgtgacccccattccattatatggtatagtgatttcatctatatcctttgacatcctagccaccattttccatttatgttgtgtaggtaaagaagaaccagaagagcagcaatccattatccaaaatgaatttaccccttactcaagctgggcaatcaaagccgaagtacaatagaacagacataaaacagattagagatactgtgggatatttgcatagcatttgtgatgatgttcacaaggctctcttgctagataaacttgatgcaattaaacaagctgctcaagatgcaagtacagacaaacgtgagactgtggataacttcactgaaaatcctagaaataaggtgttcccaagggaagaaatgaaagatattatagaactaattaatagtgctgcatcgagtgatcaagaacttttagttgttccaatagttggtgctggtggtgttgggaagacaacacttgctcgattggtgtaccatgacccagaagtaaaagataaatttgacatcatgctctggatctacgtatctgctaactttgatgaagttaagcttacacaagggattctggaacaaatacctgaatgtgagttcaaaagcgccaagaatctcactgtgcttcagcgtggtatcaacaaatatttgaccaaaagatttctgcttgttctggatgacatgtgggaagagagtgagggtcgttgggacaagttattggcccccactttagatccgcaccaggctaagggtaacgtacttttggtaactactcggaagttatttcggtggtagataactagcaacacagaagcacacattgacttggatggtatgaaaaaagatgacttctggttattcttcaaaagatgcatatttggtgatgaaaactatcaaggccaaaggaagctacagaatattgctaagaaaatagccaccagactgaatggcaatccattggcagcaaaaagtgttggtacacttttgagaagaaatattaatgaggattactggacaagaattctagatagcaatgaatggaagttacaagaaagtattgatgacattatacctgcactaaagctcagttaccatcagcttccctatcgtcttcaggtacttttcaggtactgtgctatgtttccaaagggttacaattttgacaaaggacagttgatatgtacatggaatgctctgggatttgtatgaatgagagaaagaaattggaggatgaaggaagtgactgttttgatgatttggtagacccaagctttttccaaaaatatggagtgtcccagtattatactgtgcatgatttaaagcatgatgttgcacaagaagtttccattaaccaaagccttattaatgatgggtcagatcttcgaacagttccgtcgtccatttgtcaccttagcatctggactgagccggtgtacaatgagcaaagcatagaacggaatgataactctgaagagaagttagatgcagtccaggataatg

SEQ ID NO: 23207 - DNA, 1116 bp, Oryza sativa
aggatcacttagtatccttggccttgagactgtcaaaaagaagggagatgcaactcgtgcaaggcttaaagacaaaaaacacctgaggacactttcactaacatgggggagtgcaagcggaagtactactaccgtccagaaagaagtgatggagggtcttaaaccacatgaaaatctttcccatcttcttgtctacaattattctggtgctactccatcatggttattaggagatagtttctcacttggcaatttagaaagcctccatctccaggattgtgcagcagtgaagatccttccaccatttgaggagatgccattcctgaagaagctgtccttggtttgtatgccctgtctgaaaagtatcaggattgacttcaactctgccgatgaggaggatgaacttgagttaagcgaaattgaaatatccaaatgtttagctttaacatccataagactacattcctgcaaggcgttgactatgttaagcatcaatgattgtgaggcactaggttccttagagggcttgtcattttctgaaaaactgaagcagtgtgttgtccaaggatgcccaaaacttccgtcaggtttcatcgcaaactgatgatttggtggcaaactctatcaaactagctgtaagtatggcttcactaaactatgtcatgctcattccacttcattgaagaattgctggatattgcattaataaagacttcatctaattcataacaactcaatgttgtaaactgattggcgtactgcttagctgttaatactaatgactaaaagtatatctccttcggacttgtctcaagtgcccttaggggagtttgtttaaaacatactcaacgtttgtttaaaatatagctcactcagtaagaagcttctttcatccttgcaattgttcttgagttattttttttagataatggatttatattaaacccggcctctacacttgtgagggtgtatacagccaaacaagtttccaagagtacataagactcatccagttatatgggagacaacacaaggtaccaagtttacataagactcatcccgatacatgggcaacatcacataaagataaaaccccaataagaatcaacaaagcta

SEQ ID NO: 23208 - DNA, 2212 bp, Oryza sativa
tttggctaatctgtatttctttttatgctcgtcacattgctaaaagaatctggacctataatagtccagtttttaaggatacctttagggatctcaaagaatgaaagcatatacattgctaaactactcaacacggagttaataagaattaatcttcctccggtcgatagcaacttccctttccaactactgagtttcttttggattctatcctctagttccttccaatcttaattggccaatcttctgtaatgcattgggaggcccaaatatctaaatggataagatcccattttgcatccaaacaagctttcatatatgtcttccctttctttagccttgccataacaaaacatttcgctcttatggaaattaatctttaagccggataacttctcataggcacatagtatcatttttaagtatctggcctctttcaagtcattctccatgaagagaattgttcttcagttatatttaatttcaaaaccttatgttgttgcagcaaatcagtaagaaacatcttagcatttgtgtgaaataggtactcaactaaaataatatgtttttttgaagaaaccacaaactaaaataatatgttactgtattaataaactgtagtgaataaaacaaccttgattaatttccttcatttatgttgtttacatttgttgttttgtgcagtctaaaacaagcagtttgtccccacttgtctcaaatttgcactataatacgaagtgactttgaaattttaagttgcttttaagaattcttagtatcacaaaaagagtgcttgccaacagaagtaatcaaatagtcttattcgtcacttttaaaatctgattcagattgtaatccaaggattagccaagcacatatctaagtagtgttggctcaatacctttttagctacttcatcatattactgacacagattatttgcttcacgcatttaaaaatacattttatcaaaaaaaaaattcttctactcctttgactagaccaattgctctaaccatttgtgttaagttgatttttcaaatattgaatttgtccctacaatcaagtaaataatccacagcaataatccgatgaataatttgattaacgtaaatttgaatttatgtgctgattttggcaagtaggtgtatctttgttctgtatttggttatactatgagcctttatttataggtatactataaaccatttgatgtaactgatgattgatacaagatagtacatttcatcccctgctctgtttaatgttttccgcgttccatttactccaaacttatatcatacagttttttcgtccatcaaatacaacttcctccaagttcactctgtcctaaaaaaatcattatttcaagacactatttcatttgttattcatattaagatatgatttcagaccaaagaagaggagggaaccgggatgtggacgaccttgtttctgctgaaaaaggcatgttttaacttctgtcagtggaggcagcttggacgcttactagttcgtgctgtatcgttgtggtttttgctgttgtattcactattattttcgtatactttattgtcattttattcacactaccatatatggaaatgttgtgcctgatgtgtaatatttcggtaggcacaccggctaaaacattaaatggtcttaaataccatgggaacacatctgcccttctatgttacccagataaatacattgttattttgtgattataattgtaaggccgcaatgaagatttgtgctatatattctgaccaaagagtaaaaaaactatttatagtttcctcatgtttttgcaaaacataatttaaataagtggattgaaaccaaattgaccaaatctatacttgttgtcattgaccacgacagtaaactgcaaaccatgggttagcacgactcacacaattggccttacccagtacccactgactcatggtgcccctgtgggtgaagtcatggttagtagtttcagatgcgtaataagcattaaagcagacaaaccgaagtgctatggcataagatgtgcaagcggcaaacaggataaactgaaatgaactctctctcccaattaacaaatttagagttgtatcccttttaagttagctgaaatttttatattttggtcctttttgaaaccttattttacaaatggacccctggaaaaacttaaaccggaaatggtccttttttaggg

SEQ ID NO: 23209 - DNA, 1830 bp, Oryza sativa
gccagggtggctggcgccgccctttgcctccctgcaaattgaagatccatattgcacaaatgtaccaattcacagtttgcaattcaaattacaattcacagtttcatacagactaaaacaagttccaattgcacaaatcacaactccaaaagtccatcacatagtgcatcacatattccacacatcaaacaatgccaaaagtccatcacatattccacacatcaaacaatgccaaaaatccatcacatagtcctcacatagtccatcacattttatatcacatagtgcatcacatatgtcatactaccaacaaatagattaacttcatacaaatcacttcttccgttggcgccaaatagcttgcgagcccggagtgtacctacatttaaaatccaatgtttaaaacatttaaaaaacaaaatgagggaaattcaaataacatttgagaatggtaagctcattttacctctttttcgctgcccgagtggatcgcaagttgtattgggtgggttgcgtcttctgaggcgcgtcgggaagctgcgacatgtctatctcctcagcgtttggtgcgacatagtcctcatcctcctcctcgtcatcatcgtcgtcgctaggtggagccaacgccttcccctttcccctcccttgcggaatgcgtgacgacgacgagccaccaacttcttcatgctcttctatcctgatggagtgtcgagcggtacttggacgcgcggattgaggtagtggtggtggtagtctccgcggttggtacacgtcgtccaatgcaaccgacctgcaacctaatcttgctgcaagttttcggcacctttgacgaactttctgcatttcacttaaaaaagaagtttgttaggcataactcaagtaatgcaaagtgctaaataaattttacctctaaaacattgcggagtgtgttctccgtgtccttaccacccctcggagcttggagggtatgccccatttcattcacactcctgaggagctctctcgattgaaagcgtgagaagatatatattagggtctgggatgcaaatggaaataactttgacaaatgcaagaaaacttacgactatgtctctaagtggggcgtgctccatttgatatccaactctagtccggacatcatagggattccgcccctcatcggagtcgcggtcatcctctatgtcggcttccgtccaagtaaggcggaggaacagtctatatgtcctatgcagccaacgaaggtactctgagaaaacatgattttggtgtattgtctcgatgtacctgtcgttccttccggctgtcctccattcatcaatgtatctgttatactctagcccccagtctttcaccttctttgttctcaccctgtcgtacatagacaagtggaaggtgatgaaagaatagtgagcatcgacaagggttaaatggtacaaagttgaacattgacaatgaaagcaaacaaagataagaaatatttactggtgtaattcaactccagttgagatgtcctcaaccggccagtcttgtttcttcccgaactgtcgcatgacacggtgcggaaggtggtactcaactgcccagaaacaaatcaatgggcactggtacatgaagtagtcagagtctcgattgcacattgagttcagggtcaggcttgaagcctcatttgtgtggtatggtaaccactcaatctgcaaaagttgaagagatgtcgttggttagtatctcaattaaagaagtaaatgtcaaactagaagtgatattggaagtacttacatgttgaggctgtaagcagtccatttcattgacataaggcttgtatgccacatc

SEQ ID NO: 23210 - DNA, 854 bp, Oryza sativa
caaagcccacaaaattgccgcaatgcccatataaatttgtcttttaagtctaggttcaaaaccattcaaccaatttccaaacatatgagccatgctacggggttggctaattccgaaagtaaagaaacatgcactccaaatgtaccttgccatgagacagtcaaagaaaagatggtgcatcgactctttagagttacaaaagcagcaacttagactacctctccatcttctcttagctaggttatcctttgttagaataaccccttctttaagataccacaagaatattttaatttcagtggaattctgagcttccaaatcaaagtctttctaggtatcactccattatacataagcaccttgtacatggagttaaccataaagagctcatccttgtttgctttccaaataaattgatccttttgatcagacatagtgacattcactgctttggaaactaaattataccaatcttgcaaatttcttccagttattgctcttctaaaggccaccttcaacggagttcttcccaaaacctctgccactactgcattcttattcctaaccaaattatacagattagggtattctttctcaagaggttgacttcctatccaacaatcctcccaaaatcgtacttgtttgccatcacacgttttaaaataaccaagtgattgaaaggattctttagctgtcataagactagcccaaaaatgagaatctcctggatgtttttgtacttgcataatggttttttttttgccagatacttcctcctaagcatattttgccacagtccatcctcattgattagtttaaataaccatgtacttaacatacacctattttggatt

SEQ ID NO: 23211 - DNA, 897 bp, Oryza sativa
tggcgcatttcattctaaagtttttttttctaacatgtttttttttgcttttttatttacaacgaaaaccatatttttctcctctttttgcttttcttttctagtgtgtttttgcctttttttacaattattttctcgtgcgtttttttgcttgcttttttcaaatgttctttttttgctttttatcaatacaggagaatatatgacgaaataaaagccgtgtagtaggtggtaaaaaatcgatggatcctatccgactcagagcgatttttttaatagactatgtttttttcttgcatagttttttaaaaccattttttaaaatggcgcgttttttctgacagatcttccctccatgttttttttaagaaaatcaccgatgatggaaataatttttcttgcgcgtttttttgtttttttatggaagatggaaaacaattttttagcatttttttgcgcttttttctgacttttttctcacgcgtttttttgaattgtttttattttttttgtgcattttctctttttaaatagttaaattatattagagatagagaagagatatatattgattagaaatcagactttgtttcgtcctttccatttttttctcgtgtgcattatttattttatacgaaccattttttcgccaatttcttagggaatcggacgaacttttttagatgttttttcggttttttcgcctttataggaatcagacttttttcccgtttttaaaggaatcgaatctagtattttttttcaccacttttttttttgccttttataggaatcggatttttttccgttcggatctacggtttttttccgccacttaggggatacagaacttttggtgttgtttttcttttttttttgtgcacctttccttttttt

SEQ ID NO: 23212 - DNA, 2605 bp, Oryza sativa
ttcgcctcttttttctggatcggacagttttggtttttctttttttagcacttttttcgcccggtttttttatcggataaatttggtttttttggtccggtttttttgacggacgatggaagcacctcttatttttttaaagtagtagagattaaaaaaatatgaaattattatttattttgtttgtgattttctttattatcaaaagtactttaagtatgacttctccgtttttatatttgcactaatttctcaaataagatgaatggtcaaacgttacaagaaaaaagtcaaagcgactactaatttgggacggaggtagcaaatatgtatagcaagagttagtacattggcaagcagtcaaacctagcatactaaatgcaaggctaaggcctggtttagttcctaaaatatttttcccaaaaacgtcatgtcgaatctttgaacacatgcatggagcattaaatatagataaaacaaaaattaattgcacagtttgtatggaaatcgtgagacgaatcttttgagctcaattagtacatgattagccataagtgctacagtaacccacatgtgctaatgatggtttaattaggctcaaaagattcgtctcgcggtttccaggcaagttatgaaattagttttttcattcgtgtccgaaaaccccttctgacatccggtcaaacatccgatgagacacccaaaaattttcttttcgcgaactaaacacaccttaatacttaaaggaaagctttatatagttcatttttagcataaagcaagttttagttcacaaacgtttgcaaggaagtctttaaagcatttttaaagcgtgaatataagtagataacatgaataatcatagcatatcatattattatccttgctgccctcctcaacaacatggcgcaaattccattacaaaatcatcaaactcaacacaaatctgcaattccaaatccacattccacaaacataatttaaaagcataaaactatactcatgacacttcaccaagtcgcttatgaccgcgagtacgactaatcgattagttttagactctacagagtttacacaactttagtcacatgaaatgaacactctagtttgtctcgtactcgtgaagcactaccgcactttagagattgaatgtgatctagaagttgcaacgaagcctttacattacctaatgcctagtcttgcactagcacgataagtgtgaacccactctaggaatgacctaaagtcgttaggtgacgggccaccaccttaaacttaaggccgtggcggtaaacgcatctgtttccatgaggcattgtactgtcatattggacaaacttagacacctaaactactcccagtgagcaaataggtagctcctctagatagccctgctataccattaacgggtcaataggcactgcccatactttcccggcctaccaaaatgcaaggctagatattaaataacttatttagctaagtccacaccataaaatagcacatgtcaatgtacgataaaacattagttagtggcacgaagttcagtccggacattccccctattagtgtacaactaccaccatttgtacaccacttgccgcccaagtctaaaaccattctatacacattttagttcacaaatacttaaccttttcacttctgtccagaaataaataaataccaaaactccatttgtaaagtgttaagaatgattatttgtatagttttaggcttggctaagcaaatggaagcatataaagcatttatagacccaatcgagcatttagaaaaaactcaaaccaaagctatggttacaaacagagggttgtcaatatttcaaggtggatcatgcagcaaataggttatatctaccattttaccaaattttaaatatcggtattaacaaaatacacgtgcgattttgcaaacaaacaatttcattcgcccaaatcatagggttcaaggtgataaagggaggaggggagaacctgcacgtaagtctctctttcaccgttatcgcaattatctatacaatttacacggtatgcaattaaataccaaaatatacaaaaaaaaaaacaaaatgctctaaaatgcatgatttgtgcacagtaggtaggtgatgaatttagatgaagaaatttctattttatctctttttatttaagacttatgaatttctaaagtttgtgctgatatagggtactccttccgtcccaaaatataagcatttttggactttgacacagtcttcgagatgctactttggccaacaatatctataaaaataagatgttttaaataaaaagagtagcatattatgatagtttgtttaatgataaatttacatgattgttcttttttattcttttgctattaatagtctaagttaaaaatgttttacttgatactatgctaagaccctctttgtttaggcttagacttattggcttagacttttaagtcagcttattggcttatatgatttataagccggtgaatttaatgtcctaagtttaatggtggagtcataatctacctcacataagccaaaaaaaaacttctccaatctagcttttggcttaggccctctttgtttagg

SEQ ID NO: 23213 - DNA, 5162 bp, Oryza sativa
cttatgtgaggtagatgtatgactcaactactaaacttaggacattaaatccaccggcttataaatcatataagctaataagctgacttaaaagtctaggccaataagcctaagcctaaacaaagagggccttaatagtgttagagtggcttatggcttaaaaaaagccaaatgaataagctgcttgtttgtttaggcttagacatttcggcttataagctggcttataagtctaaacaaagagggcctaaaaatgtttatattttgggacagagggaatatattatttatctaggtagtgtcgtgaaatactttttataggtgatttggttaaagttgactttgcagaggtcaagataattgttttctaagactaacccatttggtttcataattgttggagtttgtatgattttctgatgtattttacaatttgtagcgtgtccaatgttagtaatttccctatatttttaggtgtttatttgtacagaatgtgttactttatgttcttgttaaagaaagataatagttcttaacctaacaaaactgagttcacaagatttggagctaatatgaattttctacatattttacaaattgtgatgtgctttatgttgataatttgttataacaacttgagaggcattaaatgtactaaagctgagttctttccccaactataacaacccacttccctcgttttccacgcgcacaattttcaaacagctaaacgtcacttttttgcaaaaagtttctagaaagttgcttaaaaaaaatcatattaatccatttatttaaaaattagtaaatacttaattaatcatagaaaatatgttgctccgttttccgtgcttagggaatgagttcgcaactcaaaacaatgaacacagcctaagtgttttgagttttgggtaacatgaataatgttatagccttgctggcctaaccaagtcttattttagcttaattggagctatagcgtattttctataaattgcatcatttataatttgtgatttaatacttatttcacccattaaggtttagagatgattttcatattaaatgtactactttttattatttttattttactgtgattaaggagtacatgttttgtgcaactagcaggactccgttcactttattttgagttcactttactttcgtcgacgatgcggaggaagcactaggcctcgggggtgaggtgagtggctggactggctgggcagtggagacgccgaagtgcctacacgtgtttccccaggtggcggagtcggtggccatcgcacacgcgcaggccgtgtgcccctcctgcttcatcatgttgccgcccttcgcccgcgtcgcgttcatcgagtccatctccagcttggatgcctcaggcttcagctccgacggctcagacccggactccttgcttccatagcagcgatgggatggcaccaactgaggggaggaccgcagcgggaagacattcccactgaggagccgaggaggtcgacgatagaggcgacgctaccttcgcctccgatgtgtataggttggaggggggggtcctcttattctaggagcggtgattgagatcaatgcattgttatttctccacatgcactgcttgtcattggctcattgttgatttcatgtctacagtagttgttgaagctgttctgtaagttcgagatgatgaaggagaagatgcgagcaataatgaacctacagcacaacgtgtccgtgtcttgcctccacaattgttgctcaagtggcccaaggaagcgtcattctgtcagttgttgacgcaacttgtgccaacaacccgatcgaatgaagaaaataaagggggatgaggaagaagatgaatatgacaggtgggttccacatacagatgggaaagaagatgggaaacgtgacggtgatgccatggtttcgattttgtaaaaaaatgagttgcacggctacgaatagacgaattataatggcatttatctaaatagacacatttgcaatggcacgaatcaaattaacccaacttttttaggaaaacgctggggatcaggcgcccgacggtgccagaaaaattgcccccctcacgcgcgcctccgcctgcctcccacgcctccccaccactagggccccattacaacaaatccctcacatattacggaaacgctctattaagggatttcgtttcatttttttccactaacaatgtttcagctagtgtactcgtaatgtttcactatgtatagataaaatgttgcagtgaattgaattattcttttacaacaaatcacccacatattatagaaaccctttattaagggaatccgtttcatttttttccacaaaaaatatttcacatagtgtactcataatgtttcactgtgtatagatcaaatgttccagtaaattgaaacattctttcgatatttgctaaaacattgtttttatatagggtgaaacaacgcttaattttttttggaaaccgttgtttcatacgttgtagcaaaatgtttcatgagatgatttggttgtgtttcagctttttaaaaatactgaatttttttcgatttgtttagtgaaacatgttcgatctagttgatgttcataaatcgggtgcccgatttagaggcgcctccactttttaaggagctatttgtaaaataattttttaaaaggacctagaggtgaacaatccatggctaaacccaccgcgcggggcgcgcccgcagcgaaccaggcgcgcattaggcgccccccgagtttctccccccttcccttgttggcgtaaaagaaaaatctccccgtctcgtctcctccgctccttgcgccatctcgcggctgaacaggggagggggaggggcgccgatctccatccgacgagcagagcaggggaggggagggggatcctggtgagcatccacatcctctttctgattcatctctgtcccccaccggtagtacttttgtctggaatttgcttgcgttaaccctagcttctcttctagatctggaagaagggattaagagaagcatttcttaattccagagccttaatcttaatacaagtaacagtttgtttgttcccctaaaagtttgggggttcagtactgaacccccatgtcccaagttggatccgcccctgtggggagattgaatggtgcccttagggatctgtggtcgttcgtggacgaaaagcggttggtggtcgcaaagattagtttttaggtttctttttttctcctgaagtgattgcgattaccgtgcctgtgatgaagtggcgaagagaggtaatgatggcatagattttgcattggccgttcggggtgacgttcctgtattggggctcaatttgttgtttctcccagtaactaggtgcttcctggttgctgagcacgccgaggtgtagattttgagatatactcttttgactctttaactttgagtaattttggaaattatgatggttctcttgcctaaatgatgtttattattcaaatatctttatgtacttctcttttgaacttttattttttttccacattttgtttcgctctcaatacaacaaataagcagttctggtaattcttttattttcccatttcaggagatcatggagagtagttcttcagatgttcaaatgtcacattgtgctgaggacttgaatagtgagagtacaatcgagatcaaaataaagacattggattctcaaacatacaatttgcgtgtcaataaacgcgtaagtggataacaaatgcccatgccagagactatacagttgctttttacagtgctcttatggttccttagaaactattggctatttgcatgcacaacatgttgcaattctaatgatatttaattgccttctttcccgggaacaaaataccactcaatccctttcgcatagtttaattaaataataataagtgaatgtatgtcaaacttgcttaaatttccccaagtaattttgacaacccactactatatctcatatttttaccattttctgatagtttattgtgcagcctagttgcaagttcattttatgttcgaatgatgtaaattgcctttttctcaattttttctgttaatggtagttttgaatgtataaatagcatctaatgtagagcatgttgttatatgtatgttcttttgggcatgcactcacttctgatgcacaacttctgatacacatatggtgtgcatttagattcttttgagtagcagctggtctagtgttgcattaccataggagccctggatgaaatttatgattatataagattgttgtttgctagcagtgtttttcatagggcctttatgatctgtgaacgttggttaggtggctctagtagcactcctcaggtcctgggttcgactccttgtgggagagaatttcaggctggggttaaaaaaaatccccttgtctgtcccacgccaaagcacaggtctaaggcctggcccaggtcattggtcgttctcacacgggctacggtgctgctgtgtaagggtggggctggggttcgggggttttctcaacttgcgtgagaaggttttctatgcaaaactcccaggggctgtcttacccccccataggtcgattctttttagtggtctgcgaactggaatattatctttgaactccattgatcatttttagaacctgctcagaataattctatgtaccctttaattttcagaattaatgctgcattagtttgttcaatattttgttccagttctattttttgggtggacatgccatttattgttaatgctttgtcttttatacaggtgccagtgcctctgctaaaggaaaaaattgccactgtaactggaatattgtctgagcaacaacgtctgatttgccgtgggagagttctaaaggatgatgaactcctctctgcgtatcgtatcctcatctatttttggcttgtagcattttagttgttttgtcttccaaaatttgtttctccatctacaatgccatatcctacagtttcaaatgttagatgtcattcgacaaacaatattctagatcaagaaaacaatgcataatttttatgcacaattaaaagcataatattaatatttacaaatgatgatggtcccattgtttggaatttcggatgacatgttggaaataatggtattatatt

SEQ ID NO: 23214 - DNA, 10654 bp, Oryza sativa
tgcggaccatatatatacatatgcctatactatactccctccgttaaaaaaaagccaacctctctcgtaggttagcttttgtttttttacggaggaagtgcatatgtagagtgggtatgcaacagggtttatgttaccgtcggtaaccgcgcggttaccgcttttaccatgggggtatggtaatagaaaataccgcggtaatctcctttaattcaaataaatttaaaaaataatttaaatttttaataaattttacacggttatcacgtgctgcgcggtaaccctagcccggcggtttggaaaacctggtatgaacaagccgtgacgacgtgagtgaagcgtggcgtggattggataagggaggagaaacaataactccctcctcctcctcctcctgctcctagtactagtagagcagcggcggcaatggcggcgcctcctctgctgagcctgagccagcggctactcttcctctccctctccctccccaagccacagctcgcccccaacccctcctctttctcccccacgcgcgccgcctccaccgccccgccacctccggaaggggcgggccccgccgcgccatcccgcggggaccgcttcctcggcacccagctcgcggccgaggccgccgcccgcgtcctcgctccggaggacgccgagaggcgccgccgccgccgggagaagcgcaaggccctcgcgcggaagccctccgccgccgcctgctacggctgcggcgcgccgctgcagacggccgacgaggccgcgcccggctacgtccaccccgccacctacgacctggtagtactattaattcttccttctccacccacccatgacatgattactactcctacgtagtaagtaataatatgcatatgaatgcatgcgatgcgagcagaagaagagacaccatcagctgagaaccgtgctatgtgggagatgcaagctcttgtctcatggccacatgatcactgctgttggtggccatggcggctatcctggagggaagcagttcgtttccgcggaccaactcagggacaagctctcctaccttcgtcatgagaaagctttgattatcaagctggtaaatcacaacatgccctgccctgccctctaatgtaatcaaacgcaatggctgatgcaaatccttcacatcttctatgcgtctgcctcttgccgctcattctcgctgtttacatgcaggttgacatagttgacttcaatgggagcttcctggcgcgtgtgcgcgattttgctggtgctaatcctattatactagtcatcacaaaggtgattcttctacatactgcatgcatattcgtgtttcaggattaaaagctcattcttttgtaattgtaggttgatctccttcctagagatacagatttgaattgcattggcgactgggttgttgaggcagttgtcaagaagaagctcaagtaaaacttcttcgcccctctttctgttccagtaactattgcatcaggttttccatttcattaattggaaattaagcgtgcttcttggcatctgtagcgtacttagtgtccatttgacaagctcaaagtcactcgttggcgtcactggggttatatcagagattcagcaggaaaagaaggtcagcatgcatctgtatttgttttcccagttatattgtgctaacctgtccccctgtaagccttttccaacacttgccttgcacaattgaatggtagtttttattgtgtcatatgtacacttatttcttcacttccttggctgttatacatttcataatactgatcataatgttgttcttcctttcttgttagggccgagatgtatatatactggtaagcaataagcactctccatctccttttttcaattatttatgaactcttgtgctacagattttacaggcataccattgtatttttgtatggcaaaacactaagcttgctgccatttgtacaaacctaacaagctgcattcatatatcaacaaatgttgatagcttgatgcttataatgttctattgatacctgatcattatgttagtaatattatggaaagattcagaattggatgttacccactaactaacatacatagacccatcttcaggttctctccttcatttttcattatttacacagaatgattgaaccttgcaattcataatgcttcaaataacatgagtaatttatttatgcctaatgaatctagtacaccattacagggttcagcaaatgttgggaaatctgcatttataagtgctatgctaagtatgttcttaccattcttgactactattgctgtctccctttttcaacctattacttgttttgttcgctcattctgttctttgttacactaatagttagagaccataatttgtagggacgatggcatataaggatccagtggcagctgcagctcaaaaatacaagccgatacaatctgctgttcctggaacgacccttggtcctattcaaattgaagcatttttaggaggcggggtacggttccatcttttactctgtacactttagttttaagatatataatatgccaaattttcttgttgacctgctgtaccaactttatctatgtagctagagaatgaacttaaatgttgtcttatatattgctaacatgcccaaccaattattatacttctctgacacatgaaggactataataatcttgaatacatgcagaaattatatgatacacctggagtccatcttcaccaccggcaagcagcagttatccatgctgatgatctgccttctcttgcaccacaaagtcgtctaagggcacggtgttttcctgtatgtatttgtattcagtggcacacatgtttctttctcaaaacatgcacactaatcttttcttcagaatataatgttgtgttcaggctaatgatacagatgttggattgagtgggaattcattattctggggtggactagtccgtattgatgttgtcaaggtgcctagttgagcccaatttcaattccaaaaattttctaccacttctatttttttccattctgtagtacttaccactgattattaatcaatcaatcaatcaatctaggctcttccacgcacacgactgacgttctatggacccaagaagctaaagattaatatggtcccaaccacagaagcagatgaattttatgaggtacacctgtgtttgctaatcagacaacagtatgcagctaatcatttgttgctaggttgagctacttagaaagcatcaagctactggcatactgttttgttctcaaagttctatcaaatttagattagtatttgcaacccacatacatacctcttcctttaaatatatatgctcatataacttccatgccttccacaccgatgctcacttgaaatctctatggatggtataataactgcatctatttgccatagttcatgctttctatatttctgttcatctaagaaaactgaagaccataacatgtaaaatagccgctaattaaaccagcttctgttctatgtgctatgtgaatcaggtaaataataatagtatgtgttctgctgatcagggtggggttcgaaatggcttttttatttaacgagttgtctatttcacctttccagagagaagttggagttacattgactcccccagctggcaaagagaaggctgaaggatgggttggtctgcagggtgttcgtgagttgcagataaaatacgaagagtctgataggtaactccttgcaagatgcaagatggcttcaattattcatctagcatgcagtaccagggggctttaggatcagacaattagtggttgagtaattcagatctcatgtttcatgaagaatatggtgtgtgttctctccaagcatctgctttcatatgttactgacatttgaggatatgtttgttgtgcagacctgcttgtgacattgcaatttctggtctcgggtgggttgcggttgagccacttggtgtgccatcaagcaacccagatgagagtgctgaggaagaagacaatgagagtggtgaactgcatttgagagtacatgttcccaagcctgttgagatctttgtccgacctccattgcctgttggtaaagcagcatcgcaatggtacagataccaggagttgaccgaggaagaagaggagttgagacctaaatggcattactgatgcttatagctattttagttacgatgacagcatcgtgtagtccaaatagagcacgtaattatatatgttctcagatgatgtgatagggatgacagttttagcatcagctgattaaaattactccaataatgattcaggaaggaattttggataaagacatcgccaagtgaagctcttgcgggtactctctgtttctaagatcttcgtcctagcacatataccatcacatcatttttcctttgcaacactatgtgtgacgcactgacgcttaaagcgaatgccgtaatgaatacttgaatatagttaagaggcaacaattttttttttcagatctgaatctaaaaccaaccaaacacttttcaacgggtctccaactccaacgagagctatcttccaccagagttaaagtttggagccctaccaaacgggccttcatattcggccaatgccttctatatatgttctagcttagcattcgcaacgtgtatactcaactgtcaactttgtggagctatatatagaatttatttagcaaaagaaaagaaaaaggaagaaaaaagccctacccagaaaacgtgtatccaaaatacgttttcaaagttagaaagcgcattaaaagcactacgcaaaagttcttggtagattttggttcggcccattggatcttccgactcacacgcaccaccatgaccgacgggccctcgaccaccggcgattcgccgccgccgccgccgccggagagcggcggctccatctcctccatggttgcctcctctgccgcctccgctgcggccgcggccgcggatttcactcgccgtggcgaggccttcggcgccgatatggcctccgcagctagggctgccatggacaccgccatcgcccactctcagtcaaccgccatcgccgccgcagaagctgcctcctcggccaaggccgacgccctcgccgccttccccagcctcacgctcaacgcaaaggtgccaccttcttgccccccattccccactcgctccgatctcagcaaatttgctaaagctcgatttcttttggccttttcccccctctaatctctaatgttaggaggagttcgaatggttaaagaaggagtacacggttcacgagcaggtggtgttcggcaagatcaaaggtgcattttcctgttacttccgtaactcaaaatccagaaatttacagattgatttgtattgttggcctgttttattatgtataacaattgaatttcgattgcttatagatcgtgttgtctaacatggttctgttcttttgatgttcgatcaattattgactttcagttaccgtgtttgcagagggtgccatcatggccatcgagcatccgggaattgctgcaggctccacagcaattgctggaattgtgctcttcaaaagtaaataccatctcctgaaagtcatttctttggtggcttacttcttgtttgttacattcacaaaagaatacctgcttctgtaatgctttacacatgatacactttagatgatatgaagagggtacctgtcagtaccatatgttaaaaatacattgaatccttttatgtaacacaagttagaatgttggagcaaagtgttccttaatattttttgtaacaacaaagatacgctattggaagtgatttcttatcatgctacttatagttgactgaaatgtactgagaccttcttgagctaattaattagatccaacttagaaatcacaagcagattcagttcaacctgtcttattataatcatcacattattctgattaattggatttcattaattctataagagtgttgtgaaattcactttcaaattatcagcctgtacatgcagagctagttgcctagcatctgatgagacaaggatgttgatgcaagtttggtctgtgattgtttcaagaatctaaaatgttcggccttttcttatatatcactaactttagtgtgactaaattcgttgcagggccaaggagctacctgatccaacgggtgcgacgcatatttgtaagcaaggaggtacgcactgactgcctgtctagctataacatttctatgaattcttgacattgctacttgctacctgcctacctccatgtctcgaaagttgcatacaccatcttgtttacagattgtcacctccttactacttgctgactagcttcacagttcgaacctatcagatgtaatgctttagtgctcattattactgtcatggacatgttgtgatacaattctttgttctgaaacagagcgaaacacaaattcgtctaaaactagcatacatttttttaatgaaattcatgcatgctacctacattcatgaaaaaaaaatacagggttgattttctttagaatgaatacaacctatgttgattgtatttcataagtttccaaattgcagaccctactttctggcatccaagctggcgtgaatcacatgagacaaactgtcaatcttgtgtccaatgaaagccaaaagttgctggtatatttctttattttgttgaaaactgaaccatctgttgtcaaattggccatttaagttcaaacattcttcatgtctgattttgtgtatgcattccaggatagagcagcaactgctgaaaaaagatttcagaaaggatggaacacactcaggcaagcctattttttaaagccttttaccatttatttttgtcttcccttctctaatacagcattggatttgctgtctacttgtttcagggaagaagggcgtgccattcaaagtgagctgaaccaaataagtgatattgagaagcaagcagtaggtgtgtaataatttcttgcgctattgccttttcctatgtcaatttgaattttagagcggaaattgcctcatcttgaatttgacatataatgagttgtgtcctataggtctcaagagcattctcaatcagcttcccagagcacatgcatctgagtttcaatcagaggtcagtatattttctggtatctgaacactatgatgtttactgaaacgattaggtgatgttgaagctgtcactgcaatttgtttttttcccatgttgtgcaaatctgttggctaatttctttgccaaaaggagagggtatagaagttttattcagtcaatgtcggcatcgattttataagtagtgtgcagaaattatttttcatggtttcatatctcataattgcagcattacattattttatcacaaaccagttttacactaaagataagatagtattttgaagatgggagttctgtaatgttaatttatagcaagcttatttttttaattgcagatatctggcctagcctctcaggtgaagaaggagaagagagtacttaacaacaccctcacgaagattgcgaactatggtgtccctatctgactgtcgaaacgcagcttcatttgctgtagtttttatcaatgaagagattctgaagacatgggtgaatcttttactttatactacttgtccgcggaggggaaaggaaataatacgttttatcagtcttggcgagatgtaaatttgccgctggtgctgcagcagcaacataacatttttgtagtgttttgcatcatatgggcattctctgttgcattgtccatgaagtgaaatggacatactgcgtcgaccttccctgcaattaatcaaattatgttttttttttaagtgtgatgggtgcgagactttatgtgcttcagagcgttaaagtggattcaagaaaactttttttctttatcaaatctgatgaagtggttacaattcttcagtactgtataacggatatgcttatgatactattatggctggaaatagaggattgatagggaagatcgccctcaagtcgccggcttctccggaagacggaggctctgatctgattgacttagtgggcaaggcccttaatatctttattgcttagtccttaatacaatagcaggccccctttatatactaggtgccaatctaatatttaggaaatctaagacaaactaggaataggaaacataatcctaaaccaactagaattagatatatctactgattattcctattcctattcctatacctatggtatttgattccataacgccggtctataacatttccctcctcctcatgaaacagctcgtcctcgagctggaaactgggataagcttcgcgaaaatggtccagcgtttcccagctagcctcctctggagatgaacctacccattgtatgataacttcttgaattccttgattccacctagctttgatagcagcagctggtgcagggataacctggccatgaacaatgtcaggaacctgaacaatatctgttggggccacaccttcaatttttttagtaaagccacatgaaaaacattgtgaataagagctcgaggaggaagcttgaggcgataagcagcatgaccaattctctcctcaattaaacaagggccataaaatcttggggcaagtttagagtgtgcttggtctgtaataccagctgccatgcgatggtgtaaccgtagccatgcctattcaccaacctcaaattcaatgtcgcgatgagatttatcataccaactcttcatatagtcctgagcttgaagaagtctctctcgaatttcaaccaaaaatccatttcgactcctcatctatttgtccacagccacaacacaggaagaccctggctggtaagcagaaatagtaggaggatctcgaccatacacaaccttgaaaggtgtctcacgaagggaagtttgataggaagagttatagcaaaactcagcccatggaagccactgtaaccaattctttggatgatctcccgaaaggcaacgaagatacatagtgatgatgcgattaaccacctcagattgaccatcagtttgcggatggaaggctgtgctcatatttaactttgtattagtgaagcgaaatagttccttccaaaatgtgctagtaaaaactagatctctatcactcacaatagaacaagaaataccgtgcaagcggacgatatcatcataaaatgcctttgcgactgagagagccgtgtatggatgtcctaaagcaataaagtgggcatacttagaaaaacaatcaaccaccgtcaaaatgactgacttccctcgaacacgaggaagaccctcaatgaaatccattgaaatatcctcccaaacagcagaaggaactactaaaggttgcagtaagcctgcaggatgtcgatgttcagtcttgttttgttgacataccgagtagctcttaacataatccttcactaatgaactggcatgaggattgtaaaatgatgcacgtaggcgatggagagtcttctgaattccctcatgtcccatcccgtgcgcatcagccaagagcaagggccaacatgcagaagctgtaggaacataaatcttgccctcaaaggtgaccaaaccatccactaaagaccaacctgtcgtaagtaaaccagcctgaatctgatcccttttggtaatgagttctagcagtgtgttggtctcttgtcgcaataaatcaaatatttcaaaagatgggccagaaatagcgtgtaattctgctgattcttcacgacgagataaagcatcagcagctccattgtgttttcctggccggaactcaacttcaaagtcatacccgaataacttactgacccaagtatgctgtggaatagtagacagccgctgatcaagaagaaatttcaagctataatgatctgtacgaatcgtaaaggatcgtccccaaacataaggtcgccaatgacgaacagcttttacaagtccaatcaattctctctcataagctgcaagcttcgcatgatgaggagccactgcacgactaaagaaagcaattggtcctgctccctggtgtaaaacagcaccaaaacccacaccagaggcatcacaatcaataataaatcgtttagtaaaatccagaagttgtagcaaggaagcagatactaaggccttctttagcgctagaaaagcaccatgggcctcagaggaccatgtgaacccttccttcttcagaagcttggtaagaggagatgctatggcaccatagccatcaatgaactttcggtagtaaccagtgaggcctaagaatccacgaagagcgcgcacagtgcgaggttgaggccactccgcaacagcctctaccttgctaggatccatggccaccccacttgcagaaacaatgtgtccgagataagtcaccttttcttcaccaaagagacacttggatcatttaagcaccatttggtgttcttgtaacaccaacaaaactgctctaacatgttgaagatgttctgcccaagaagaactatatatcaaaatgtcatcaaaaaatacaaggacaaaccgtcgtaggaagggagccaatatgtcattcattaaggcctgaaacgttgctggagcgttagttaatccaaaggccatcaccaagaattcataatg

SEQ ID NO: 23215 - DNA, 12785 bp, Oryza sativa
ttcggaaagccgtttttttgacgtcatcaggatgcatgcgaacttgatgataaccactacgcaaatccagtttggtgaagaagcgagcccctttgagctcatcaagaagatcatccaccaccggaattggatatttgttctttatcgttttgctattaagggctcggtaatccacacaaaaacgccaagttttatcttgcttcttgacaagtaatactggagaagaaaattcggaatcacttttctggatgataccttgggtcaacattgcagcacattgtcattcaatctcatccttcaggagttgtggataacggtaaggacgaacagccaccgctgctgtgtcagaaatcaaaggaatacgatgatcatgacttctttctggtggtagtccacttggctcattaaaaagatcatcaaattcttgcagcaactcaggcaataagtcacgtccagtcaaagcatgagcctgcggcggaaaagaatcaccaccatgaccatgccaagctacttgatgatcgtccctccaaaaagacatggtgagcttatcaaaatcccacaagatgggtcccaatgtacggagccactgaacacccaataccacattatagcctactagtggaataacataacaatcggtgatgaaatcctccgagtcaatttttataggaatacctgagcagatgcttgagctagtgacttgatcaccatttgctaccataacgttcagtccagattttgtggtaggcgagaggccaagacggtgtgctgcctcagtagccacaaaagtgtgggtagatccggaatcgaccaaagcagacatggttacacctccaataataacagccaagcgcatggtcttgctagtacggatgccggtcaatgcatgaagagagatggtaacggtgtcatcattgatactatcatcgtcctccccctcgtccatctccaagaggtagatacctttcatagagcactgacggtgatgatctttagagaatttctcgggacaattgaagcaaagccccttttcacgacgctcagccatctcagctgctaacaagcgacgaaaccttgtgcctgtagtacctggccttgtaggtgatttggaagcaacaatcgcagcagaagaagacgtgctactacccacacgggaaggtgctggagcagaacgaaaagaaagtgcagaacgctgtttattctccacgatacgtggagcagcgactgcatcatcttccaaccgctgctcataagagcgtgccaagctcatggcggcctgaagattagctgtattttgaagctcaacatcaatacttaaaggcttgccaaggccggcagtgaaaagattgacttgatgcatcggattgagagatggggtaacacgacaaagaagagccaaaaattgtttttggtattctgccacagtcccggttcgtcgaagtgcggacaattcaccaagaatattgttacggatgggaggaccaaagcgcatattaacaaagtgctcaaaaactgaccagttcacgagtccattatctttggaaaattgaatataccattgttgcgcctcacccgtcatgtgataggaagcaagccagaccttctcatcctcaggcgtccgttggccttgaaagaattgctcacaccgattaagccaggtcaagtgatcttcttctccatcaaatattggaaaggttagcttgtgataacggggaacaccacgtttgtcatcatccagattagcaccactgctccctttttcccatgaatcttgccgagcctcaaggttatcaagtttcttcatcaagagaacaagtgtcttggccaaatcagccatggttgtgctgtcttccgacatggtggagagctaggtataggtggtggctggggttggttgacggtggaacacaacagatgtagcggcggaagtgacgcaagcagcgcgaatgtgaggcgtgctgcgtcgagcggaacccagcgacaaagcaagcgctggatgagggctctgataccaaatattatggctggaaatagaggattgatagggaagatcgccctcaagtcgccggcttctccggaagaccgagtctctgatctgattgacttagtgggcagggcccttaatatctttattgcttagtccttaatacaataccaggccccctttatatactaggtgccaatctaatatttaggaaatctaagacaaactaggaataggaaacagaatcctaaaccaactagaattagatatatctactgattattcctattcctattcctatggtatttgattccataacgccagtctataacagatacagtatgcaatcagattttgtatttgcatgaacacctggagtcaaagaatccacaggttagatggagagaattttgtaatttgaattgagtaaatttcatcattagcacaaagatgagtcagtttcaaacagtaaaaccataaaattttaagggtgctaataaaaaccacaggaaacacgataaaaatgtttccgaaaattaacaatcgactatttttaatcatcaattgatatattatagtactatatatagttagcagatccaacaaatgacagctgtgtttagtttcacactaaaattgaaagtttgaaaaaattaaaacgatgtgatagaaaagttgaaattttatgtgttgaggaaagttccgatgtgacgaaaaagttaaaagttcgaagaaaaaaaaattttaaaaaaattgtcctgctcttctcctctccccctcccttgtttggagaaatttaatatggcaacgccgccgtcgcccgtccacgcgcagtgtcgacttcctctcggccgcgctagggacccacgccgccgccgccgccacgtccgccttttccccgctccgctgctcgcctccccagcctccgtccgtgctcccctaaaagcaggaggcggccgccgagaaggagaaggcgccgcgaagagtgagagcggggggctagacctagtgcaatcgagccttcatcggcgccaccgcgggccatcgcgtggttagccgccggagtcgggggtgggggggatgccgcgggagccggccgccatgcgcgtctacacggtctgcgacgagtccaagtgcgtgtcgcatcacaaaccctacctctcctctcctcttccaatgcattgaatccctcttgatgattcaggtacctcatcgtgcggaacgtcccgtctctcggctgcggcgatgacctcgccaatctcttcgccacctacggcccagtagacgagtctgtctcttcctcctcccacctataccataccaccacctgcctgtgtgaatgatttgcttgcttattcaggtgcacgcccatggatgccgaggactgtgacccctacaccgacgttttcttcatcaagttctcgcaggtcagcaatgccaggtgagtaaccaaaatagtaccttttctttcagtcctttttcctgttcaggaagaaccgacgttcacagaatgagtgaaaaatgttactagccaccattaattccaacaattaaatttgtgtttggtagtcttttctaagacaaatttgtctccttctcatccctgttttgagctctgtgcttaggattacagctttagtttagtttgttagcaattgggaacaaatctggacctactatttgccaaatcgcaagtttattttctcaatgaaagcaagaaacggcattaattgcaggtttgcaaagaggaaattggatgagtctgtatttcttggcaaccggctgcaggtgtcatacgcccctcagtttgagagtcttctggacactaaggagaaactggaagtcaggagaaaggaagttcttggccgaatgaaatgtgtgcttccatgttcttcttttccccctaactctatgctgtttagccttcgttgtttcaatatgtaaccgttttctttctacgactacacattgctagtttatcttgcttggatagttatatataaatgtttgctttcatttctccagcatcttctggaagacctgaagggttatctcatcattctccaggtcagggatcatctgctgcaaactcacaccgtcagatgagctctaataaaaggttaacatattgcgtactactatcagtttttttttgtgtgtgtgtgtgtgcaaacattgctaaggagaacattggtcatcagttactcattgatcggcccagtcttcaactaaattctatccctgttaaccatgccatttggaattggaagttaccctcatatccacatctttattgatatatgacatctggtctgaatatttgaagatggatacccagtctttatgaatagcttagcagctaagctacagtgggtttaccgaacaaaactgagatctttggcacagtaaagttgaaagaaaaaccagcaatccttattccttaatcaaaagactgagacacttcttctagctttgtgtttggtttgctctttagattttatgcatcagtttgtatatttcatactcagcactaccatgtaggagtatcaaccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctctgtaggattattttccatctgagtcgatgaatgcaacagtaaacctagtcagggagaagcttgataaggtaagagtatctttgttaagtgtattatcatattcactgcaatatgtgcatttgtggataagttaaaggttccattttcaaaatttcagatacaatccagcagcgacaattccagtgctatagttgcacccaagaaaccaaggaccgataaccgtagacgaatttgatatcatgggatggagtagaacatgcatttttttttcttcatctactttcttgtagtttgttttataattggcagaaaatagtgtactataatgctaaatgctgtctatattctccctcagttgtaaaagtatccccttttaggttttctgcggaagtaacgttagtatcatgttttgacgtggattaatgtcatgtttgatgagcacatttctcttcgtgaaaagtccacctttcttttgaacaatttatatttgaaacatcatgttctgttggtatactgatttatctctacagttatgttctatttggatctcaaatggttcctatgaggttgtgacatctgtgttatggcatgaagaatttcatgatgtctgatataggagaaaaagatgacctctgctgatcagatgtactccctccgtaccacaaaaaaaccgaatctaggactggatgtggcacatcttagtatgtatgtccagattcattgtacaaagatatgtcacatccagtactaggttttttatgggacggagggagtaatagatagcttacatatactctattcggtcataaattgttgacgtctcggacaaaatttagccggagttttgaaattccctaaccacccgtatccttttcttttcctaacttcaagttcgagtcggatcccgatgcctatgtactatgctaagagcaagtacgatagggatgactcaatactccctccatcttataaaagaaaaatctaggactgaatgtgacacatagtataacgaatctagatagatctgtccagattcgttgtactagcattaagaacaaaagatagtgcagtcggctgtagaattataaccaggctatagcacgtaaaaagagaagatacaataacttgtccgcttctattagctatggagcatagatagtgatgggcctaataaatttgtatcaaataactattgtgcatgctagctactaaaaaaactaacttagactatagttagctgttggctttattattgtacctgctctatgtgtggaccttgaacatcaaacaatcagatctcgataggctattatacttaaatatagatataatattgagccgtacatttcgatgcctatgtatatgctactatcttcgtcccaaaatataacaatttctaactatatagatagaagttactatagtttataacatagagagtatgtaagcgtcgtttctcaaggtctaaaaacaactgggaagatcaaaatgggaaaatgagggagaaatatatagagatggaagagacgaaatggaaaggggaaatgaataatgcataataaaggaaaaaaaatgacaactgaattttttttagtcggacgacctcattgcccaacttcttgtaaaaagaaattaattaaatccggaaagcacaaagtaatagaaaaccatctctctcgcgatgtacaaagttgctgacaaccataaacgtggcaactttctggtctggaattcttgcgtgggaaagccgttaccacaatattaacaggaatagaagaaaggtggttactattaagtcttcgtgatagacgtaccatgacaatatttatattaggtgaattttcaaatagtggaatataaaatgccagcataaatatatctttacctctactattataaaaattaaagatgtttttgccggtgctttggtaagtcatccgtatatgagttggtttttaagttcgttttattttgaaaatacatatccgtatttgagtcagtttttaggtccattcgctttcgaaaatatagaatgagttgtataagaaatctcttaaaaaaactcgcatactaacttgaggcgatcggaatcctaaattcataattgaagctcatgattttctaaaaaagggcttgtttggtacagctccaactcctaaatataactccaggagttgagtctggagtggagttgtggagctgccaaaacccagctcctcaactctagtacattttgtgagagagctccacccaactccactcccaattttggtggaactgaaactgattggctgagctccagctccaggaggggtgaagctggagctagagctgtgccaaacagacccaaagtatatatccaaacaaatttctacagtgaattttatcttaactaaactgtataacaataataagattaaagtaactttcacccgtttgcaacgcacgggcatttttagtggaaataaaagagaaactcaaggagtaaaagaaaaagaaagcgaggaaaagagaaaacagggggagggagaggagagagagacatcaagcaagctaggaacaagggaagggaggggaaaaaactgtaggatctcccccgacaacaaaagaagaagaagagaaaaggatggcgatggcgatgcgacgtcgggtgtcgtcgtgagcgcagccctccctcgcgatccacctaccccgccgccggtaagcctccacctccgccattcctccccccacccaaaccctagatccacaccctcctctccgcccccgagatctcctcgatcccgtccgcgattccacgccgacatggctgaccccttcgtcgccgacgaccagaccgacgccgacttcttcgacaagctcgtcgacgacgacgacgacctctcccccgcccctgcccctgcccctgttcccgcccaacagtcggcggaggcggccttgcttccagctctttccgacctcagcctcgccgacgatgacacagacccttccccggctcctcctcccgtcgaggccccgccggagggtgcctcaccggagtcggggaagggcgccgtccacacaacggtcaagcaggtccagtgggcctcatttggaggcgccgccgacgatggggctgatccgttcagtgatctgtctggaggcgccgctgatgacggatttctcgggaccatggccgggaaccagagcttccagacctccgtcattgggagcgtgggggcatcagctcacgggatctttggcgggagccagagcttgactgccgaggtgacagatcaggattttttcggtggtacctccgatcagaacaccgatacccagcagcagcagctggagcagagcggaagcagtgctttcgactccacagatcccaagtatttggagagcatttatcctgggtggaaatacgacgaggcgacacagcagtggtaccaagttgacaattctgatacgcacggtaacgccacccaggtggacaccagcactgagaatatccagcagcagcagcttgccgcttcttacatgcataatccgacacagtcatcgctagagacaattgcggaggagggtacgacgacagggagtgtatcgacatggggacagggtggcacctcggagtacccaccaaacatggtattttacgccgagtacccaggctggtactttgataccaacacacagcagtggcaatcgcttgagtcgtaccagcaggcagtgacagctagtgctgttcaggatggagcaaacaatggtgtcgttgcctcttctgctgagacaaattatagcgtcaaacaaaccgaagatcttcctgcccacaatcaggtggcccaacataactctttctctaataactatagttatcagagccagtggcagacaaattcatttagtaactctatgcaacctgaaagtgcaacagctagtctgccagatagtttccagagccttggtcagcatgctatttctgaatctttcaattcctctacaaatagtcaagttagttttaacaccgctgaaaccgctacaagccattatggcaacgtgaacttagattcgtcaagtactcagggtggctacaccgcaagtggtggtcaacaaactggttacaagggcttcgaacctttcacaggtcatcaggctggttacaaggggtttgaaccttctacaggccaccagacaagtcataagttatttgatccatcagcaggtaaccaaaacagttacaagccatttgaaccttccactggtcaccaccagcacaaggggtttgagccttccacaaatcaccagggtgattacaaggcatttgagccatccacacataaccagggtggttacaagggattcagtccttccacagttcagcagcctggttacaagggatttgaagcttctacaggccttcaaactaatttcaagggatttgaaccttactcaggtcaacaggctggttacacgggatccctaccttctacaggccaccagtctagttacatggggtttgagacttcttcaaaccagggttatggtgatgccaacaatgttgcaaatagtcaaggctttgttccgatggagagcatgtacggaagccataatcaagctcatacaaacccccaagtgcctttgtcaaacagttatctcagtgttgataactccaagaatttctctcagcaacaatttcttggtccaaatgcttcacacttgcaatttgggcagtccccacatgaagagaggtcatcagctggacgtccaccacatgctttggttgcttttgggtttggaggcaagcttatacttatgaaagaaaccaactcaatggccacaaactatgactctgggaatcaggtatgctaagagttcctgtgtgatatatttttagtcatcaaacaaaattatggcatatgttaaagtaactaaaatattctattttaattttgcaattcaaggggaattctagtggcacagtatcagttcttaatttatcagaggtggtcacggacaaagctgatgctttaagcgccagtaacggtagcgcacttagttatttccatgctttatgtcgtcaacctgttcccggccctcttgttgggggaagcgctgcatcaaaggatgtgaacaaatggcttgatgacatgattgcactgtatgaatcatcgactagtgaattccagaggggtgatcctcgcaagttgcttatttctttgctgaagatactatgccaccactatgggaaactgcgttcaccttttgcttctgacccatcacatgaggtactttctgcctttcatgctcttttttgttgcatctatagtgtattttaccaaaacagaggctgatataatgaatgctccagttaatcaactcttagtgttgtaataacggcgcagagggcaagcttttaatactttttaatgtgatgaacatgtctgaattagcagtttaccttttagctcatcgtgtgtgataatttgggtacttgtttcattgtttgtcctttcacctttgtatctctgactcatttgaattctcaataataggacacagacggtccagaaatggcagtaactaagctcttttcatcttgtaagagaagtagctttcaaatgggcgatttcggatcccatgtccgttgcatgaagaatattccctctgaaaatcagatgcaggtgattgccatttatattatatggatgtgaaatttagctaaatcctaaatgtccccagttgaggcagctactttgcttgtaggctgttgcacaagaggtccaaaatcttctagtttctgggagaagaaaagaggcccttcagtgtgcccaagaaggtcaactgtgggggcctgcaattatacttgctttgcaacttggtgataaggtttgttcgacttaatagccttctcttgtttgcatttgaatagtttgcttgattttcaatgaggttttcttttccttaattttttttatttatcttttctttccccaccggtggtgcagttttacgtcgatactgtgaagaaaatggcccactgccattttctatctgggtcacctttgcgaacattgtgccttctcattgctggacaacctgcagatgtttttaatgcagacaacaacatcagtagcaattatggttctcaacagcctatggaggtaatacataattatttttcactttctagatgcgcgatactttggtcgtaggattattctgtagttagatgtaatagtaataattgttcttaacttttcatagcacttgcctgtcccatattgttgtacaataatggcttttcatttctttgttactgcagtgtcatggtgctttggttttttttttcttgaagaaaatgttttgcttcattgataatgcattctactgttctaccacctcgttgttggctttctgtttaaatagtggctcactttataattcattgttttgtcacacagcctagtcctaatggcatgttggatgactgggaggagaatttggctatcataactgcaaataggacaaaaggtgacgacctagttattacccatcttggagattgcctttggaaagagaaaaatgaggtctgtatgatatgtatttgcagaattaaaccctttcttttttgtggtcaagtaccttatatgccttttgatacaggttgcagctgctcattcgtgctatttagttgctgagttaaatattgacccttactctgaaagtgcaaggttatgtctccttggtgcagaccaccttaagtgccctcgaacttttgccagccctgaagccattcaggtatattactgctagccattaacccattacctgtaaatatattgaatcttagtgcaattttccctcgaagctctatcttttgctttttaatgattagttaatgcaagcatactgtctcagtgttttataagcaattattgcatagatacatagactggaaatgcaagattgtgtgtaaccgctaacctgttgcttcatctttttttactctgctgtccactgttctgaactaatattttgaaatgcgataacagaggacagagatttatgaatatgcgaaggtgcttggtaattctcaatatatcctgctaccctttcagccatataagctgatatatgcatacatgcttgcggaagtgggaagggttgctgattctttgaggtatgttgttgatttgtgcatggccagcaaatgatttcaatgctatacctaaactcctgctttcacattatgacccatttgaatctccttaaaggtactgtcaagcatctatgaaggtgctgaaagcctctggccgtgccccagaattggaagcatggaagcaattattttccaccctggaggacaggatacgcactcaccagcaggtaaatccttacagcttgttttgcaatgtagctgagttcctccctctccctattaatgcacttgtgttgattgctattgtttagggtggatatggcacaaaccttgcccctgcaaaattagttggaaagattttcacctcactcgataaatctatatcgcgcatgatgggtacaccttctgctccacttccgccattgccacagggtgctgttagtgatagggagagttacactgcacctggggctacaaagtttgcaaatagccaatcagtaatgaccatg

SEQ ID NO: 23216 - DNA, 4018 bp, Oryza sativa
cgctttggttggttaggctccacactacagaagacaatgggatttgtttcaaaatcccaccggcaggtactttaactgagctattgaattggagccactccacttttgttcagtttctcttccatatagtaaagctaatactgagatccttcctatgtcttgaaggctaaattagggcaacaaaacaagttttactatgacgaaaagctaaagcgatgggtggaggaaggtgctgagattcctgccgaggagcctcctctccctccacctccatcaaaaccctcattccagaatggtgtggtagactataaattaaatggccccatgagtgcaagtcatactcccaatggattcatggaagggaaatcttcaacttcttcagagcatggttcgggaatgccaccaattccgccaagccagaaccagttttctgcccgtggacggatgggtgtccggtccaggtaatctaataattctgccacttgctcatgtctttctctatattctataaaatattgaccagaggaaagttatgtttatttttagatatgtggacacattcaacaagggtggaggaggaggagcagtcccatcctataacaagccagctgttgcatctgtgacaccacccagtggtgccaaattctttgtgcccactgcggctgttgttgctgcagagcagatgcctaaccaaacagcggaaacacatggtgaaaccttccgtccagatgagcgttcatccccagctgaaacgtcattttcttcacccccaccagcaacacaattttcagcaccactgatggtgcctaccattcagcggtatccgagcatggataacatcactaccccgaacaatggatccggattatcatcgggaagtaacagcagctcattctcaagatcacgagcagcatcgtggagtggaacttactctgaacaaattaatgctgtggcaggtgctagatctcctgaccagcagaccatgccatcgcccctcatgcctgggaagcagtcacatagtcgttccaacagcaactcatctgttcagttcaacagtttgacagaggatcttcatgaggttgagctctgatatgctgcgactgctcagtatgacccatgattttatagaaacaacctgggtaaaataccttgatcctctcagcaaaccccctagaggagggagggagggagggagggaaaaagagaggaaatgttttacagtaaatgaagggaatgccacaagtgaaatggatatctcctgtcttgcacaaagttgtgggatggggaagtaaagcaaggtgtgcccgccctgtactcgtacaaacagttgtttttttgggagattttgtaggtattgttggttattatgggtttagagaaggggataaagagtcggatgtccttttttacatgtgagaagcagagagcatgtggacaccattgtacagataatccaccccagcccagccccagccctgcccccatattataattcattgaagacgcagagaattgggaattcatccgccccacatccttttttgtcattgtattattatcattttttttcttcataattttggagaaggatagaagagagggagaggtcaagatgtgtctggatattctagtgtaagaaagaagaaagcttttgactgcgtagagtgttgttatacttactgtaatgttcctataccatgatgatgataatattattctttggagtcgaccgatggatcaatcaatactggagtaagtagcatcctttttgttttgtttcccagcatgcgtgatgaaagaggtcaatatcatgtggtggtttggtttgatgtgattcatctggtagtttaatttgtgctgtgtgttggtaaccaaaggctctctctaaaaccggagaggaagaatagatcactatttccttcattccaaagaaaatctataacagaaattgagggcaaagaatctggataattgttttaagtttttttaattggttattctaagatacttcctccgtcccaatatattgcaacctaggatagaatatgatgcccaggttcatataggttcatagtattaggatgggtcaatcccatcttagttgcaatatattctaggttgagtttttaggatgtagggagtaggctactagagtagagagattggtaggaatcaccaaaagttgagggcatttttttatttattttcactaaaatatttaaaaaataatcttttgtttcaaaaatttatagatctggatgcctcatgccatttgggagtgtaaacgggctttaaaaaaacatcaaacattctgttagagaatgatgtggcatataactgttggttactcctttcccgccctcccagagggtttttttttataggaggaggacgcttgtaaatctgcttgataagatagaaaaatctaggccacccttataccagtattttgggggttttttttataggaggaggacacttgtaaatctgcttgataagatagaaaaatctagaccacccttataccagtattttgcgggtagcctttcctcagtaaaaataataatatattttcaaagggcaaaagggctccgtctgacatgaacaccctcttttttaggctgctattagacggagccaacagtcatctgccagataaaaaaaaaagtcctctcaaagtgcatgaggcgtctagatctgtaaatttacaaaacgaatttttaaaatattaaatgaaagaaattaaaaattagaaaaaaaatggtgaggtgaggaggtaggcaagtcaagtcgaaaaacatgatgatgacgactgctaattcggcccaacaagtagtcccctcccctccctcgacgagagaagacaagacaagtcgcgacctgacgacccgaccttcctcttctctcccgctgccctccgccgccgacccgcaggggatcgtggggacgatcgatcgaggaggagagacccaaaccctagccacccaggcgccactcccattgcccccttcgccagccagccatgtctgcggcgcacctcctccgccactcccgcaaggttccttcctctccctctcccctctcctccatctcttgtttaattctccgcagcattctctcatcccaacaccgaacgcatcttgttccgatctgtcgtgcttatgccattccaggtcgatcggaacatcaccagattcccttcagattcccaatctaatattcctactgcagatggctcacattccaatctacggctctcacttttgtactgcagctgcggactctacgtgatgctctagattatgatcggtctgctcttgtacgctacttctccgctgcttctgcatcctttcccacaaagggaggtgctgctgctggtatgtgctgtactagtagcctttttctctttttctcaattgatttactggagtatatgcatgcaatctgtttgtttgtttgtttgtttgttcaaccaatctggagatgccctttcacattactaattttctgtgctcattatttatttctcttgtttaattgtatcttctgtttgtaatctatgtaattctgctgcggctgtggtcactgcttataagtcctgcattgtcatcatcgttcaaactgatgtggtgctttgcactctcacttcaatttaatcagaatacaacttttgtatcttgtatcagttatcctggatcctccagaggtgcttcttcttttgcacctacatattatcagtttcacaagaatatggggcattcatcaattatgtattctggactgtaatctaattaatataggcaaattatcaattgtttacactaaaatctgtacaaacaaactattttaacacaagcacaatgctttctcatcttttttacctctccactccgttattttccgtaccttcgaccaaacatgttttggcttcctgagccaatatcatcatttttatttattaaggtgtcatttgccgttgacttagtttaactacgctcatatcctccagtgcagacag

SEQ ID NO: 23217 - DNA, 1167 bp, Oryza sativa
tgtctagtttgtcattttatcttttcaggtgtcactaggaggactaaatggaagatatgcttgtagaagagcacctaacaattgtatcccaaccactattaccggtctcaacggttcattgtcatggtatgttttgttttctgctatgctattgttagcttatatggctgtgtaggaatatattgaattagagaaccacccttgaaacaagagaatatgaactagtaatacttgaacattgagctaagacaaaccataaaaaaattattgacatcttctgtaaggcccctgagatatgcctctctgctctttagtgctcttttaccagaagaaatgaccccatgacagttctaatttccattgcatcttggtaatattcctcttttcctgtttcttttcccagtggacaggtgtcttcagcaagatctttctcaagcagtgcaggtacttatcccagcagttagttagtcttaagtgggtttattggttgggcctcacttatgtgtgatgctttttgggaagtgttcttggtgggaggggttccttgaccctttctttataaatatttctctcttcttaatgaaatgaagcgcagttctcctgcgttttttgggggaaaaaaacaggatatcgcatagcagctcctcagttttttattgatcttttttgcacttatctacaatgttgtttttttgccatccttctttttgttctattatttgcttcactttatcccgtcttcccatgtaccaattgtttcatgcatgtgatcctctattctgctacttttttttggatatttttctccacatctgtatctccgttgaattttcaaaactttttttttgtatgtgttatataagcatttaggttatttgctacaaaataagtatatcccaatctcacaccacatctccccattgttttggttactatgttaaaattttctatgtaactccaatcaatggttccttacagagcatgtaaagtaaggtcctctgttagctctcttaattcttgacgcaatttgcttattccagacctgccaccacatcaggaaattgggatgccatcactctctcctacaatgactgaggtatctgttacgcaaaaaaaaaaaaaaaaaaaaaaaaaaaaaaccgtgctccttatctgaatatcttgaat

SEQ ID NO: 23218 - DNA, 1172 bp, Oryza sativa
gagatcaaagttggtgaggtaaaaatttactgatcaaagaacaaccaatttatgactctcattttactaatatgattattacagttgcctctgcctataaatttttctgacgtaatcttggttgatttatggccccactgttccttttagatcattgctgtaactgtggaagaagagggtgaccttgagaagtttaaggattataaaccttcaacttcagctgcacctgcagccccttctgaaccgaaggctcagcctgagcctgcagagccaaaggtgaaggagacagagccttccaggactcctgagccgaaagccccaaagactgaagaagcttctcaaccagggggtcgaatattctccagccctcttgcaagaaaattggcagaagataacaatgtagtttttttttcgtgttacctatctaggctattaattggtagattttattgaatcatacttaataaacacaaaacaggttccactgtcaagcgtaatgggaactggtcctgatgggcgaattttgaaggcggacattgaagattacttgggtatgccctttctcttgtcccctccaccccccttctctctctctttctcctcccttaatgatgaaatctgcgtggaaaaatgcaattaactagttttatatatttaccaatgactatagattaatttattttcaactatatcacttcctagtttttttagagaaaccgctggggaagccctcattttgtagctagtcatgtgtgctcctggacatctcatgctaattctgaatggtggactcataatgtcgaattttattggggtgtcctccccttgccagctgtcttcttgttcaatctttaaggctcaatcacaagaaaacaagctgtatcactcaatatctttgtggttggctatcatatccattctaagataaccatattcagatactatttgatcacttaattcaatatccactggaccagtatatcaagttttcagaagaaaaaagaggctatttatctgactcagttttgcacttatgcttatttgtgtacactgtgttagtagcagcactagtttgattcaaagtaatattaatgtaatttgcttgagcttgccaaggttcaagttaaatgtgtggctgtcactagcctgttatgtatgtcagatttgctgtg

SEQ ID NO: 23219 - DNA, 8030 bp, Oryza sativa
  unsure (1)..(8030): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacaagctgctactcctagatctgaaactctgaataggaaaaatctaggaccaagtccaattgaataaataaataatgaaataaatgtagaggagaagatgtgaccttgttgatggcgacgcatccggcagtgttgtcgtcgatctcaacgatctgaacattagacttgttcgtcttcttcttctcctccttggcagaagtatccttgttgtgctgcttgaccttgttttctgctgtcttgtctgccttgtggtggtggtcgtcgtccccgaagacctcctcgacggagtaggcgtgcgaccatgggtggaggaagcccttgcccttgacctccttggcccacttgagcttggtggtgccggcggcggaggccttggactcccacttccacttgcggtcgaagccatcgtcgttgggggtgtcgatctgggcctcccacttgaaggtccggtcgccgtcgggcttgtcgtgggtggtccacttgatcttcctgccggcggattcggcctcgtaggtgtacttgctgcgtggggcggcgagctcaagcgcggagacgcggtgggcgagggagtggtggagaaggaagggatcgcggagggcggggcaggaggtggttacaggtggggtcggggttgggaggaagaggtcaaggtcgaggtcgaggtcgagatggtggtggaaggcggcgtcgaggtcgtaggaggaggtgaagccgagtgggcaagacgatgaaggaggagaggtgaaaccgagtgggcatgaggaggagggagggaagaaaaatgggtgggtgtcgtcgaggaggaaggaggaggaggaggttgggaaggtggggaagaaagggtggtcgtcggcggcgaggaagcggaagaggtggtggctgccccccatggctgatggcagtgtggactgtgaatgaggaggagcgcaactatcgccgcatctccatcgatcgatcgatcgtgtgaagctgaagcatggaagggagtggggagggcccacatgtctgtctgccacgtgtagcacgtaatcagtcaatggtcgtttccaaccagcacgccacgagcactcacgcagagtactgatccctccgttctaaaataagtactgttttagctttattcatgtttaacgtttcaccgttcgtcttatttgaaaaaagtttatgattagtatttttgttgttattagatgataaaatataaatagtactttatgtatgactaatttttttaatattttttaaataagacggatggttaaactgctaaacacggatatttatggctacacttattttggaacggagatagtatacatgagggaaaggatggaatcccgatgcggcgcggatgtcttgcgatccgccgtctcctgtcctgtggactgcacgatgccatgcgcacacgcagacgcagagagcgcaccacgatttgttccttccatgccgcggtttcttctcttgggcgtgtattgttgcacgattcttctcctatgaagagttgctagccattgggaggcccagcccgctctatatcatcgctgccttttccggcccagcccatcataaataatcctaccggcctggcccaactcctttccttccaccgcactgcacttgtcatgaaattttgggccaaaagattgacgtccgccccaccaagttcgttcgcccactgacagcccattaattaagcaaggaatgcgcggctcgttcgtccggatcaacagcccattcagcttgcttgcttgctcatccgccccaacaaactatgtaaattatttacagctaccaaaaattggtaagattgatcaaggcaatcaatcacagtgttgtccacgagtgctcgacaataagtacttgtctttttcttcttatcattaaaaagttccctggttcgaaaaaaatgacaatactagtagttgttgatagacagcacattatattgcacacacatactacagtcgagtcgatcactcttgtagtgatcaatgaatccttattattgtagctagctaagtacggagtaggtactttaattaattccgtgacgagacgacgacgacgatgataataataagatttattagaggtcgagcagctggcagttctcccagagcgtcttggcggagcggcggaggcggcgggcctcctcctcggtgagctccatctcggcgacgccgaggacgccggcgcggccgaggcgggcggggaggctgaggaagacctcgtggtcttgggggatgccgtggaagccggaggcgaggacggagacggggtggatgcggtgctggtcgcggaggagggaggcggcgaggctggcgacggagtagccgatggcccaggaggtgtagcccttgaggctgatcacctcgtacgcgctgtccaccaccgctcgccggattccctccagggcctcctcgtcgaagctctggtggctctcccgcagcgacttgagcaccggcatcccggccacgctcatgctcgaccatatcgccaccgagctgtccccgtgctctcccaccatgtacgcctgcatttttttatttttcattcattattttgtcaatttcctcaactaacatgtcactaataatgtctagtcaatagtaattagcactatgattaattgttcaatagaaccctaatatcaccactatttaattaatcgtggagcgatgaaatgttaggcccaatttaaaatggactttttccccccgtaactattcagtgttaatcactactgatgcaccttcacatctttctctctggttggttcaataataaaaatgccgtattacatcataatagattagactgttctttctgatagtcattctaagatttattctctccatttgtttaatgctggagctgcgtttcgtttcttaaagagggaccaactcatttttagctagtaaatggtgtatttgatgcaaaagtttcctatatacaaattatctattatataattaaaggaatagaaaaaggagcttccacattcgctctcatggcttagaaattctcacattaatcggagaaaaagaaaaagcagagtccatatagaaatacaatttagaaatagctgaaattcggaattaaaaaataaggaatattagaagaggagactagagtccatatagaaatacaattaggaaataactgaaattcggaattaaaaaataaggaatattagaagaagagactagagtccatatagaaatacaattagaaaataactgaaattcggaattaaaaataaggaatattagaagtagagtatagagtccatatagaaatacaattaggaaataactgaaattcggaattaaaaacaagaaatattagaagtagagtatagagtccatatagaaatacaattatgaaataatagaaatttgaaattaaaaataaggaatattagaagtagaggatagagtccatatagaaatacaattaagaaaaaaaatagaaattcggaatttaaaaaagaaatactagaagtagagtatagagtccatataggaatttaaaactaactaaaatttggaataaacataataaaattaaaagtagagtctagagtctgtataaaaaatacaatttacaaataactaaaattcgaaattaagaaaaatatgggaagaagagtttaaggtcaatataagaatacaatttattagtaactgaaattcgaaattaaaaattgaagaatattgaaagatgagtttagagtccacatagaaatacaattagaaataataaaaattcagaaataaaaataaataatattgaaaaaaaaagcatagtctatatagaaatacaatttacaaaaagttcggaatttaaaaaagaaatattaaaagacgagtctagagtccatataggaatatatataatttacaaataactaaaatttgatattaataactaacaagtatataaaatataatatgaaaattcagaaataaaaataaataatattggaagaagagcatagagtctatatagaaatacaatttacagaaaattcggaattaaaaaaaggaaatattaaaagacgagtctagagtccatataggaatatatacaatttataaataactaaaatttgatattaaaaataattaataactaacatgtatataaaatataatatgaatattacacatattgcaaaatttaaaattatgttgtcattttaatatatttgaataatatagtgagaaaacatatatgctattatatgatagaaaatataatgatgctaggcgcgcaatttgattttatatataaaaaactaattttaaaatttgtagttactaatattcgattagtcaaatgataataactttgtcttgttggaaattttagccaaaacgttctcccgtatgcggatcctaagttgtattattccacatatagtagtagctaggagcatcaacccaaggcattcgattctattcagttgaatcttaataatatcatatcagcactaactaagcatctttgggcttttatcaagttgtcagaagcatgtgttcgctcttgtcacatgtgtgcaggaagctagtcatccatggaaataggataaaggctaaaggctgccatgtcatcacatgtgggtgggcagtgacaccaccactcagccaaccatatgctttagctaggccccacaccacatgtcactttgtcgcagagagagagagagagacagcaacaatggccaatggacaatgggcaatggcaatggcagtggaggagagagagagaggggtaaggtgttgacctggacatcctgggcgttgacctggaggtgctcggcgaggaggaagcggaacctggaggagtcgaggttggtgccggagccgatgacgcggctcgccgggaaccccgacagcttccacgccacgtacgtcagcacgtcgacggggttggagacgatcagcagcagcgcctccggcgagtgctccgccagcgccggcacgatcttccggaacagcgccacgttccgctgcagcaggttcaggcggctctccccggggatctggcgcgcgccggccgtgacgatggccaggtcggagccgcgcgtgacggccaggtcggtgtcggagacgaggcggacgcgggggaggaacgccgccgcgtgctgcaggtccagcatctccccgcgcagcttgtccggcaccgcgtccaccagcgcgatctcgtccgccatgtcccgggtcaggatggtctgcgcgatcgccatccccacgttgcccgcgccgatcaccgatatcttcgtcagccgacgccggtgcgacgtcggcgtcgacccgccgtccgccaccggacggaagaaccccgacgacgcgccctccgcgtcgaaccccagctccgacagagacgaagccttcttcatgtcgcgagaccgagatcgagatctccctccctcactcactggatgaaaggccaacggcgatgtggatctctcctgaaaatggaaatggaaatgatcgatggtggttttgtggctcattccatggaagttctcctcctctttatagagaagaggtcgctctggagacaaaaccgctacactacagacggcggttttccaaaccgctcatgctgatttgactctcaaatatactcacacaagatctaatgatgctgacaacaatttcttcttcaaaatcaaaaactaaggcgttgatggttttgttcaccggccctaatttataggggtgcaaggtctaataatatcatcacatattttaaactggtatcgagaatgtcgatacacgctaaccatataattaattaactcatacactgcgtttgtacatgctgacgtgtttgctcgtcttgaacctttccgtgttgttacactgtttaatcacaaacccaaaaacaatatataactcaacacagcatgaactgttgtacccgcattctactatatctctcccttgtaaaattgacgacggtctacaaaggttgctaagttgattccatcaatttgtgccctactactactgctctactgttctgtacagtatttgtgaagaaatctcactgcctatcatcatatcgcgtgtttctctatttaaaaagatgccggcccgcttatcggtcaaaagtgcgcaaattagtacaaacagataaagaaaaaccactcatcgtggcacattggatatatctaatgcagtataccattctgctctttggatctcctagctatcctatctaccactaatatattttctcgaaatagggttacatttcctttacctatacttaagcgaaacagtagtagattaatagtagcagtaagtcattggtactactttccgcaacgaatgaccgatccaaatctggcacgctgtcaaagaaacacttaatttggtacggatgttgatggaaaactgtgcatcatgcatctttcccggaagcaaccctgtcctggaaccggtggccgtttgctggttttgctcttgcttccggcgtttcttggaggataattatgctatgctatcgaaattatcaaaagcggagctatgaaaagctcagctccttatgaaatcggttccatttttcatctcctcctttttccaagtttttgaccttctagtctcccttcgctttctagcattccgttccatttgacgttcagaattgcgtgttggatttgggattactagagcgattcatttccttttgattagaagcttcttccataagaacgctgaaatgcatactgcgagggacaagattcgtcttaccttctcggtcctgcagcttcaaagaatgacaaccaatcaacgcacataggagtaggtcaagaaatatgagacgcacttgtgccaactcacgtggaagaaaataacaatgcaccgaccaagcagacaatacacgatcaaacttcccatgggcagccaaaaaagaaaatcagtgacttggaggagaagaacacacaggcatattctttcttaacaagcttccttttgttttattgtactccattaaaggcccaaaattaaaccagcacatcaaacatgtatgtgaaataagcaaatgcatgatttattatgaccaataatctacttctctacacaaaagcttaagaaacagtataagccatactccccaagattgccaatttattccgaaagatccttctgcgcctcttggttttgcactatgaaggggaaaaagaaaagggacaaatcgtatacaggctatactgcattgtttcccgggaatttactctctccagttatcacacttgccgagggtaaacccacaaaaaggtgctaaaaatgcttgtaagttgatcctcctaattcccactataactggaacgaaacaaacaaacaaaaaaaaaaaagataaacagaaaaagcttttaatccaaaaaccaggtcattctgtctatggttatgtgctcttggttttcgggtcctccttgacagaacaccgtgccggtattatacaaaatgagatagcaccactctgcgttattcgagcacatgagaagaatagttttgctgatctttaacttcacagtaacattgagtttggattctcgatatagcccttgaatgctttcagaaattctgcgccgatagcacctagagaaag

SEQ ID NO: 23220 - DNA, 559 bp, Oryza sativa
agaaataaatttaccataatcaccttcttgtcaacataattctaatcccaggatacatgctccatgacaacttactggcggataaaatcactcatccacgagctattacactgagggacctttcgaagagccagagctgcagcctgcacatcaaattaagatcaattcagatctggaggtcaggagaaaattaacagtctgtgaactgatatacatcatacacccaatctgcgacaactcaatggttggtagacataagaaacaagaaaacggcaattacctttataacaagatcgttaatagatatcttcttaccgccagatgactcttgcaacggattcagttcccctcgcaacctggattagattgaaataaagaactattttaaaaagctacaaaaccagcagtatggaattgaatcattacataggtttcctatgtaatataggattgctttaaattacaaagctaggcttcaacatacttgataagattatcaacacgggcgtcaactgtcaagtaataatgaggaatagtttgtttagagcttagcaggcgg

SEQ ID NO: 23221 - DNA, 434 bp, Oryza sativa
ggcaacaggagcagagccgaggtcgcttgccttcaccaccaacacggccgtcatcgctctcctcctccctgcgccgaccaggccgggagagcgacattgccggagctcgaggaggtagctttgctgggatccaagcaaaacgcggtggatgcacgaggtgtagcacaagcagaggaggaggaagacgtacgatggcgatgacaattacgcgtgcatgaacttgcaagtgatcaagtgatctaaacgcgtgcttgtgaattcgatttataatacagtataggagtgatataacgcggtgaggaatactcgctcgtttttcctcctcgctgcttcctcgctgctggctgtcgttcatggggtctggttaggtttgccgagtcaagagtcatctcttttacccttctctgctgtgcaacttcttgtgccaaagatga

SEQ ID NO: 23222 - DNA, 9224 bp, Oryza sativa
cctgcagccctgtttttacccccctctctctccccacccttgttctatacggtataccgtatacatacatcggcatattcaggactacctggagcagaattttgtgaatatatatagcagtagggaacaagaaataactgaaatggtactacaacatccgttctaaaatcgacatccatgtcaaggttattccatgacacacttgtatgtacacctactactagtttacaccttaattttaattttaacacgcctagaaatgttttaagatatgaaaagaaatacctcaaggagatcaagcaggccagcactcgcgtatactcttatatacatggtcatcatatgcatatattcgcatgcttcccgtgcttgtagaataagtgatttttttttaaaaaaaacattttatatatactatgttcctaaataagtatctaacgtatttttttaagatagagagagtatattttttggaatatcattttaaatccatattttgactttatagtagtagtagtgtataacatcacaatccatttagatatatatccagctatttgaaaaaaaaaaacccacataattgggctggagaatacacgcaccagcatgcatctctagccacctcgctgactgacctggctgacctgacctgcagtttccagttccatgcatgaactcaaaaatggggggaaaaacgctgtgctgacctctccctgaacatgtggcacgcacaaatcccttaatcaaattcatcgagatgtgggacgaaacgaaatagtggtagtaatacgtgtgcagggcaacattattatgatatgtttagattgatacggagtgcagaattaattagtcactttatttatataacagacccctgtggtgtgtgattagagacagacagcatcagcatggcccatcacctgacacttattttatagtacctctacacatgctcgcatgcacgtaattgtatattgttcgcaagattttagttactccgatcactcacaagttcccaaaaaggaatcgccccactaaaatatactgcaccacagctgactggtggattaaactatagtgctagctacacgtagcacgtattttgcttaattaattgtgtacaaatatttatgcattattcgtaattttgtttcctacaaaatgtaaacaccgcacactccctccgttactttattgttggcactattgaccagtgagtatcatttaaaccttaactgctaataatttttaatagtcagcgtatgatgcatactagtaaatgttactcgatccaataatataagtatatatcgtttcaagtctttacgatgttttttttaataaaatgaaggatcaaattaagttaaatataaataatgcgatggcgcagccaaatgtcatcttgttttcttcgcaaccgatgctggtgttgtcggcggcggtgcagcttggcattgctgtcgatcacctcctcccttggccagcatagcaagcctcctctccttgttcgtcagttgagttgatgccaccagcttatccctctcaatgcaaaccatcacgtgacgtgcatcatgcggccggccggctcgccggatctagctcgagtagtcctagcttgttgatgatgacacagcgagttaaatttgtatctggccggccacacaaactccctctcgtccgtaacaattaatgtagattaggcaacaatatatatatggtgagctcgacagcgataagagggcaagcctgagtacgatcgatgttggggtaagctcgatcggcaatggtgtcgggaggacgagcgcgtgcacagtggccgccggcaggagggagaggacggcaagtgctattgtatttggtgataaccacatgtagagctgagacacccgtgccttctgcaatacaagggtggctctgtgggatgggcaccaacggtggagctaagtggtgagccgagaccactactagctaggtaggagacgagcattgtggatgtggattgccatggtaggagtgaagtatactgtaggaagatactcgcctcctggatctggagtatgctggtgggtgccaggaaaaaccaaccgtacccatggaacaaccgcctagcagctggctggcgatactgtgagctcactctctgcatattcattcagagtgatgtgtctgacttactgacagcctttctacgaagtaccagactctccactccacacacgtgcctaaaatggcttcttcttcttccataatcttgacacggccaacggaagaaataactaactaacttccataatctcatggcgataaactttgcttatactcctgtccttgtccattgataccccgtctgaatcttcttctcttacaaacttgcacggatttccacccctcttctgtgcattgttactactactttaaagttggattttttttttgtctatgaaaatttactttgaattttatagctataccgaattgactcgctgaattgttcgagggtatctgttaaatgcagttgaaacatcaatgatatgttgttaatgaaactcagctgatagtgtcaattattattatgataatgaacaaagcagggagtgtgataattccaccatgaggagcgcacacacaggtagacagtcaaagacgacgactagctagtactccttccgttccaaaagttccaaaagataaaagcttttttttatccttacacgatttatgagatgttattttgatcaataatatctataaaaataagatacattaaataaaaatagctgtatattataatagtttatttaataataaatctagtaatatcaattttgcaagattgatttttttatactaatagttaaagttaaaaatatttgacttatcaccgtactaaaaatgcttatattttacgccgagggagtacctgttttgttttaattaaaaaagagaagaaaatgattaaaacatgcatctaccgacacatcgtctgacatttgactattggacggcctcctgatcacattcacatctagcattgcagggacaaattataaaccacaataatcctcctccttgaacagtgagagatgatgagtaggagctgattaataagctaatctgttgtagatgatcatatcatatataagcgaaaaagcagtactcactaattaacatgtaaggattaaggaataatggatatagctaagagagaccaacagaagcaacaaaagaagaaaaatgctgtgacttgtgagcccagccaagctatcactatctctctctctctctctttgtgcagatgagaatgagaggagacgatgagacgagagagagagagctattaagcagcagaagaagcttaattgcatggctaatgatgagaaggaaggagagagagcaataagcactaaactagttaattaatggccgtcatggctctcatccacttggtcgtcatgatcatcggtcgctctcccaacgccaacgccaacgtcttcctcgtcgccgtcgccgtcgccatcatggtgcgcctcgtcgccgtcgtccttcgtcctcccttcctcgttctgctccccgtcgaacgggaaacccggcggcgcgcaccgcacgtctgggtacttcaccaccgcgtccagcagctccgagctgcccttcgcctcctccccgccattgccgcccgccgaggacgacccaccaccgccgccggagccggagcgggagtagaggcggtcgagctcgtcgaagtaggggcacgtcttggcgtgcgccggccgcttcttgccgctctccttggccttgcggaagtacttgttgatgttctcccacttctccttgcaccgcttcgcgttccgccggtagcccgccgccgccatgcgcgcgctcacctcctcccacagggggcccttcagccctggctcctggaacctatcctccagccccgtccgcacccggatcagcgcctccacctcgtgcttcggccaccgcgacgagctcagctgcagcgacccctcgccgtcgtacgccaccacctccttccccacgccgtcctgctcgtcggcgcccggagcggggttggcggcggggggtgggagcgtgatggtctcgccggagatcttttccaggtaggcgatgatggcggactcgcgtgcagcggcgctggcgcggtcctgcgcgcgcgcggcggcctcgcgcgcgaacttgtcggcctcctggcggcgccacgcctcgtcgcgggcggcgcgctcccgctcccggcgctccatggtgtcgaggaactgacggtggaggctctcctggtgctccatgaggcgctgcaccaggcgctcgaagaaggaggccgacgcgctgagctgctcctggcgccgccgcttgcgcttgcggcgcgccgcgtccgcccccgacggctgctgcgtctgcggctgcggctgcaccacggcgtgcgcgtcctccccggcagacgtctcggacgtgttgaggtgcggcgggttggcggcggcggcgtcggggaggtcagccatgggcggcgcgagcatggcattgtcgtccccggtgaggccggagccggagcccgtctgggggcctccgctgccgggcttgtagatggcctccagctcgctgaagagcttgtagttgacggcgccagcggaggcggcggatgcggcggcggcattgtcgtcgggcttattcttgaagtaatacgctgggggcggcggcgcaggggagtcgggagtggcgggtttgtccttgggcggcgccctcttgctgctgctgctgctgtgtatgtagtcgatgtcgagtggccgcctgcacagcaaatccaacaaaacaaaatcaatgtcagcaacagctcgctccacagctaattaatctgcacaatttggctgcagctctgttgctaattgatttgcaagaagaatatggcgtgcgggcggggcggggcggcgaggaagaagaagaagaaatgatgagtgcatgcaatggcgaattgaggggggcggttgggttggcttggcgctttttggtgagtgaggtaatcatcaagtcgaaaaagggggagacgaaaaggtgatagctttgcgttgttgtggatgtggctgtgaattctgttgatggagaagaagaagatgagatgagaggaggaatcgcgacgcatccatcatcatcatctgtgtgctgtgcataaatcagagagggaggaggaccctgcgcttgcgagcgatggctccctttctcaatcatgacactattattggccgtcctctgctcccctctcccgagcaaagagagcatcctaagcaaaaaaagctctcctccttttcctctctgttcttctcttctccaccatggatggatgcatgaatccactccaagcacgcactcactcactccaatttcaactcaattttaggctgagtaaggataacttgtacgtaccaggtcggttctttgatggaagtttcctcgtcccccggccaccgccggagcctgctctccgtggccgcctcgtcatccccgccaccacctcctcctcctcctccatgaagcatcatgccgctgcccgcgccgcccccgtcgttcagcgcgtcgtccgttccgccggtggcgccgctgccgccgccgccgtcgacccccagcttgaagctcatggcggcggccaggaacggagggacgcccggaggggcggcggcgccggaggcagcgctcccggcgccggcaccggagctctccggaacggccgcctcgacgtcgaggccgagatggtggtgcgggtggtggtggtggtggtgctgcggggcccacctagccgggggcggtggctgctgctggtgcttctggtggtggtgctgctcgtggaagagctggaggtgggggtggtggccggcggcggccgcctggtggagcagctgctgcgtgaagggaatcccaccggcgccgccgaagtgcgccaagtggggaggcatctgaggcggcgggtggtggtggtggtggtgctgaggcagggcgtggtggtgcagcggctggtacctgaacggcgcgcccagctcctggccaccggccgccgccgccgcggcagcagcagcggcagcggccgcctgggcgggctgcggcggcgcggacatggcgaaggcgccggggtccatgatgtactgctggaactcagagacgccgccgtagccggactgcatggcgcctgcctgcagcttgctactccactatcttcacctagcttgctaccgagtagagagtgtcactcaccttcacttcacctagttcgctgcatcaagtggtttacatgccggtcgggtaattaagaaggtttgacctgagctaaggaagaaaatgcagccagccaaaaatctcactcacccctcacaacggtctgagctggagctggagctggaggtggaagaagaggatgaggcagggcagtgcagagtgcaggggtgaagagaggaggaaggaagaagggagagggtagcacaggcacagggaaggtagtcaggtttggtttccattttgcatctctggtggggtgctcggctttatctcctgcctcttttcgaaaggggaccctgctaatatccatatttgtatctccacccatccaggccagcccagggtgctcattattattctccttcaggtccttgtcccggtttgaatggactgttgctctttcaggaaacccctcctcgctttttctttaacaatcctgtccgggttttggggcgactcctttttttttttttctctctctctttcaattcctatgttcctatctattactatcgtcttctctcttttattttttacgctgctccagttattagtatttctttatttgtttgtaccaagggctcattcgaatcacacgatagaaaaaacataggccgagtttagttccaaaatttttcttcaaacttctaacttttccatcacattaaattttttctacacacacaaactttcaactttttcatcatatcgttgcaatttcaaccaaactttctattttagcgtgaactaaacacccccatactttagggaagatataggaataaaaaatgaattcaaatgtaaaattgaggatcgaaaaacagagaattatatataatgggagaacttgaaatagaggataagaatagaggaagatttataaggaaatgagaagtaatctaactctacttttccccggactcttctttttctagctgacgagcaacacacctttgtcccgttgccattgccaccgaatgcggcccaacacgccacaactacgtggcccaactccacgctgtcgattgtgctgtccggcttcttccgccgcctagcttcctctaggaccccttcatgctcttcccctcctctctgacttttgcgtctgcccaactttgagagtgagcccgtcggccgctatgtcgttgactctctcatgcatcattcactctacgtcgaaaaccgacctaaaaaaacaataatagtactacgaaaatgcagttgtaagtatataacaactttacaatatatacactatgggtatgttcggtagctgtttctgtggcagcgctacggctgcgatgcatactgtgtgtggttgtggctatattgcttgttgctacagtcctgccagccgaatagaccctctagtaattcttgtgtttgttcaaactgaatgttagtgtcagtgtgtcactaccattccaaatcgagatgatgatttccacacaaaaaataaaaacagcagcgtcctatgaacactgcaatatttaaataatgcatgaacaaggggagtaaagtgaaaaagacctgtccataaaaaggaaaaagggaaataaaagtagagaagaaaaaaaaaggggggtttagtacaggctacagaggggaagcaggtgacgtcagcgccactggcaccacacacgtgccatgcacgtgtgaagacaaaggacgatttggtaatgtattggtgcatgagtatgatgagatgcctagggcactgcagttttattactagtactaatcgctctgcttcttagaaattgatgatccctgtctgccaaacccagattttccatctctaatgatcttcttgaatcatctgcttgcttgtctgcatgcacgcacctcttcatcatcgtataattggtttttggctcaacgattcaacgaattacgcataacagtttggagaggaggacactgtcactgaggatgcagcggacacatgagattagaggagatcaaccaaatggtgacggactcattagattggtggtaggcctcatgcatgacgactcgatgaatcgatcgatcattatcgttgtgggatacacagtacggagtagataaagacgggcgtcaagtggtgattgggctacacagttgactaccggtccgtacgtagtacacggtggcatctgcctccactattacgtggcatgacatgctactttacgtgggtcaaatcgacatgacatctggccgccacgcacagctcgaccttctcctataccatgcgagaaccaacatcttttttttttttttacaaatgttattacttaataatgatatttataacatgatggcattacgaatgacctcatgctttcacgtcggagctaagcggctttattaaacgggagagtggcatcacatacaggatacatacgtcttgccgaagatatgggggtccatgcatgcttaatagaaagtgcctgtggcacaaaattaaagccaccacacaggatttatatctcatcgcctatctttcttatacattcgttctctttcattgtcctctatttaattaatgacgatactgatgaggatgacaatcaacgctcttccttcgctcgtccgaccaccattgcccctatctccccgtagctcgggcttcgggcactaccattttctttccctatggatttgacttacataagcccattctcattatacccaaaatgttcccacttaccatcggtatcatcctccatacctccaaccatcacaatcgtcaccaccacccatttacggatcttagacaacctcaatggttggtttgctctgggcgatagactaagtgaaaaatctaactagtgcgatggcaaaggggataaagtggattggtgaaacgacggttttaataatagagaactagtgacatagcggcctagtcaatagcgtctataacgaaagatcgacgacttatcaatttgcacattcgttgcctt

SEQ ID NO: 23223 - DNA, 3459 bp, Oryza sativa
atctcctacatatccttaaagcaaaccatcctggaaaatgggttcaactcaacccatcccttgaaccaaacgcatgactagagactgctaggaattaaagttaaaattccaatttgcaccatttctcaaaacatattgctgcatttgtatctccacgttctagctagctagaagatcgattatgatcagctccaacaaaaccgttcgaatagaggaagaagacggatgagaagcctgcacggcgctatctatgctctacacacactacagtagagtgaaagctagctagagtccaacgaaaaggaaaaagaaaaaaaactaaaggctatatagataggagtagctgctatatatgcatgcgcaagagacgctagctgccacaacgagctgatgatcgatcgagctcttggcctccgtgcctcacaaagtaagctacgcctacctacgggctacgtatacgtacgtacctgtagaaatcaagaaaggaggactcatcagtcaacctctaccaagctaattaaattcagctcaaaattaaaggtccaacatccaagaaaataagtttagcgtggcttagctccattccgctgcttggagtctgttttagccgccgtagtttctctaagcttaagttttttcttattttgctttttcttccctcccctagcataaaccagtctggctgattgcgtggtgtaactaaaactctttttttcctaatatattgatcgtgcaattcttctgcgcgttcgcgaaaaaaaaaacatccaagaaaatagatccttcggcaaagtgccaccatggctgtgtttagttggtgtgctaaatttttctaagtatacagacacacatttgaagtattgaacgtagactaataacaaaacaaattacggattccgcatgtaaactgcgagatgaatctactatgcctaattaatccatcattagcaaatgtttattgtagcaccacattgtcaaatcatggcgtaattagtctcaaaagattcatctcgcaatttacatgtaaactgtgcaattggtttttttcgtccacatttaatgctccatgcatatgtccaaatatttgatatgatggaaaagttgaaagtttgaagaaaaaagtttgaatcttgcatgtatcaatcttcgtcaagaaaaaaaaatcgctcgactaaatatcattgcattggtttcttatgtactatcacttaaataaatatagcatttttctttataaaagtggtaagataaattagtatgagatagatctctctacgaacatgcaaattcaactcacttcatttcgtattataaatcgttttgattttttttaatcataacttattaccaacatatatacaacaccaaattaatatcgttgagatgtaatattgaatatgtttgtttttattaaaaaaattctatattttcctacacatctactagccccacctaaagaaaatatggcacatgcacacacataggattgttcatttggggactaattagggaaagaagcaacaatggaaagcagggtcgatgttaattaactattgatatcctatgtgtaggtactgatttgaggtatagacctgacctaccaatcgagagttggagacagtattgtcatccatggtcaatgtgtgtagccggcctgcttgctgctcgatcgatcgatcgatctctgtccatatttatcgtgcttatgcatgacagcatacttcatatatatactagctattgcagcgctcgagcagagaatttgtcctgaacgtgtacagtatacaatgatctgtcatatttaccagctgcatgctagctgccgcaagcatataggagcacaccggatgtgcgtgtgtgtgcacgcagatcaggcggccccctagctagctgtacgtgcagcctccatagacagatctagaggggagagaagggaggccggggaagaagatcgagaggaagacgacgaggctccctccaagctaaagctaaatccacctctgtttgtagcattcatattttaaatttttagatctaaattcatatgtgttcttaccctaaaaaaatcatttgtgcttgcctcaagattacaagatcgatatgtattgatccgtggaagaagatctgtcaggcggagcaagctctctctcgttgctgaggtagcagtcaagagtactgttggttgggagtttgacggtgggccttcttcgtggatgttggctgggcatattggatttccctccttttgagaggagcttcatcggtacgatgaagacggtggctagacaaaatgaaaatacttaggatgctaatgtagaatcgaaacacaagaactaagctaatcagaagggggtgaatggttggtatacctaaaaaccgaaaacttttagcgaaaataaaagttaccctccaattcgacggatcacggtctgaccgaagtggatgcgctggtctgaccgcctgatgaacgtcggtctgaccaatgtagatcgatcggtcgaaccgccgaaatcgcttgccgccgcttgtctgtgccgccggtctaactgcccttgcgccgtcggtctgaccgccgcttgttgccggtctgaccgccagtgggatgccggtttgaccgccgaaacccggtgaaacacaaatcgaagaactctcaaattagataacaactttattacttctctctgtgtttacaaagtgcaccaacaatactccttacaaaaatctcgactaaactcgaaaccctaactaaactagcaactcaattgctctcaaaagcgataccgggaagcctcacgctccccctctatttacacatgaggtaggcagcctaaagccacgaaccaaactcatactaagagtcctaaacaccttaggaaaccctctagtacaagacacaaactttacataaccaatcataccaaatttggactccttccaaattcgactccgcatcccatacgcacacaatacctccatcgtatgccatatgaaatcttcaccaaccacgtgcatcaactctagccatgaaacaaacaaagaaaccatattccgaaaccaagctatccccaacttgactcattagtagcaaacaacagtattacatacgtatagtatccatctagaagccatataaccatgaaacaattacggatatccaaagaaacaacccgaaaccgaaaccgacacagcgtcggccggtcagaccgcgggccggccggtctgaccgctcgatcaccaccggtctgaccggcatacacagcccggtcgaaccggtcacataaaataacagtaaatccaatcatctctgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctc

SEQ ID NO: 23224 - DNA, 12662 bp, Oryza sativa
ctgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccctggccgaaccggcaaaggggggcctgcgcggtctctcggtgaggagccccacgctccgtcatcaggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtctggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtaacgacagggtcatggcgaatttctttcccatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgatgacgagggtcatgtcctcgccgtcgagggcgcttcgcgggccacccgaaaggggaggcctgcaggaggcaaaaagaacgaggccggcgctcccaacagggagcacccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttagatcacatcgacctaccggtcaccttcggtggatccgccaacttccgcacggagcgggtgaacttcgatgtggcggacctcagtctgccctacaacgcggtcctggggaggcccgcgttggtgaagttcatggcggtggtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggtgtgcgaccttttgtgttttctagatgcatactctggttaccattagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattaaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacagttctcatttcacgcttccccaccctgtgccgacttggcccgggagagagcagggaggagaggctcccgagccgaacggtgacccaaggcccccgacgaccggagttggccctctgcccacttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttctaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgtcgcctcctggtgttaggtgactcccagctggtcgttaaccaagtctgtaaggagtaccggtgctctgacccgcagatggacgcctacgtgcgccaagtacggcgtatggagcaccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctgaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgtggcgctaccatcagcgccatgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaagtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgcctcgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactatcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattacggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtacgccaccagcgttgcttcccggatggtgacggcggcctcgcggtccgccagatccctctccacgacgtaggcgcgctcttccagcgccatggcgcgcgcctcaagggcctcttctcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctctgccagcaccttcttacgagtttcaagctccgagacgtgccggcggtgagccttatggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttctagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacggaccgccccgggtagtctggcgccgggcgtccctcgcccagcgtgactatctcccggccggtggcagattccggcatgaagcggcgcgacagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggcacctcgcttctcgctcccactatttcgccccctcgtttctcgcgcccacgcttccactaatcccattcgcccgcttgcggcgcatgaggtgggtatgcggttgtggcagtcgagatagatcatatcgtgcgcgcgttaattacgctcgccgaccgaagcgacgttaccatatcttcagacgaaacgaatcgccatgtccagatttgtgtgctactcaagtaatgtggcagtcttgaagagaccgctcattgttgacagccgagttaccattgccgatgtgcgtggtttgtgaccgttgagtttctgcccaattgtggagaccggtcccacctgtcaccaggtcttaggagtggcgtcatgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggtctgataccggtcatgtcgtcagcaaacagccacgattccacgtcgcacctgctcccggcgaaagtggaggtagttgtgggccgtctcatcagaaggtgactcggacggcaactatacaaatctccgtccatttatgaaaagggggggggggggtaagtccccacaaaaaagagagaaatggtgcatgtggtatccccttaagatataaaaggaggaccttgcccacagagaggggggactggacttttccagattagaaacccagaacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcaatctccaaaactacttcgtgaataaattccaaatatcaaaaccaataatcacatataccaattgttcatcatagaataagaatcaaaacacacattgatcttacagctaagtccaagctatccttggcctccagtttctttaatggataacaatgtcatcttttggcatcgcatccttcacggaggcatcgtttttttgagtcttctctatgtggtgttgttgtagtaggctcgacgatgattggctggtttagtgcttgtgtgtgtatggttggcgtgtggttttgagatgtgcactctgatgcacatcctttctttgcactggtggagaaaccatctttggtcggtcgaccaaattccacaatagtcccgattgcaataaaaaccaagactaaagattatctttagtcccggttgaaaaggttagagctactttttgatctttagtcccggttggttgactaaagatcatttttagtgccggttcaaaaaaggataggtgatatcagacccctctaatatctttagtcccggttggtaacaccaaccgggaaaaaagatcggcatgcacgagagatcgaggcgtaagagtgactcggatcgagataaatatctcctcctctgc

SEQ ID NO: 23225 - DNA, 5244 bp, Oryza sativa
acgcgccgaggatcctctccttctctcctctcccccactcatcctctcctcctcccctcccctcccctccggcgggtggcgacggaagcagcagcgagatgaaggccgaccggtggcggcccggcgtgaggtggcgggatgagaggctggccggcaccggccgggcgcggggcggtggaatggagtccggccggtggcggcgggatgggaggccggccgggcaaggggcagtaggatggaggccggcctcgcactcccctcccgggcccagatctgtggatgattttttcttttcttttttgatgatttgtggatgttgatttctgaatgttgatttgtgaatgtgtttgcgaatgtttatgtgaatggttttgtgaatgtatatgttgtgaatgaatctgtgtgaatgtatttgtgatgttgtgaatgaatatgtttactgtgaatgaatcgatatgaatgaaggaaaaaactgaaaaaaaaataaaagagaaagaaccgaaggaggaaaaaaagtctttagtcccggttggtaagatcaaccgggactaaagatgcctgcgtcagtcacgtggctcaaccatctttagtcccggttggtaacaccaactaggactaaagatagatttttagtcccagttatttcacccgggactaaagatgggtatttttagtcccgtattcgtagtcccggttgtataaccgagactatatgggggttcccaaccgggagtaaagcccctttctccaccagtgttgacatcggacttttgatgaaaaacttttttataaacattttatcttatatcttaacaacattcggattacctctctcagtcatcgtggaaaaaaaaactgtccaagaagagcaatgcatatacagacttacagtacgtgtatgtagctggctagcgagtgcatactagctagtgatatcatctcagcgtattctgtttctctgtcctatgatcgatggattaattagctcattatatattgtgcaaactgcaagtaataactggtgggaaaatgttgattcagctgcaagtcatgcaggtatataacacatggatgaattaattaatgaatattaatgtaacgctattatagttgctagatggatatatatcactgtactagatataaatacatggatagaacacgatggggcatgtactgctgcttgcgttcaatctagctagatagatctgtgtttgtttctttagtagtactatatattttctggcctgcgcagcctcgacgatatatcatgcatctatatatgcatgggtaattaatgcctctagaaattaatcaaagcacattgtcgtgcatataagtatatatatatatatcgcatgcattctgtgtgcgtgtagtacgtaagtatactgtagttggtaaccactgccttaattttgctagcttgtctcgacaatttaattaaatgcctgatgaccaatgcaggtcgatcagtcatctctatatatagagtattatatacatgcatgtacgcagcaagtacacctgatgatgcaaattgagccgaccaaatttgcatgcatgcatatatatacatgtatggacttgatgcataattgattcaatataagtattagctacgacaattagcaagtcagtttttatgcatatatatgagtatagttttctcgaacagctagcgtatagtgtgcaaataccatgtatgatgtatgtaatgtgtacaaatgcaccgtatgcagataaatgtgtacgtacacatttatatcaataatgtatatacgtgttgtatatgtatctggaaaaaaagagagggggaaatggatggaaaggaaaagaaaaggaaggagtggggggcagatggagaggacgacggcatgcacaagtgacaaaaattgctacagtgaggaggatcgatactattgtgggtggggcccagtgggcttgaaggtgagtttggcccaccccaggcccaccgacagccctgacccgttactgtcaatcccccacccgggcccactgtacgtcaccccatccctcctctgcactgcattgctagcctaattcactgttcattgtcattttgtttgctcattcctatacccccgatctcgatccattttcgatcgatgtcgatggtcatatacaaatttcgcctcgactccatttcaattattaataattactccatacgttttcaaaacaaaatggcgtagctagttcgtttcaaaacagtaattcgttcacatatgcctgtgccctcctatgtactatcacacaaaccatgcaagttaacttgcgttcaatacaatcatacgttgccccgccggcaacctggcctttttcctttggagctacgctgtcggatggattattagtttatcctaaagccgcattagtatagctatatattgaattgaagtctacccatgttgaccttgcttatttttcaattatcatttcatataacagagttaattatacaaaaaagtgttatatatggagataggttgatcctgtccttcgagactaatctacgcgacactatgggctatacagccgtctacgtataactgtatatggagcccgtctcaaattatcacactagtacattttagccatgtgatggtttcttaggcagtactcccatccccccgtctcgaaacatatattagtagaatgtgttctatttatctctattcagatttcgttcttatattataagatgatgaagggaatacgttgtttgctttaccatagtaacttgctttctgcactttcatggacgcgtctcgtgtccacatatagtttacctaatttaactttaagcgttatatttgtgaccatcaattttattattgcacttttgtaaaatatataccagcttagacaattaaaaattgatacatgatgcatacgtaacacacgtacacgacttaattataaaatggttttcactggtcttcggttgctgacggcgccgcaaattgccagctaacttaaacccatttttacctctaatgaataccgattttgtagtagtgatgtgtgtcaggatcgatacacatatatacatggatgaaagtagtagatatattaatatacccgtgatccgatatttcaggatcgatcgagcgaggaagggatcggaagaagctatggggaggaggacgctcacgcatggacctgctggaccgtccggagtccggacaataataaaatcaagtgtaggagtacatgctgctccaccccgaccattgtcctcctgcattggacagtagcaatacattgccacattgcactgctgtcccctcctcccctctatctctatgctcttgctagctgtcccagctacttctcccgttttaaaatatagatatatttaaagttttagccaactgatatggaaaaataaacactcgagataacaaagtagatgaaaagttaagagatgattgttatcgaatgtaataagaaattaaacgaagagagatttattattgtatgaatactaagaatgtttttattttaaaataggagtatgtcgcgtgcaataggcaatgttggctagctacctattgcagcttagggttactttgaatcgtacgaataggaaaaggaaggaatataaaaacacatgatttttaatagtaatgtaagtggaaaatataggaaaaacataggaatttgattggaccgcgggaaaaattgtaggaatcggatgagatagatagatcgactcaaaggaaagattctcaaaaggttgaaactattgctaaatttttttcaaaatctttatagtattgtccattccatataaaatttatataaaatttttctatatgattaaaattctctaaaatttttatgtgtttcctttaaatcaaagtacgccaaatgtctccaaacaaaaaccatagctggcccctacgcacgcatggacgcacgtacattggcagatttggatcactagctagctagtgtttttcttttctttttcgtttacactagttttgattaattccctgctacatactcgtatatgtacgccgttaattaattaattaattgccattcgtcccgacatgtacaggttaataaatccatttgcacagtattttatctactgttttttaaatcttcatcgcatagtgtatagtactagctactctacatgtgttcgaaaagtttcagtgcacacagtacctatcgaaattacgttactgtggtagttacgtcacctatcgaatatatgtacttcgtgccatttactacctctaccttcattttctaatatataattttgttaaccttttgacatatatttaacattttattttttttccacggacatgaacaaatatataagtattcattagtaaagtcgtatcaaaataagtaacaattacatatttttaataaggttaatgatcaaaaataccttaaaaatcaacatcatatttttttaataatgagaagaatttcgttagaaatgaaattacacctaacttctacatcgaccagagaaactcacaacctaggacaaaagaaaccaaagccaaacataaacatattatgttatcttataccggtagaatcctaagcatctagtaaaaaaacaacacctctaagaaggtcctaacatttgtgtgccattgccatcggaacaagacgatattttcatccaaagcccgagatgacaccttcaataaaaaaataacaaacaagcattgacattgaatatagataaactagataagagttttcatcccggagtcattgtcactactttgtgccaccgtctggatgaaatgagcatgatctacgatgtgcagccaatatggacaaagtgcaagcctcctctacccaccaccaccgagctaatggaagaagtcaagtcatcgtcaagccgaaatcttggaaaaaggaaaaactacggacgaatatatcacagtgtcttgcctgatatattatgagaatggaactcgttggctcaactagatgggagggtgccacaacgcacttcaaatctcccttgtttgatctcgcttggattgcaaaccatacctggtgtcgatctggcacgtcgtggtgttgggcagagaagaaaatcccatcacaactaccgccggcggttgcagtggcgaagacggtgcataggtccaatggtgtcgtagaagcagaagctcactgtcgaggccatccccgacacaccccatcgtcacaacccgggggatccactag

SEQ ID NO: 23226 - DNA, 4028 bp, Oryza sativa
acgacgagataccacccggacgccatggccccctggatggatggggtggcggcgctggtgaaggttgatgtttgtcgccctcaggtatcatgtggagcggattactagtttatttgtgatatagtataaaccgtataacaaagttttaaatggtgcaagatgttttaaagaaaaatgatgctgccccatgcgtccatcgaggttagttagtacaattaggcattctttaaaaaaagtacaattaggcgaatgatgtctgctattatgtgtgtacgctattactccctttgtccctaaatatttgacgccattgacttttttaaacatattagaccgttcgtcttattcaaaaaatttaagtaattattaattcttttcctatcatttgatttattgttaaatatacttttatatatacatatagttttacatatttcacaaaagtttttgaataagacgaatggtcaaacatatttaaaaaaagttaacggcgtgaaatatttagggacggagggagtattatatcagtgagcagcgaaggcatcatacaagacactgcttgagcgtttcatgtacacacaaaatgcattgttaattttatttgtctgtacgtactttgtttgtagctacaaagtatcttgcataatgttcggattaatgtggtctgaatttaattgtgaattttgaacaggggaaggaagtgccgtcccgtgtgttaaattactagatgaatccgaccacgaccatttcatagatttaatttgatttgagctatatagcactgctgcaacggtttgcacggatgtgtcccactgacgcaattaaacacacaccttgctgttagcagtagatcgattcgaccatgcatagctccaaaaccaattttgtgttgaataatataaggtcagatgaaattaatatagttagctggaaactgatcaatccaatatttcgtgtcatcccggccgtcggcggcgagtccgtgtgaaggccaccgccaccagctagcagcctctgctctgccgccgacgaccaccaacgttgtttatttcagtacgacggaattaaccaacattcatgcatgcatggtttatttaaaccgattttctggaggagattaccgcccggacgtccgatgtaactcaaaatatcgaactctacccactggtggagaaaccctttgtagtcccggttcgtaacccccctttagtcccggtttccaaaccgggagtaccaatccgggactaaagatcgctatctttagtcccggatgaaataaccgggagtaaagatcaatctttagtcccggttggtgttaccaaccgggactaaagatagagctgaccttttttttttttgcatgcccctgttgctgcatggtttatatatatatatatataccatgcatatatatgcatacatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatatgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatcaagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattccccttaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgtgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggatggccatgcccgacgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttcatcatcg

SEQ ID NO: 23227 - DNA, 10300 bp, Oryza sativa
gagtcacctcctgtgacagtgaatgaattattgaaggaagcacaaatcaacgctggccttctccatttttggctcttctgtctctacttttttttttctcttttacaatagaaatatagtacactaccaccattcacgcacatggaaaaaggggaaattttattattttttcattctatttatcccataatataagatattttagtgtgctacttatcgcatccatcaactttaatttaaatttttactacctacagtatatattttaacaccaatctacccactcaagcacaaccaaatctcatttaatagggtattctagtctttcttgctatcattaatctactaaaagggaataatcccttatattagggtatatacaatgatgtttaatatccgttgccatgatgtaaatttgatgacgtcgaagagagaaggggaaaatgaaatatggttgctccgcataacaacaactcagagttgattcttagtatttattaaaggaaattttattgcattagagatggagaaaagaaaagaaggatataaaaaatattttggtgcattaatggttactcatatatattagagagcttgttatctgaacaataagagtatatttctctaagtgatgtgtactgtattaactaagagctcgtatggggcggagggagtactatctacttcatacttgatccctccgtcccaaattagatatcgctttcgcttagctttttttcttgtaacgtttgaccattcgttttatttaaaaatttaatgcaaatataaaaaatgataagtcatacttaaaatatttttagtaataaaacaagtcacaaacaaaattaattataattccataatcttttgaataagacgaatggtcaaacgttacaaacaaaaacttgaaatatcaagtattttggaactgagttagtataaagaatgggcacacgactattgtagtatataggatgctcctcttgcgaagaactgtagtatcctatcatcaaatcgtgtagtaatatttagaaataataaaatagcacgacttaataattttgaaattgtaattactaattatcgagttgcattcaagtttgcaattgtaccctttattatgtttcgataattttaaattttggaaccagtaaaaactgagttttgtattctttgtacgtacagattaaatgggatacagtaaatatttcctataacgtgcagattaaatgggatattacatggtccacgatcataatacgtttcatctcatcaacgccagttctttccgattgacacgaagctctaaaaaaatgcttaattactagtagaactataaatggacagttaatattgaatcttgaatcgtcctagctagtctaccgtcgtccttgtcctctcaaatgcacgtagtacgtactgttgcctgccgaatatcatcatcgcatctgttaattgctggcaatggtcaccggaagcatatatatgcacgatccaacgagcaccattggagcgacccatcgatcgagatgaattgaagagactagagatgtgatgatgtcttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaggcgttggatcgaaatccaacacagctgtatgtattttggattaatttctctcgctcaatgagaatagcaaattaagctgacaatcaattaattaatggattgaaaaaccgattactttacacaaatatatatgcatgcatggaagtagctagtactactttattaatcaaacttgctttgatacgtactgtactgtgtacagtatgtagataacgacgctagcttctaacacaacgtacgtattgcgcacgatgaatacgtgattcaattgattcatatagtagtacgttcttcatagcatagataggattcgttgattggattcattgatggatgcatgcgtatacatatatcctactgtgcgcatgtcgggatttaaattgggcttacatgtgcatatatgcatggctcgattttttttcgaacgcgcaaaaggattgcacgtcaatatattagcagaaaaaaagcttttgttacacaaagcaatcagccagactggtttatacctaaaaaaggagagggggaggcaaaataaaaaaacttgaagataggaactaccacgacggttaaaaacacaactccaaacagatgtgacgattggtggctagggttttaatttgctactccctttcgttccaatatataagtacaatctaaaacagatgtgacgatatatccagattcatagttttaaatatcacattatactcggttaaatttatattggaatgaaaggatactgcactagtagtagctatacttaattagaggttaattgtactatgtgtatatggttccaacctttcaatcctgtccagattgactcctccctctctcaatcaggcaggacgatcagctagtactgctctctccatcctaatcaaggaacagcatcttactaatgttataatacaatacgcgcatacatacatacgtagatacaattagctaacacatttttattctctaaattcgtttctttaatagagtgaagatctttaattttgttggatacttatatacattgtgtttattgggataaaagaaatgataagataataatattattattttattgatttttaggatagtggtagttgcgtattttatgatagagggtgcaatgacatttctatcttaatcttcctagggacataggatctcgggtaaattattcaattctaactaatttatattaaaataaatagatatatcggttaatagttacttcccccgtttcacaatgtaagtcattctagcattttctacatttatattgatattaatgaatctagatagatatatatgtctagattcattaacatcaatatgaatatgagaaattatagaataacttacattatgaaacggatggagtagataattaataagtactatattgaacttggatgtttctttgattggtcactgggaggaagtaatatagagctaggaaggagagagataggcagtagtactacacctatatgcatatcgatcggtatcatggatggatcgagatgtgacaataagtgcaatgcatgcattgaatataatactatatataaataaatgaatatatatgttggggccgggatggtcacgcacaaattgccaaaatattaatggctagcttagctagcatacaaacccggccagatttaaacatgcatgcacgctccccctctctctctctctctctctctctccttgcttgcttgcgtatatgcatgtatggtccatacagtatgcatgagagagagcgagagcagagacacacatgtacacacagagggagagggatatattgatgcatgtggctaagctatgctaatctctgtcatatcgatcgatcgatgtactgtttatatatatgttggtctaatggtctggtgctgggctcacaccggccggccggacgacgctgcctgctggccggctagctacagtagtactggtacccgacaacgacatatatgaagtagtagatacccacactgcatccattgttagagtttgcatcgaatatatgtatgtagtcggttacagtttaaaacttggagttgtaataggtgtttggactaaagtaacagtcggattctattataggctctctcataaatagaggagcgtacctgttataaccgcatagcgacataacatagcgagagggagcggctgccagcggcgaccggccgtgagtcattgtaactctaatatgctggatcggggaggagtgccctttatcaataccctggagatgtaggctacgactgaactccgttatcaaatatggtgctcggtgtgtcatcgtgtttggatctcctatagtgttttcttccgcggtttggtttccaatgtgatttcggggccagtcttataacaagtggtatcagagcacttgttagagtgcgcaggccagcccacacactgtgggccactcaggtttcattgggtctactccaccacaggcccaacgaagtacaactttagatcctgagtctacacaacctaaaagactagtctgatggtacgtaccccatgcaacaacgacatatatatggagtagtagacacccacactgcatccatccatccagctagctattgtagctccatcgatcaatcggacgacactacgcattcaaaagatctccattcaaaaacccgacatgtacgatatgatgcatggagtgcgtacatcccaaacaaatgacatgtctatctcaaaccccgccggcccccattatgttaatttctctcttccatgtctcaccgctagatacatgtatagataacctaggacataatacttcctccctcccaaaatataaataacatttgtatagcttttttttcacgggaattagataatagattattgtaattagtaaggatgagtaagcataagtagctagctagagaaattaaacgacacatgcaggtctgattgctcaagatgacaagaagctagcgggtggacaagtatatatgtttcataacaatttttgaatgctgaaataaagcttgtcatattttgggtccacggaaagagtatatgataagtttagtctctaaacgtgggcatttcagggctttggcttattaaaaaaaacatgttattaatgttaaaaaagaataattttagtaaaacttttgtacttctgtttttaacggaacaaatgttaaggttaagtgacacaaaacgatttaaaaaaaaacctaaattatgtttctgaatttcataattggacatgcccttataagctgcagcttaaaaatagaagaagaagcaatactacatctgagaagatgaatattaatggatagtttatagaccaccatagcgcttgttaattagaggtgtggtgggtgtttgcctgcagcttttataagatcaagtagctagtcggtcggagtagtaataagttagttgttcggacagacaagaataatggatgttttcctctcttttttctttaacttctaggcatcctatatcgacacttgctctgtttctatttaatcatcatataataaataaattctttcactaaagatcaaggaaggcttaacgtccttatacacttaatttattatgagtatattgtaaaaaaaatatcaagaaatatatatgcttaaactcctccacatacacaagaaactgcatatcaagcaaattaaggagctagggttatgtaatatcaattcggagattctaatttttgattatgtgacgggctgaagtagttttaagtgataacctatccaccggtaagaatgtactctatctgtactaaaataactttattttttatccatccacacataccaataaaaaaagactagaatatttctagtttatcagattttaatgcaattattttatctgctccaaatgtatttatcatctgctttcacaaactctcatgcaatgattatttaaaaataaaactattttgtgataaattaatgggaggagaaaaaagaacttattttgaatagaagggagtactcatgttcttaaagttaaatattaattatttgtaattataattgaggaggcaaaacaaaaccttggtgttacatctatccaatggagcagaagtagataggtataggtggacggtggtccagtttgatgcgtggaaaagatacggatggaaatgagtggttgccgcctacaattgatgatatttgttttgtttgtttgcaattgaattgaattggaagggcagggttggtggtaatgataatgacagtggccggccgacatgtgggcccgtgttggattagggtcccctattaatatactattgtacgctgctgcattgcggtgcccattctggtcgaccgtctcctcctcttgtgcatatctattgttttctttctggtactgttgtatgctagctaggctagcttctttccttaatcaattgattaattagatataattaatggctatccccctaaattacacaagaatcctgctaaattcatgaaagagcgatgattgctaattccttctaggatatcctttatattatgggtacgggaacgggatacggcaaaattatacgagcaacctccattttttgattcattgtagtacaacccctctgctttagttcatatgtaagaattaggaaagtaattttggtgcaaactgtttcgaatatagcattataaaagactacactaactacgactaactttgtgagcgagatgacatttagtatttgacaatttgaacagtcggaaaaaactggagtacattgagattggaggagtatatacttacttgagtgtaaattaaagctcggcctcagagcattagacgcaaatggaactgatgcgcgcagtaataaaagggatgatgctgcaaagagaaaagaggctactccagtaaatgtagagtataactgaaaataatttccaggagaattgaaggacaatatataaaggtacttgtagctccaagaaatgaagtcaaaattaagggtgagcagtgcgtgttatgcaaatgcatatgctgccgattgatccatcgatgcgtctttatcagtcatgcacctggctgtatgtaacgtactactactgctgtgcgtcgcgtcctctttcacagagctgcaacccctgccctgccctggccctggcagcttgcatcgcattgccaccaccagcaagctctctgctgcaaaaggaagaagaaactgcattcaaaaggaagtctagacatagaaagatctggagagtaaaaaaggaaggaaatttctgtaccttagctattgctttgctattgtagataaagtaaaccatgcagctcattaaaaattgaattaggagctgataggaattgggaaaagtttgttttacactctctgaataccgaactattaaaaccattcacttcagtttgaaccttaggccgggtttagatcccaacttttttttttcaaacttccaacttttccatcatatcaaaactttcctacacacaaacttccaacttttccgttacatcattccaatttcaatcaaactttcaattttggcgtgaactaaacacacccttaatttgaatcacattgggtaatctatcaatgacttggcaaagtagccaaaggcagaagccattttattttattttaaaaaaagtagtagaaagacttaaaagacctacaagaaattccatttccactaccaagtgcttataatgcacgactgacataaaacatagatggtctaaaaaaaatatttactacttaaaaagaccatagtggtgatggttgttcctacaacaaaaaaaaagttagaaatgaatacataaaacttatttgttgggtagcccactaaactttgttcacttcccacaaaatttatcaagtttggagtactccaaccttgtggaatgacagaaacttactgtatcgatattgccaatttctttatttgaatcttctgcaacaatttgtactgcagttgaagagtggaagcatgcagccatgcagggggcatcaggtctgtaggccaaaaaggattgacaacacatacatgttattaccgggttccattatttgacaatactgaacggaacaacggcctatgctgatgccagcgttaagcagtgttagcagacacggtaatactgtttagcttcactaaagtgctagcggaggcactggagttaaacagacttggggtacatgtgtgctattcaaccaggaaaagctagctagcaaacaatattgttgcaacaggaaaattaataatgcagttgaaccccatagtacagctaggaggtcagcaatttactcatgcatgacacgcttggcagacaagaactgcaggtgttgagttttttaaagggaggaaaatgtacctcacaactcaccagggcaggagatatcatcatctactatgggctatggttacaaacttacaatcacccaaagtgtcagtaggcagcaactcccctgcaaatcaaaaggttgaacaaaatttgtgcaagccaattattacaaaacaaccaactgtagtaaacaacaatgaattcctcctgctagttaacaatgacgcaagtttaagctaggtaaatcactccatcttatgtagccctttggctctttgcacgtaccttggtgacattaccattagttgcgacgttgcttgggttcgccattttgtttgctcacccaaaagaagtttatttcctggcctgactatccagttttaattacattctaggcagctgcccttctctgttaaactgacatgtaacagtagcttctaacacgaggcaaggttacagctgctactgttctctgggccttcaggtcagcacctacagtgccaatctgaatcaaaagttgatcaactttttatcaagatcgtacaaccatatagacagaaagcaaaaagaatgacatctcaagttagatatagtaatagttgtaaaagaaagcacaagagcactgtacagaacatcaagtcgacacaggatacattccaagaaaatcaacagggaatcaaaacaatatgttcattacaataccaatttgactgatataagatatccttttagactcacagaaacagtaaacaaggtgttctatccaattcttctttggttatgagatatactgcaggcaaagtagtcaacacaagtttgatgactatatacaataataatatcgtgaagtgtatgtttttatatctctctgtaaaggttgagcctgttggtggcaccaagcatcctattaacgacagtcgctccttggcttggagaggtaatatctgacgaatctcctccgatttgcaaggaggagaccgcttgagctgctatgaaacctgggcatgcaactgactggtggaacattccttggtagcacggtgcctgcaactgcaagtccttcacctctccccaagatggcaatggctggccaatcccccaatcaatacacctccctttgggagcataaacatgatcagcgcactgtatcagtccatcaggaggataaatatcagcgccttgtgcatccacggcgaaatcaaaaccagctgagtgatcccaatggttgcatcttctgtgcttgtttagcatcaaatggcagggttcatcggagtcctcaccaatgaggacatgaagagcaactgcttcagctatcgcagcaccttcctcatccagcctttgctgttcttccctcttcttctgcttcttcttttccagctcagatataatggcagcggagtttgcaagcgctttctccagccgccgtctcttcttctcagcctgcttctggcgatctaattcatccttggcttgtttcttcttacctttcttcaagactttgcccgcctgattggccgcggccttttccatgacaactatgtactattttcagctaaactccactagtgactgtaattgtaattacgggaaagcaaaagcttcaaagttcattgtttggagtgatccaggccagaaagcaaagcactggctagcgctaaaaagaaacaggcagtgcaggatgctacacccactcaggtctgaatgagtatcttatcttgcggaagatgcagtcccaaaaggagacgacaggtgagaggaggagggagaaatggtaggcggttgctatttcatccgttggtaagagggttgtgagaggcttgtttgtggtgagctcctgacccatcttagtagcaccagaattgagggaaaaccacagccgaccagctcataagaatcttatactgcatcaggaggaaattaaaagaaaaagatcaatcagcttagtaaaat

SEQ ID NO: 23228 - DNA, 1557 bp, Oryza sativa
aggtataataataataacggaattggtgatgacgggcgggcacagagaagaatgaattcggggaaatagaggcacagagatgagtcaattggagggaacaacaacaaactaagaattcaattcattgaggttgagggagtaggagatgagattcatcagatccctaagtaactagcagcggggggtgattaattcccgaagcctaagccgtaatcaagtgatttgggggtggagatggaagcaggtgaggtgaattggggaagacggaagggtgaattgaattacctggcactggcaggcagggtaggatgaagatcgaagaggaggagatcgaattggggatctgcgccgccggcgtccaaccaatcaatccaaatctccttccacttcgttcccccttcgccctcgcctcgcctcaacggagaagcaaattccgatcgattcgatttggggattttttttttccttctctctctctctctctcttttctcctcttccttaattaacacgtaggagtactcccctagtccgcctgatctgaacggagcacgtgcgcacaacgtgtcgcgtgggccgtggtgggttgggccgaatccactcttggcccgggattggattcctctgcgctcgctatcgcgtgttttgcaccttcataattttctcacagaaatgctatgtactacactttgtttttcactactttatatctaaaccctagatctatcttgtgtttatgctccagtttttggcaacatacgtacatacatacatacgtacatgaatgatatgcatatccacgacaagcaaacaacgtacatcgatcactcacctctcatcttgattaattttagctttactaatagctagctatagctagctagctacttttccaggcgcccaacatccagctgattcagtttagttaatcatatatctgcacacatacggatgcaaagaatcaataggataggatttaaaacacaatacagatacgcatatcgaacgatcgatcgatttcactgcatccatacatatgtatgttgatacatatatattcttcaatctcaagatatcaagtctttcaaaaatgcttatagagatacaaagtgtatgtatgagtttatagagatgggtgattgttgtattctgagttcctgcgtttgtactgtattttttaaaaaaaactataattgttacgttattcagtattgtagcttagctgccagccgaactacatatacagagttttcttgattggatagatgaagttagccagcgctgctcgttcatcatatcgatcccgggcgtccgatgaccagatctgtctccacgtcctccatcatgcgccgatcatcgtcgtcgcgtacgccgccgccggaataatcctcatgacgatgaacatcatcatccgcctgcttattcttcagctctcccacagacgtcgaccatggcgatgacagagccttacactgcatatataattacatatataattcatcgcgtgcgtgactccatctgtgtgtacatatatatcttaagcattcaatttggagttt

SEQ ID NO: 23229 - DNA, 727 bp, Oryza sativa
atacacacacgagccaaaaaaggcaaactatatgtaagcaaataagcaatcgatcgagatgagatccaacatatatatttataccttcttttgcctgatgctacataagctcttctccagctgcacttcaagctcttgtagctcctgcactgaacacgaccccaggccttcccccaacagcttactgtatgcgtttatgtatgtgcattaattctcaaactaccccaatatatagttagattgataaatatctaatataattaatcatttgtactatatatatttagtcacctcttgtagccctcaattgcttctatcttctttcccagggttgtagcctccgatctccacttctgtgaaaataacgcgcatacccaaacacaattaataagtaattccaagtgaaaactatatatattatatatgtaatatatacatttcgtgcattaacatactcagtcatgcatcttgtgctaatcgatcatgcatatatagaataagcatgatgtttcatgcatgatcttcagtcaaaaacagttcgatcccatcatatggtatccctcctaattaatactctctccgtttcgaaatgtttgacgccgttgactttttagcacatgtttaaccgttcgttttatttaaaaaatttaagtaattgttaattcttttcctatcatttgattcattattaaatataattttcatgtaggcaatataattttacata

SEQ ID NO: 23230 - DNA, 2070 bp, Oryza sativa
ttccaaaaataaaccaacctaaacaataatgtgacatatccacttcgagatttgtttattttgaggcgaaggaagtatgaggtagctagtcaatgcaaaagggaacaacataatcagcatgtactcccagcatgctcactgtatttcatggattttttacatatacttatttatgtatgtactctctctgtccctaaataactcaaaccctaactttccaataagcttttaaggagggaaacaaaagaccacaatgcccttaattaatgtggatgttgtattgaatgatgggtaggtgaggggtattgaagtaataaaatttctcgttttgcggataggtagtaggtaagaaggtagaaattgatttattttgggacaaatttaaactctagaagaagttgatttattttgggatcatctgcaaagacaagtctcttttgttactttctcggttccaaaatataagaagttcaatttataggttcaaattttgtatcgcaatttaaggatttccacactgattttataacttccatcatttaatgattacacagacagtcatatggttttaaagggattatctataagctgtttaaaaattgacagcttaagtgaatgaaagagaatcttttgacctaatattattatttgttaaacaactataaaatctttatattttggaacggaataagtactttaatttgttttttttacaaagacaatcggacttctacttctagttcacttactccctttaaactaataacagagttcatctattatttgtgttgggatgttaaaactaattaataacacggaagttaaactgtgtgtcgttttaattatggttgagggtttgcagacattgctaacaagtaaccgcacgccatatatatacggttgacacgccgatgtacgtatagttctacgtataatactcctacattaattggaacaaaatcgcacagtacattttcttaaaaaaatcgtcgtacatgcactaagtgagattggagagactttgagggtagaggatttaaagataaacaaattcaggggaggggatgtgtgctagttaattgcatgtatatatatatatatatgtgtgtgtttatattatgaaatatctaagaaaaatatttgtgatatgtttgatctatatattaggatcaatggagctaaggagtatcaatgagtggatttaaaccaaaatggaaagctaacagaagggaccattatatacataaacttcaattcatctctttaattagttattatatatgtgatggtaatttcgaccatgacttagcctttagttcattagtctgcatatacatagatatatatatgtccactcctactagtactagttaaaattaagaagtcgtaatacatctacgtacatgtacgtatagataagtacaatcgataagaagtacatatgtactgttttcctcctttttcaatatagatagaagagctcaagaaaagaaaatatatttaggcagcgagggggcggccattatcgtctacacagtacacgaagaagtacacgtatgtgtttgctatatgaacatatgtacggatcaataaaatcgaaaatactccgaatatatttcatgctcgcatgcatgcatgtatagtactggagtattaattaggagtagtaataacaaattaattaagtggagtaaataaagtaagtaagtaagtagatggatgtgaaagaaagaaaaggttaattactcggaggaggcagaagcgaactggtagaggcggccgcgaggggagaagacgatgagagcaacctcggcgtcgcagagcaccgacagctcgaacgccttcttcagcagcccactccggcgcttcgagaacgtcacctgcctgctcgtcgcgtcctcgatccgccgcatctcccgccgcccgcgccgccctgcagatctcacctccaccttcttccgactcgcctccgccgctacctgcaccactgtcgtcgtcgtctcctgatgctgcacccctcctccgccgcccatgcctgcagccgccgccgccatgagctacgagctcttg

SEQ ID NO: 23231 - DNA, 6232 bp, Oryza sativa
gatgagagcaagaaagaaagaaagaaagaaagaaagaaagaaagaaagaggagagaggttaatttgttacttagaaaggaaaggctccaaggatgactcgggaccacaattatactgccaacacctggttgccatcatcacccttcaccccatatgcccctttcccatttttcctatttttattttaccatttttggttgcgcctgtacgatctttcttgtggtacaccgtaaaccgctagtttttatcgtaaataaggcgccgcagtttatggttttctctcaagagacgctgtcacaatttttatatagtagtggatgatggctatagtcatcctaattttgtagtcattttctttttctcttagttcagtaaatcctagcttgtaaggcttagagacggaaagatggtctggaaaataccttacacatgtatagagataacactttggtgatgagttaaaatcaagtggagcggcgctacaccataccaatatacaataccaagcaaccttattttatatatgataatcttcaactaattcattgttatttattttgtttaccacaaaacaaattttaaaaggttaactgttgtgataattaattaaggcaactagacaagacatgaaggatggtaagtgtagcggtcaaggagtacatactgtacgtatgtgcaaaatgaatcgtgtcctatataaatgaaattaaatgcccataccataatatatttgctcagttcaggtacatatatgaaaggtcaaaataattaagttaaacactaggtaagttgtaaccagcctttttaaacttattagttattatagtatgaattcttaaatactaattgaactgctctattttgtttttcttattttacatacaagttgccgtgggacgagagctagcttacttgccacaccaacaccactcttaactataactattcagccgatagtatttgtcgacttgttgcaatcaaattaaacaatctaattactaagatcgagtgacatatggagcatgtatttatgatagtgcgcggagccaattaatcatgtggtggatcccatatactccctccgtttcaaaatatttgacaccgttgactttttagtatgtgtttgaccattcgtcttatttaaaaaatttaagcaattatttatttttttcatatcatttgattcattgttaaatatacttttatatacacatatagttttacatatttcacaaattttttttaataagacgaacggtcaaacatatgctaaaaagtcaatagtgtcaaacattttgaaacagatggagtagctagcaaaatattcatatatattactacctccatcccaaaatgtttgacgccgttgacttttttaaaaatgtttgaccgttcgtcttatttaaaaaatttaagtaattgttaattatttttctatcatttgatttattgttaaatatacttttatgtatacatatagttttacataaatcacaaaagtttttcaataaaacgaacggtcaaatatgtttaaaaaaatcaacggtgtcaaacatttagggaaggagggagtaattgtttggtggattttacagtggttttcaccaacaaacaagcgttggttactgtgaggaaagggttaccggacctagcagtgacacggtcaccagagtggtatcaccattgacaccaaccatgcatgcatggtaaaaccaagcggtaccattacaaacacaagccaatataatcgagctagctgtagggatcgatgtgtgacgcaacattggaaactgctcgtctacttgtctgctaattggcgtgtgcaaaccatagagactatcaatgtatataatgcacagtaaaattataattcaagatggataacaccaaaagcgacaataaccacatgaaagatttttccgtgcggatagaatagattttcgcgtgcggagcttccacccgtctggaagggtgcgtctgcgaaaatcccgattttttcgtgcgggtgacgcacccgcacgcgaaaatcgattttcgcgtgcgggcgcttagaccgcccacacgggaaaataaaaaaacaaaacaaaaaaaaattaaaatccacccgcaaaccctaacctagctgccgtcaacaccgccaccgccgacgatgctgccttgctcgaggcccgtcgtcgtcgtcgccgccaccaccatctgcggtcgccggcgacggatccggcctccccaccggccacagatctagaacttggaggcgtaggggaggagagagtcatagcagatgtccgggtaccgcgtggtcacgcagtgggcgcagaggaacgccgtcgccgacgaggacgtcgtaggctggccaccggcgtcgtcgagtcgttgtcccagcggtggcaggccgctgatccggcctccccgcggcggccggcgacggatccgcctccacgcggcggccagagacggatctgctccgccgccaccgccgcgctcgccgatgtcgcggctgccgcgcccgccaatgccgccgtcgtggccacgcccgccgatgccgccatctccgctgccctaaccgagggcgctgccgtcaccgaggaggagaggaaggatggggaggaggagagggaggatgggacgatggacaggagggaggatgggaggaataatggtagcgcgcatgatggggaggacgggaaggaggataagagggagatgggaggttgggcagcgcgtgggttacgctattttcgtgagtggatcacttaattagcaagcccgcaagcggcttatttttgtgtgcgagactgttaagtgaaccgcacacaaaaattgattttcctgtgcaagcgacggcccagagcccgttcctcattttcctgtgcggttgcacttatggtccgtttggaaacaaaatggtttggtgtctaggaaaatcttgcatgtactggtgcttgaagaaacagaatgatcatgatgtgtagaattaacatatcatgtgtgacgtctcaaaagaagtactccatatacggtaatgcatgttagatgcagagatgtgcatcaatgatatatgtagacagccctgcatagaaaatgcgtttgtgctacactatagttgtacttatactagtttgggggcaccgatcatcgtgcaagtgagctgcttaatttgagtgagaaatgaagggagcacgacgcttgtgtttctaccactggctccacgtgtcgacacactacttgcttgcgcttgcccgttcgtacgaggaccaggtggcctcgtacggacacatccactcatgcgccgacacgtggaagacctgggcccaccgccatcaaaagccgcggtggggacctccacgtggaccatcttgcagaccgagcctcgtactccctccgtaaaaaaaaaagacaaaccctggatttccgtgtccaattttgactgtctgtcttatatgaattttttttataattcgtattttcattgttgttagatgataaaacatgattaatattttatgcgtgacttgtctttttaatttttttcataattttttcaaataagacggacgatcaaatgttggacacggaaaccagggtttgtctttttttgagacggagggcgagccaaccaaaatctgatttttctttccccctcctttttcattatttttcaaagaaaaaagatcacacatctgcctgattgtcagattccacacctatcctacttcaaactagcaataatatccatccttgttctgctttcctgcttgcaagttgatcctgtttcagtttcctagctccataaaaatatagtgcaaaccaactctcatggttagctttatcgttgaattaatcaagtaaggtctaaaccgagactaatggttttgatgagcgcgccgtggcgtctaaaagaagaaatgacgtgttgagtatattaaccattcatgcttccttgtccctttagagaaacaaacaaggggcaagaaaactagggagatgggaaagggaggtgtggcccttatcataaaaaaatcatattggaaactcacccaccctaactaacctaaggtaacacaagtaggtctctttaaaagccgatcacgaggttagaaactatttctttaaaaagtagggaggatccacttggtccaattggatcccttaacaaaactatgctaccagacaataaacttttggagataaaatactagatatatgcacccaataacattacttcaagctttcaaagtgcaggtttcctagatcccacaaaacctatttgatgattatacagtgtttatctcatactaacagtatcctataatatacttcctccgtttcatattataagactttctaacattgcccacattcatatatatgttaatgaatctagacatatatgtgtgtctagattcattagtatctatatgaatgtgggcaatgctagaaagtcttataacctgaaacagaggtagtaagagattttgactaacaaatgcatcgccaaatttcttatattgtgggacaaaaatagaatgtagctagcatggatacatattagatgttacacctagaggacacgcatagagagcacacagatttgtggaggagttttgtaggatccaaattatataggactttttcctttttggtcatttgaaactaatggattagagctttccaaatgctataaaattcctaagaaagggctaaatgcatgtaaagtttggagaaaagttagaaagaactcaaaccccttggaaagctttcttcgagcatatctctctcttctggtttcctgtgtttctcatacggtttattgaaatgaccattcatgtatttttccatgttttgcaattacaattctatcaagattttgtgtttttcttattcgttttgttttctcaatccagtgtataaaacgagctctaaatgttgttataaccatataaagtaagtaccaacagactgcactaattcgataagataaaatgattgatttgtgtggaaataccttgtccttatgtatatttatttcctagacacttgtaggctagcaatcaatattttttatttttctccttatcacttatatgtgggcctcaagtctattttttaaaacttttttttatactgggttgtcatatggacatcatgtaattaagccaaaaccaccctaaaacagccatggatttgttttgtatatagttttttaatacttgggaaagcgagctacggggtatctagttttgcggaattgctcaatcccgggcgaccggcgcagggggagccggatcgggcgctcccccacgttcgctctccccccacgtgaccctgttgggccccacccacttctccctcccctttctccacaaaaagatgtttcacctagtgtcctcacaatgtttcactatgtatagatttaatgttgcagtgaacgaaacattccattgcaacaaaaacccaaatattttggaaactctctattaagggaatttggcttattttttgttccaccaaaaatgtttcacctaatgtactcacaatgtttcgctatgtataaatctaatgttacagtgaattgaaatattccattgcaacaaaaaacccacatattttgttattttctgttccaccgaaaaatgtttcacctagtgtactcacattgtttcactatgtatagatctaatgttgcagttaactgaaacattctttcgctatttgctgaaacattgtttttatataaggtgaaacaacacccgatttaaacgagtgaaacattttcgatctactttgtgaaacaatttcgatatacctggtggaacatcgtgcaacatttaaaaataattcaataataagcttattttttttcgtcaggatatatccatgcgtggtcttgttttaaagatttaattgcaatgaatttaatggtgcaatcggatcatgatttggataagtaatttaagagaaaaatcagtttaaagtagttttacacgtaaatcgggcgctgacgtcaattttaacccgtttgcatcgggcgcccgagccgagggaattttttttatttatacttttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaa

SEQ ID NO: 23232 - DNA, 2704 bp, Oryza sativa
  unsure (1)..(2704): unsure at all n locations
tgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaagtataaataaaaaaaattcgagccgaggcgtcaccctagttttgcggtggaggggtacgaattagactgggtcaatagttgagggagttgcaatgacttcattctaacgggcctgcacgtatgctacagttgtgcgtaaggaagctacagtccagttctggcccagcccagcccatgtagaagaatagaaggtgacatctttccttcctccctcgcgggcggaggcgctcacacgcaaaaaccctaaaaccccagtctacccttccttccccgccgccggcagccgggacatcaccatggcggacgccgtgcagtaccgcctcgagcggatgtccgacgagctcgacgacctcgagcgccggggcctcttcacccgcgccgagctcgccgaggtcgtccgccgccgccgcgacttcgagttccgcctccgacgccgctccccgctccgctccgacttcctcgactacatcgcctacgagctccgcctcgacgccctccgcgacctccgcaagcgcgccatcatacgcgccacccccgacaccaccgaccacgatgctgacgccaccgacaacgacagcagcaagaagaagaagaagaagaggaacaagggcaaggccaagaagtggaagaagtccgtctccgacatcgccggagtcctccgcgtcctcgacatctacaggatggccaccgtcaggtacaagggggacctcgacctctggttccgttacctcgagttctgtcgcgacaagcgccatggtcggatgaagcaggcaagtctccccagaaccttcccaccttcctgtctcatcctgcccattacttctttctccatactatgtatgatactgcggcattgccttgttcaatcaattttgttagcttttctacatgcggctcttgattgatgtagcaatggtttagtactgattactatatgtcgccctttcatttcttggccacaccgtagtgagtgagggacacgggcaaccaactttattcacttatttatgaatgcataggttcatttcatctctttgtctctgtttgatcaataagaattttattacggttgaagccttcttgtgctctgaatttaagtttggcattgagtgaagtcgcatgactcacattgtgattatcgggcagcaagttaggccatacgtcttgctgatagaaatttatagattacttgacaatttcacatgaacttctggttgtgcatcagaaataatacgctataaatagttgaatgctgaagataataaagtcatgaccccacttattgttgaaatttattttttttcctgggctttttacaccgaataaccattgtctggttcatggtagattaccgcgcaatcctgaatatgacataggctgcactggtgtcactggctatgcgtcgcgaaaacggtatgagattacactacagtgctgccactaaacagaccccgcatccagctatcactggagctgttgtgttgtgcactgtttgttaaggcggcggtggggacatggtaagccatagaaaaaagaaatcgttcaatgctcaccagtccagatccggtaaacgttaaataccagtcattaacctattgaagggtaagacagaaaagctgtagtgtaagcgattggttttatgtttcatatggaattagttgtttaagttttcacaacattcgagctaagaaagaataaggacttccccagtccagtgtgtacttgtttgagatctgattgtgttccgaaggctactcagtatgcatagaaatatagtcataactggcaaaaggttggagcttttgaagtttttgaaattgtgttttttttccttttgcaaatatataatgtggccagagcttgaaagctatttagagatgaaacttttcttttcttttttttggttcttggatgtagatttcattttaaatcttagtatgagttgatgcctgtttgtccttcttttgttgtgtatttatgtgccccatttcatgccttttttgtttgaacttctcctccgatgatatgtaaacatgcgtatatatatttttggaaggctaacattgaattgatctcactatttactaaatttacatatctcatgttcattgtattatttttcaggctctggcacaagctattcgttaccaccccaaggttcctgggctctggatctatgcagcagcatgggaatttgatcagaacttaaatgttgctgcagcacgtgctcttatgcagactggtcttagatcttgtccagaatcagaggatatgtggattgagtatcttcgcatggagcttacctatcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23233 - DNA, 731 bp, Oryza sativa
tatatatatatatatattgcattttacgttaacgttcgtcctcgttcgttcgctcgttcacgttccctagctcgttcacgttcgttcgatcgttctcgttctcgttcacgttgtcgtggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcagcggtggcattgcgcgcgcggcggcgaaggcggcggcggcgtggcgacggcggcggcggcgtggcgttggcatgcggcggcggcattgcgcggcgtcgaaggcggcggcgtcaaaggcgacggagagagatcgagatcggagagatcgagatgcatgaagggagatgcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggtt

SEQ ID NO: 23234 - DNA, 3696 bp, Oryza sativa
  unsure (1)..(3696): unsure at all n locations
cccgggagtaaatatcttttcccgctatttcgaaattctttttaaacccggttagggttaagaaccgggactaaagattatagcactgcatatgattttcgcttacatatgtgtttataaaatagaagttaatgcattatacaaagattgatgacaattacttcgaaaaattatttttgtctgtaataaattaagtggataaatcgtaataagcaaatatatgacttataattaataaaaattccaatatatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgagagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagnttgttggttgatcgactcgttacccatgagatgttgtcgtagccacgcggggaaaggtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcactggggcgtgagttccacgggtacgcccgattggagncgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgtttttccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctatttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgtgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccc

SEQ ID NO: 23235 - DNA, 901 bp, Oryza sativa
atacatgactattttagtcttagcatgtaatattacttgagttttaatataagattactttatttgtaattagacttagtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttatacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctatcagtacggtgtactggcgaagaacaagggcacgcggagatcatgagagttttgtcccagattcggagaaagagatgct

SEQ ID NO: 23236 - DNA, 33335 bp, Oryza sativa
aagtggggtggtgtgcccaaaaagtttggattggaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcagagctcaaggatttgtctcagcaagggatggcaattgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggacaggagtagggtattacttcttttataagaaggcctgaacctgtataaatcttttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatagacgacctcgtcttctcacccgggcagacgtttcggttcggtagcctcgacttcatcaccaacaacttcggcaagatttctctcctcgactcggaatcagaccagtcgggagagaaccggctttcggtcccgtttggattcccgaacgcggctgaaagctacttcaagaccatctcaaccgagtcggcttcagaccactcggccgagatcgcatcttctccaacgataccagatcaagatgatggggcttacccaccggtcctgatgaagctccccgacgatttagcggccgtcttcaccacgacagcgtcttcatcccgtaggcctaggcggaagtcggcttcaacaccgatttcgcctagcttcagggaagtcggcgtcatcctccaaccactcggcacggtttcgacagatcagctggatgactacaacagctctcccaccgtcgactcacgtcctactgacatcgtggagtacgacgaatttagttctcgatacaacgacttcaacgacttcgacgacttcgacggaagcctagatgacaactacacccctctctactttggcgttttcatggccaataatgagacggaggagcaacgccaagcccgggagaccgaggaacgacgccgactggaggaggagcatcaagcacaagaacaagaacggctacggcgcgagcagcaggaccgtgagcggactgcgaaggaggctgaagatcgacgtcagcgagctttggaagcagggcgccgagcgcgtgatctcatcggccagcaagatgtcgaagggacaccggttttccgcacccctcaacagaatgcggttgccgcgatcacccttctcgacaccctcctcaaccaaaacgagctcaatcaatccgaccacgtcgtcaacatcttgaatcagacgaagaccatgattgcggcgacggtcccagttaactccgaaagcgtccacacgccgactggcagccgggtcccccacttccgatctcatgactaccgtcatccaagcctcagcatcactggagcaggatccaatcgcaggagcaggggccacgacgagcggtctgttcactcgcctcccgaacttcatagggagcgccgagtggaacggcctcgctcaccacctcgtcgccgccccatcgatcttcgcgacacaatcatacagcgccgagcagctcgaggctaccatcactcgccggatcgccgcgacgacgaccttgacggagttgcagccttcaccgacgacctgcgtcgagtggattggccagccggcttcaaaccgactggaatagagaagtacgacggtaccactaatccagaatcgtggcttaccgtctacggtctcgcaatccgcgcagcaggaggagataacaaggccatggcgaactatttaccggtggctttagcagattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccggagaatcccttcgggattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtacgccaaagccgaagatgccgtcaccgcatcgaagcagtcgggtcccagttggaggccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagactgcacggaagaactctgacgaagaacaaagcacgtcgaggaagaaggacgacggcgacaccccggcaggttttcaagatcaccgtaaggagctcaaccatatcttcggcggccccctggcttatgagtctaaacggaagcagaagttgactgaacgggagatcaatgctgttcagcccgacacaccccagtatcttcgatggtcagagattgcaatcaagtttgaccgctcggatcatcctgaccgagtggtccacccggggcggtaccccctggtactagacccagtggtccgtaatgtcaagcttcgcagaaccctcattgatggtggcagtgcactcaatatcctcttcgccaagactttggatgatatgcagatccctcgctccgagttaaaaccaagcaatgcgccttttcatggagtaattccaggattatccgcaactccactcggccagatcactctcccggtcacttttggcactcgggaaaacttccgcacagagaatatcagctttgaagttgccgatttcgagacagcataccatgccatactcggacgcccggcgttagccaagttcatggccgtcccgcactacacatacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaaccgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggaattgaccaagctgttagcagcaggcttcatcaaagaagtccttcatcccgactggctggctaacccagtcctggttcggaaaaagacagggcaatggcgcatgtgtgtcgattacactgaccttaacaaatcttgcccaaaagatcctttcgggttgcctcgcattgaccaggtagttgactcaaccgccggctgcgagcttctcagttttctggattgctactcggggtatcatcagatccgactgaaggaatccgactgcttgaagacttcattcatcacgccctttggggcatactgctacgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcacgacttggcgagcgggggatgcccttctttaagctgctgaagaaaacagatagcttccggtggggacccgaagcacagaaggccttcgaagatttcaaaaaactcctcaccgagccgccagtcttagcctcaccacacccgcaggagccgttgttactgtacgtatcagccacctcccaggttgtgagcacagtcttggtcgttgagcgcgaggaagaaggccatgtccagaaagtccagcgaccgatttactttgtcagcgaggtcctagccgactccaaaacgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtactttggatacatttttcggcgtctcacaacgtcgccgagtatgaggcgctccttcatgggctacggattgcgatttccctagggataaagcgtctaattgttcgaggtgattcacagctggttgttaaccaagttatgaaagagtggtcctgcattgacgacaacatgatggcatatcgacaagaggtacgcaaactagaggataagttcgatggacttgagctcagccatgttcttcgacacaacaatgaagctgccgatagacttgcgaactttggatccaagcgcgaggcagcgccatctgatgttttcgtcgaacacctttattcgccgacagtacctcacaaagatgctactcaagttgcggacactcatgacatagctatggttgaagccgactggcgagagcccctcatacgatttttgacttctcaagaactccctcaagacaaagatgaggccgagcggatttcaaggcggagcaaactttatgttatgcatgaatccgagctatacaagagaagcccttcaggaattctgcaacgctgcgtatctttagaggaagggagacaattgctgaaagacatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagttgcacacccaatgagcaatggacaggtggagcgagctaatggcatgatacttcaagggattaaagcgcgtgtctttgaccggctaaaaccctatgccggcaaatgggtgcaacaactgccatcggtactttggtccttacgaactactcccagtcgggccacaggccagtcaccttttttccttgtctacggggcagaggcaatgttgccgagtgaagtcgaatttgagtctttgcgctttcgtaatttccgtgaagaacgctacgaagaagatcgagtggatgacttgcaccgattggaagaggtccgcgaagcagctttaattcagtcagctcggtacttacaagggttgcgacgttatcataatcgcaatgttcgatctcgtgcctttctagtcggcgacctggttttacggaaaattcaaaccacgcgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattatattttcctattttgactgtcaaacatcaagttttctccttgaagttgtcagtcgggggctatcatcataataatggagtgtgattttttatcaattcagtttgcttacctggtttatcattgccttgtttggtttttctacttagtttgcgaggactgaaagtttttaatagcttctttgggttttaggctcaacaaagcttagcaaaaacttttaagaaatcaaaaaacttcgcaagaatcatcaagcacagcataaatacaccagtattgtacaaattgagcctccatgtattacattcaaactcagtcagaatcagtcctttcatcatcagagtcttcattactcggttggaggtcgttgttgcgaaattgctctacaacatcactcgcaattttgtcagctgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggatgagtccctttgcgcagccagttctgtcttgtctctctccagggcttcaatttgcttcgccatctgttccatcctggcggcttgcgctgtttgaaatccagatggttgaggatgcaattatgacagcataaatcaatggaacagatctggatgattaccttttgatgaaccacttagttcgaagtttgcgtcctggagctgggcgattcggtcccttaactctttctctgtttttttggcgcactccttggcctcatgcagctggtccctaactgcttctagagttcccaaatgaggaaccagcttttccaaagttgtagtcttggcctcattgcgaagatggattctctgcatgatggatcagggttcagttctgctaaaaagaaaacaaagttaccgaaggacgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagacggatacactgaggttatttaaatcgccattgtttgagaagacaactaacctgaagatgtacctagctgagcgtgaggtgatctttgttctttacctgaagacccagctatcgagtcgttaccagcttctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcgatcggctggttttcagcagtcggctcggggtccttggatatattttgctctgtcatggcaggatcggggtcttttccagatggatctatatcagatggtttcctgcagagtgttctttcagtatttagcattatcttcatcggaaaacatgccgaagcggaaatcataccgagagatctaatacctggaagatgttctgatctttggcattgcacggccagccagttttttcctgggcatggtgcgctttgggggtttattaggcgagcccttatccccagatttatcatcgtcgccttcatcatcatcaagtaccagctttctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcatgaagataaaattatgttctgatcacggtttgagggtttccgatgcatacctgtggaggcggattgaatgcattatatggcacaactggcagttgatgagagtagctgaccacaattgcatttgagaagattttatacatcctctccttcatgattttgaaatccagggaatccggttcttcacggttgggatcatgtttgccgtcgaactcgaatgctgtgcgggatctttccttgattggcgccagtcggcatttgatgaagtgccgagtgatctgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagtttgcatgccatcctttgttcgaagtcttgaagggcatcgagaaatatttttggctcagagttccccttagttggaatcctgcccccccgactacacacggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgctccaccatctccttaagattctcctccgttacgtcggatgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgcaagcttttttaggctacaaaagctgtttgggttaactaggaatgacttgtttttattatagttatttccttggcgtgttatatgcctgttttcatggtaaatagtcatggcctaggctatttgacttatttattaccataatctttataatacttgatgggtaatctttagagtttttatattcggatgcctgtcgagtgtgttcattcgtgaaccttttagagtgtaaaccactcggatttcttttattgtggttaaaaagcagtcggctagcatgcttatttaggcaccgcgtacgcttttgtcatataatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaagagtttgaagtactcggattatcatctttgagagggctacgatggtcgactgcaaaggactcgggggctactgtggagattatgggtatcccatatctacacggcgatggtattcgaactgggtacaggatacctaatgtagatagaatatcttatctgtatttcgggtttgtttcttaacttgtgtatcaaggaaacaccctgagacttagtcggttacgactgtatcttacttatattttcgtattccgttagggatatagattatcttttgtaacccggactccttccccatatataaggggggtccgggcgcctctaggggcatatgctgatttttcccgaatcatacaatcaataatacactcggcggattcatccccggataggagtagggtattacttcttttataagaaggcctgaacctgtataaatcttttgtctccaaacccatacactttcctagcttgatagccacccccttttattattgccgaaatctagtttcgacagcaatttcccccgtggggccgggtcccctacgggggcgggggcgggttcagtttttgacccgcgggggatgtggggccgggggcccgcatttttgtggggaggggacaggtgaggcatttcacccgtggggtgccgaagggtgtatattaaatctcaaaatgtaacccatagaagatctaaaagagccacaaaattttaagtaatagccttatcctctccactctccccatctcccctcccctcactctcactccatattaacttggagcgtcacaggctagttccggtcgggactagttcggggcgtgacattttttttatctattcgattgatttttctggtaggttgatttttcacatggaaacttttttttgggtgggtaattttttaaggcaacatggatttttcacgtgatggaagaagtgtgatggtgggagaagaggagaacgacgaccgcttttacagttgaaaagaaaagatgggaactgttttaatcacccggatggatgtccatccatttattacatgtcatttaaatggttatgaaaaaaatttaaaaacaattaacaagatagatcaatacgtaatatatcacttcacaaatattaaagttaaaattcaacttctacaaattgtaagaaaaataacaaacaaaactcaaattactatacgtatatttatagttaaatttgttatttttcttacaattggtagaagttgaaatttaaacttgcaagtttgtggaatgatatattacatattaatctatattattattatttttgaattttttaataaccatttagttgacatgcaataaacaggtggcgtctacagaatccatctcaaaaaagaggaatttatgttgttccatcaatattgggccacatttaggacaactctcttgaaaccggtgaagcaagcacagttaggctcttaattccgtggcccttgcctacgtttgtcgagcaaacggccggtttggcccattagcatgcccaggagacgaggaaaaaagagaacttatctgctaggctaacattatcaatttttggatatatatatatatatatatatattaaaatgcaacatacatgttatacatattgtgaaccaatctactcctaattatcttttctccctatagtaagcattcatttagttaaggttagatacattttgcagcacgaatcttgaaacacatcaacggtgtagattgtaggtacatatgaatccgagtgcaaatctgcattttcatatatatatatatatatatatatatatatatatatatatatatatatatatggaagggcaattgtattctttcccctattttaatttgtagatatgagttttgtaaaatatgttctttttgcttttttaaaccgaaactttgctcctagtctattggctatgtatatgagttcctaattcatctctctcgttttctgctctttcggcgcgcacgcttttcaaaccattaaatggtgtgtgttttgtaaaaagtttttataggaaagttgcttaaaaaaatcatattaatttatttttcaagttttttataacttaaacttaattaatcatgcgttaatctatcgctccgttttccgttttgagttaatcagcctagtcgtttcaatggcgttgcaatttccctctacttttgtataaaacagctgtgctgttgttcatttgtggcatatgtgtacttctgaatgcagcggtactaacatatgccatgacacaagggatcctctccaaactaaacaaatcaacttaaagctcatatgcacttcaatacccaatatttcatgagcatagaccttgtatacgtcaagaagggaaaaagaaccgaaaacataaccaaaaaatcatataatccccaaatcaacgcatgtaacacaatataaaaaaccattttagacaacacccactattacaggcggacttaaaaaaatatacttgtaaaaatatattaagtgtttttttacagctagctcgcatgcaaaaaaaatcaaatttttatataggtggccctcaggtcttaggttttcgtccgcaaaaatcatatctgtgtaggcaaactgttaggagcaccgcctgaaaaattgacaaccgaccacttgctaccgcactaaaaagctactatggctgtgttcgggaggtgaggttgagaattcaccttccgcgcacgcaaaatggagcgatgtattttcttacgattaattaggtatttactattttttttgaaaaatagattaatatgattctttaaagcaactttcgtatagaaactttttgcaaaatacatattgtttagcggtttgaaaagcgtacacgcggaacacgatggaggtgagttgggaaaaatgggggaagaacacaacctaagtcttaaactctcctccacggctcctctatcgagaaccactcattctctccctctcctatcttctctgtctcactagatccacacacgagctctccttatccttcacttgccaccgtttctcctcgtgtagaagcaaccacacggcttgccttggcttggcaacggcgacttcgaacacatggcattggatgagcagtgaaggggaaggggtgggtcggcattatcgaacgagggccagagcttgggaccagcgacaacaatggcgactgcggcaaggacagggtggtggtggcaaataatgggctgagctcaggatctgtggtgaacgaacatctatgtgggttgtttacaacaacgttgtggccctagatctgttggagtgaaggctagatccaccatcggggaggtcagatctggatggtggctattacctctctcgatgccgccgccagtgggcagatccaagccatcatgcttcatgtctgctgcggcgggtggcggtagatcggggtactgggatggtggttcactactagagaaatgcacttcggtgccggttgggaagaccccttagatgccggttttcccaaccagcaccatgaaggcggcactgattaccggcaccaatgtcattttaaaaaccgacaccaatatggaatcaacgagcaaaaaaaaaaaaaagccagccggctctagccgattaactcccacatgaacccacatgaataacaaacaaatgatgaacagattccacatcaacagatgaacaagagcgacacaaaatctcacaccaattatcatagcaacaaatgaactcttgcatgaacaagaacgtatctcaaacaaatcacaaagtgggagggagggggagagatggatccgctggccgccgatgccgtcgcacctccagatccgacgcgggccacctctgtcccgccaccgcacgccacctcccgctgccaaggggcgcggactgcctccgtcccgttgccgcacgccgccgcacttcgcctaccaccgccgagtggcgcggaccacctccgtcccgccgccgcatgccgcctccggttgccgaggggcacgggctgcctccttcccgccgccgcacaccgccgatcttgctgccgaggggcatgcaagacgacagtgagaaggctagatccagctgctgggaccccgtgaactccggtggtggtggaacctccctggcttcttagggatagcgacaacaacttcaacgtcgaccacatgattttcgcatgccttataattgtaagcggggcggctgggcgcccatgaaaaatcatttttttctgcctgcgaatacccatcttgtactggtgctagattagcaaacctgttttttcctttttttttttggggggggggggggttgaactatggtggcttaggtagcctacatgccaatcaaagttttaaatttagtttaactccaagggagaatgtattctatcgaatttagaaaaaaatgtcaaaattcatgatttatttaattgtttgtggaattatgtttgaaattttgtaatttaagttaccccgaaatgtttatgcattatgagatagttaaccctatactccctccggttctatattaattgacgttttgaataaggttgaggccaaacttttataactttgaccatcaataactttaaaaatatttaatttaaagaaaattgaataacatatataaatttttctttcaaagcactataataaaagtaaacatgcatttatttattgtatatattataatagaaaaataagatcaaagatatatcttgtagaccgtatcattgtccaaaacgtcaactaaaatgaaactgagggagtatagggtatcacattctaaccttggggttaacaagacacagttgcttttgtatcctggattgacgacgtacatcccttttgctttatcttttgctttttgcactttaatcaaggaggcgaagcaaagaatccgacgattagccaactactaactccaaattatctatagccaatttaatagtcgatttatacaacaattatttacaatactattaatatgtgatcccacctgtcatagaagcatatattatgtcttgaagtccgtgctacagcttctacagatctgtagcccactgcttctctctacttttttatctctttaaaatatatatgtttatagctggcttacagtctgctattgtacctcctctcagatctgagatgcattcatcctctcagatgatgcattcaggtacagcttaggacgtacatatagcatatcgatttgcggctttgcagcaaatgcaaagcaaagaaaaatactaaagcaaacatatcgatcgtacgcaaggaataatagatcgacgaaggcttctagacgacagtacgtttttacaaggcttctgctagctctagcccagaacatcgatctatcgatcatattgcatccagtttgatcgtttcaatttatgctcgccctcgcaccaacaatggcttagctaatccccatgtactcgatctctgtcggcaaacatcgtgattaaggtaaactagctacatcatatcgtgcagtttaattgcgctctctctctctccccctatgtgtgtgtgttgatgcatcaggagtgggctggagaaatcgatccatcaggcatctatatatcatgggttaattaattacagggcttgcttcaacatatatatgtattctctgctgtcgatccatttctaattaaggagcgtttaatcaactgaaagaagatcgattgagattatatgatcgatgaagctgcccgcaattcaacactaattgaagagagccgggctacgcagatcaactcaacatgccaccagcgaaggaggtaattaaatcagatcggtgatattgtttttatttttgaatgaaagttatttcacgaccacgcacgtgaattaaacaagacactttactgctattttagatttccaatttggacgcaattttttgaaacacgctttcattgtcatatttggctttagaagtgtttttttttctaacatctcatttgcaaacaatcctctcggagcaaacttcttctatttgtggaagaaataaattgcaaaaaggataattttaccaaccttagaacataacatgaggtaccatattttatactataaattttggcacatcaagtattatgtatctcaatgtataaaagaaataattttagtgtaaacttttgataataacaagtaattggtcaagaaccgtaaaatttctcacactccacctgttcaaaattcaatgctatgtttggctagttgcagagagaaaaaatattgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacagtagcccccgagacctttgcagtcaaccatcgtagccttctcaaagatagcaatccgagtgcttcagattattcatgccaaggcccaccgagtagcgaagacgaagactgtaaagggcgaaaagataaagaatatggtgcatcgaatagatgcacctaattaggtgtagcccccaactatgtgattagttaacaaactaaacatatagttgagaacaaaataatagcactaccacgcatcagatggcaaaagcatacgcggcgcctaaagagacattctagccgactgctttttagccataacaaaaagagtccgagtggtttacactctaaaaggttcacgaatgaacacactggacaggcatccgagtataaaactctaaagatcacccaccaagtattataaaaaattatggtaatgaataagtctaatagcctaggctatgactatttaccataatgaaaataggtatataacataccaaggaagtgactatgataaaaacaagtcattccagattaacccagacagcttttgtagcctaataaagctaacaaaaaagcggtataacacctttctgtcgggcaccttttaatttgcattgcaataattccaaagaattatatgaccgcataaaaaggattttatcagcatcgggcaacactattgtgagcataatattgccaaagcaaaatatgcctaagtccctaaggaacacaatgggccacgctgttaaaagtattgggctgaagtactgttcaggcctaggcccatttgcacctccgatacccttaacaagaaatccgagatccaagcgacgcttcgtcttccccgccggaactctcgccattttccccactccttgctacagtgcagaactgcgccggcgaactagggttcaccaatccacccaaatccaccttcaaaaagtgatcaaattccttcccgtgatccaccgcctcaattcctcacctctcccaagccatccctcgaatcaaatcagcgcatttgaggaaactcgatggcggaagagagagaaagcttcgaaagccaatgggcgccgtctgacgtaacggaagagaacctgaaggagatggtggcgcacggcgttctccctgctaaggagatcatcgggtggcggccagcgtacggtgagatttttccgacccccgatacacacgagattgtggtcttctcgcatttcttctacggcggcttcgctcttccgacctcgaaatttttccgcgggatcttgaacttctatggaatcagcttgcatcacctaaacccaaattccatagtgcacatcgccaatttcgtccatgtttgtgaagcctttttgggaatcaagcctcactttgccctgtttcgccggatcttcttcctcaaaccccaaccaaacaagagtaagccatgtgtagtcgggggggcaggattccagctgaggggaactctgagccaaaagtatttctctatgcccttcaagacttcaaacaaaggatggcatgcgaactggttttatgttcagaatcctaagcctgctcttcccgaatactcttgtcttcccccggtgtaccaagatacttggaactctcttccaatcggagatgaagctgcccaagccttggaattgttggatcgcatgttaaaactcaaagaacaaggcttgcaaggagagcagatcactcggcatttcattaaatgccgactggcgccaattaaagaaagatcccgtacagcttttgagtttgacggcaagcacgatcctaatcgcgaagaaccagactctctggatttcaaaatcatgaaggagagaatgtataaaatcttctcaaatgccattgtcgttagctactcacaccagctgccagttgtgccatataatgcattcaatccgcctccgcaggtatgtatctgaaatcatcaacttacgaccaaaatagtatcttgtcttcatgttgagttaactaaccatggaggcatctcattcaggattacgtattgatgaaatctgatcccccaattgctcagcgccgatctcctcgccagcacaccattcagggaagtggagggccgacaatcaggtcagacccacaacctcaaacctccaaaccggctggtcagacaggtcctcgcaagagaaaactggtgcttaatgacgatgagggcgatgacagcaacaaatctggggacaagggcacgcccaacaaactcccaaagcataccatgcccaggaaaaaactggctggccgtcaaatgccaaagattagaacatcttccaggtataaacttctcggtaccatcttgtttcggcatgcttcccttatagaaattatgctgagtatcgaaaggacgctttgcaggaaaccgtccgacatagatccaactggaaaagatcctgatccggctgtgacagagccaaatttatccaaagacactgagccgtctgccgaaaaccagccgactgccgaaagccagccggctggcgcccatgcttcggatgacaaagccgatccgagtgaccagccgccaactggagaccagtcggcaacagctgaaactgcaacaacacaagagcccccgactggaaaccagtcggatgtaggttccgatgaagaaatcccggaagttgaagcgcaaacgacaacttcccaagaaccagaggctggtaaggactcaatgattgggtctctaaataaagaacaaggaccacctcatgttcagccaggaacatcctcaggtaacacatcttctcaagtgatgccgatttaaataacttaagcttactcgtctaattgtcttggaaatacatcaggaacaataggcgatgacgaagaaataattcctcgcataaaggcggttgatgactcccgtcctcctatcttgctcaaatggtgggacgagaactcgcaagttgccggcatcgttataaatcgtcaaaaagaagatgaggaagtgtgccagctgaagaaagcacttggagaagccactcgcattgtgaatgtaaatcttccgggtgactgcctttaataactttgttctctctttagtagaactgaaccatgatccatcatgcagagaatccatcttcgcaatgaggctaagactacaactttggaaaagctggttcctcatttgggaactctagaagcagttagggaccagctgcatgaggccaaggagtgcgccaaaaagacagagaaggagttaagggaccgaattgcccagctccaggattcaaacttcgagctaagtggttcatcaaaaggtaatcatccagatctgttccattgatttatgctgtcataattgcatcctcaaacacttggatttcaaacagcgcaagccaccagaatggctcagatggagaaacagattgaagccttgaaaaaagacaaagcagagttggctgcagaaagggactcagccttgaaagaagttgaaggtactgccggctgatgatctgaactttcctctttttaatgcagtagattcttattataaatgtgttgtgtagaccgtaaaatcaagtctcaagctcaattggatgtcctggttggtaagatcaagaggcttgaaggagcaagagatgaagtcgccaatgtcgctgcaccactcatccaagctatgttcctcaataacagtggtccgagtgcactcgacgcaaccgaaatattcgacaagctgagtgttgctccggatgtatatttcaagaatatcaagaaagctggaagtatgggagctagcatggccttggcgatgacaaaatccttgtacccgagaattgaagttgacaccattgatggctttgcaaacgggacaagtgaagaagctgctcttgatcttatcagcagtgcacaaaatgcggctgacaaaattgcaagtgatgtcgtagagcaattccgcaacaacgacctccaaccgagtaacaatgactctgatgatgaaatgactgattctgactgatcatgaatgtaatgcatggaggctcaatttgtacaatactggtgtatttatgctgtgcttgatgattcttgccaagtttttgatttcttaaaagtttttgttaagctttgttgagcctaaaacccaaagaagctattaaaaaactttcagtcctcgcaaactgagtagaaaaaccaaacaaggcaatgataaaccaagtaagcaaactgaattgataaaaaatcacactccattattatgatgatagcccccgactgacagcggcaagaagaaaacttgatgttgacagtcaagatagggaaatacaatgataagcttaagcatagaaacgatgaagatgttcgatgttccaagagttgtcgacaagagtaccgtcttcgcgcttgagtcgataagaacctggccgggtgacttcagagataataaatggcccttcccatagaggagataacttgtgccgatctcgtgtagtttgaattttcctcaaaaccagatcaccgactaaaaaggcacgagatcgaacattgcgattatgatagcgccgcaacccttgtaaatatcgagccgaccgaatcaaagctgcttcgcggacttcttccaatcggtgcaagtcatccactcggtcctcttcgtagcgatcttcacggaaatttcgaaagcgcaaagactcgaattcaacttcacttggcaacattgcttctgccccatagacaaggaaaaaaggtgactggcctgtggcccgactgggtgtagttcgcaaagaccaaagtaccgatggcagctgttgtacccatttgccggcatagggttttagccggtcaaagacacgcgctttaatcccttgaagtatcatgccattagctcgctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttagcttcaatccacttggagaatttgtcaatggccacaaagagatgcgtgtaaccgccgactgcctttttaaacgggccaaccatgtcaagcccccaaaccgcaaacggccaagacagcgggatagtctgcaactcttgagctggtagatgaatttgtctggcgaaaaattggcaaccttcgcacgtgcgcacaatcttgtcggcgtcggacactgcagtaggccagaaaaaaccctgccggtaagctttgccgacaatggtgcgtgcagcggcatggtttccgcaaatcccagaatgtatatctttcagcaattgtctcccttcctctaaagatacgcagcgttgcagaattcctgaagggcttttcttgtatagctcagattcatgcataacataaagtttgctccgccttgaaatccgctcggcttcatctttatcttgagggagttcttgagaaattaaaaatcgtatgaagggctctcgccagtcggcttcaaccatagccacgtcatgagtgtccgcatcttgaatagtatctttatgaggtacggtcggtgtgtaaaggtgttcgacgaaaacatctgagggcgccgtctcgcgctaggatccaaaattggcaagtctgtcggcggcttcattgttgtgtcgaagaacgtgactgagctcgagtccatcgaacttgtcttccaatttgcgcacctcttgtcgatatgccatcatattgtcgtcaaggcaggaccactctttcataacttggttgacaaccagctgtgaatcacctcgaactattagacgctttatccctagggaaattgcaatccgtagtccatgaaggagggcctcatactcggcgacattgtgggacgccgaaaaatgtatccaaagtacatagcttaatctttctccagttggggaaatcaaaaccactcctgctccggtgcccgaaagtcgtttggatccgtcaaaatgcatggtccaatgctccatgttctccgcgggggtatcctcctggcactcggtccattcggcgacaaaatcagctaacgcttgggacttgattgaaattcggggcttgaatgatatgtccaaagacatcaactccaaagcccacttagcaatacgtccgttcgcttcgcggttgtgcagtatatcaccgagtggaaatgatgtgaccaccgttaccgagtgaccttgaaagtagtgagatagcttcctggtagtaattagaataccatataacagcttttgaacctgagggtacctcgttttggagtcggctaggacctcgctgacaaagtaaatcggtcgctggactttctggacatggccttcttcctcgcgctcaacgaccaagactgtgctcacaacctgggaggtggctgatacgtacagtaacaacggctcctgcgggtgtggtgaggctaagactggcggctcggtgaggagttttttgaaatcttcgaaggccttctgtgcttcgggtccccaccggaagctatctgttttcttcagcagcttaaagaagggcatcccccgctcgccaagtcgtgaaacaaatcggctgagcgccgccatgcatccagtcagcttctgaacatctttctgggtacttggcggtttcatgttgaggatagcagtaactttctccgggttggcttggatgcccctatgagacaccataaagccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatccaaacggcatggtgacgtagcagtatgccccaaagggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttggggcaagacttgttgaggtcggtataatcaacacacatgcgccattgccctgttttcttccgaactagaaccgggttcgccagccaatcgggatgaagaacttctttgatgaagcctgctgctaacagcttggttaattcctccttgattgcgtccttcctgtcttgtgcgaatcggcggagtcgttgtttgatcggcttggcatcttctttgacatgtaaggagtgctcaatcacctctctaggaataccgggcatatccgatggtttccacgcaaagatatctttattattctgaagaaaggtgatgagcgcgctttcctatttacaatctaactcggcccctattacagcagttttagtagagtcagagggatctaggggaatcttcttagtcttggcttcgctttctccactttttgaagtcttggtggcaggtatttctccttcgctcgccgtggccgcagccagtcggatgtcctctcgggcagacgccatctcgcgagtttgggccatgtcgcaactctccttgtcgcatgtgacggcttgcttgatgtcgctccgtagggatagcactcctcggggaccaggcatcttcatcatcatgtaagtgtagtgcgggacggccatgaacttggctaacgccgggcgtccgagtatggcatggtaagctgtctcgaaatcggcgacttcgaagctgatattctctgtgcgaaagttttcccgagtaccaaaagtgaccgggagggtgatctggccgagtggagttgcggataatcctggaattactccgtgaaaaggcgcattgcttggtttcagctcggagcgaggaatctgcatatcatccaaggtcttggcgaaaaggatgttgagtgcgctgccaccgtcaatgagggttctgcgaagcttgacattacggaccactgggtctagtaccagggggtaccgccccgggtggaccggtgatgctgaggcttggatgacggtagtcatgagatcggaagtgggggactcggctgccagtcggcgtgtggacgctttcggagttaactgggaccgaagccgcgatcatggtcttcgtctggttcaagatgttgacgacgtggtcggaacgatttagctcgctttggttgaggagggtgtcgagaagggtgatcgcggcaaccgcattctgttgaggggtgcggaaaaccggtgtcccttcgacgtcttgttgtccaatgagatcacgcgctcggcgccctgcttccaaagctcgctgacgtcgatcttcagcctccttggcgatccgctcacggtcctgctgctcacgccgtagccgttcttgttcttgtgcttgatgctcctcctccagtcggcgacgttcttcggtctcccgggcttggcgttgctcctccgtctcgttattggccatgaaaacgccaaagtagagaggggtgtagttgtcatctaggcttccgtcgaagtcgtcgagatccgggtcgtggtagcgagagctaaactcatcgtactccacgatgtcggtggggcgcgagtcgacggtgggagagctgtaatggtcatctagctgatccgtcgaaaccgtgccgagtggttggaggatgacgccgacttccctgaagctaggcgaaatcggtgttgaaaccgacttccgcctaggcctacgggatgaagacgctgtcgcggtggagacggccgctaaatcgtcggggagcttcatcaggactggtgggtaagccccatcatcttgatctggtgtcgttggagaagatgcgatctcagccgagtggtttgaagccgactcgattgagatggtcttgaagtaggtttcagccgcgtttgggaatccaaacgggactgagatccggttctctcccgactggtccgattccgagtcaaagagagaaatcttgccgaagttgtcggtgacgaagtcgaggctgccgaaccgaaacgtctgcccgggtgggaagacgaggtcgtcgatgccggagaaaggacccattgcactgatcggcgaaaagcttgacgcctcccctacctggcgcgctaactgtcgaaactagatttcggcaataataaaagggggtggctatcaagctaggaaagtgtatgggtttggagaccaaggatttatacaggttcaggccttcttataaaagaagtaataccctactcctgtccggggatgaatccgccgagtgtattattgattgtatgatttagggaaaatcaacctctgcccctagaggcgcccggaccccccttatatatgggaaggagtccgggttacaaaagataatcaatatccctaacggaatacacagatatagattaaatacagccgtgaccgactaagtctcaaggtgtttccttgttgtacaagttaagaaacaaacccgagatacaaataagatattccatacatattcggtatcctatatccagcccaaatagtatcgccgtgtagatatgggatatccataatctccacaaatatatatagtgtaattaataactttattcgtaacattatatatatgccggtttgcactctacctttttgtggtctattacactttattctattgtaattaataaatacaccaccgagaaaactgggcgtttctttagaattttatttgtgataaaagattttagtgtgtttgtttagctatgtgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttagagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatctgagtgcttcaaactttttatgccaaggcctgccgagtggcgaagacgaagactgtaaagggcgaaaagataaagaatatggtgcatcgaatagatgcacctaattaggtgtagcccccaactatgtgattagttaacaaactaaacatatagttgagaataaaataatagcacattcatgcatcatacgacaaaagcatacgcggcgcctaaagaggcattcttgccgactgctttttagccataataaaaggaatccgagtggttaacactcaaaaaggttcacgaatgaacacacttgacaggcatccgaataaaaactctaaagattacccaccaagtattatataaattatggtaacgaataagtctaatagcctaggctatgactattcaccataatgaaaacaggcatataacataccaaggaaaggactatggtaaaaacaagtcattccaagttaacccagacagcttttgtagcctaaaaaagcttacaaaaacagcataacgcctttctgtcgggcaccttttaatttgcatcgcaataattccaaagaattatatgaccgcgtaaaaggattctatcagcatcgggcaacactattgtgcgcataaattgccaaagcaaaaatgcctaagtccctaaggaacacaatgggccacgctgtcaaatgtattgggctgaggtactgttcaggcctaagcccatttgcacctccaatacccttaacaaaaaatcccgtgatccaagcgtcacttcgtcttccccgccggaactctcgccattttgcccactccctgctacagtacagagctgcgccggcaaactagggttcaccaatccactcgaatccaccttcgaaaagttcatcaaaatccttcccgtgctccaccgcctcaatccctcacctctccctagccatccctcgaatcaaatcagcgcattcgagtaaaatcgatggcggaagagaaagaaagctttgaaggccaatgggcgccatccgacgtgacggaggagaacctgaaggagatggtggcgcacggcgttctccctgccaaggagatcatcgggtggcggccagcgtgcggtgaggcttttccgtcccccgatacacacgaggttgtagttttctcccatttcttctatggcggctttgctcttccgacctcgaaatttttccgcgggatattaaacttctatgaaatcagcttgcatcacctaaacccaaattccatagtccacatcgccaatttcgtccatgtttgtgaagccttcttgggaattaaaccccacttcgctctgttccgccgaatcttttttcttaagccccagccgaacaagagtaagccgtgtgtagtcggaggggcaggatttcagctgagggggacgctgagccagaagtatttctccatgcccttcaagacctcaaacaaaggatggcatgcaaactggttttatgttcagaatcctgagcctgctcttcccgagtactcttgtcttcctccagtgtatcaagatacttggaactctcttccaatcggggatgaagctgcccaagccttgaagttgatggatcgcatgctaaaactcaaagaacaaggcttacagggagagcagattactcggcatttcatcaaatgccggttggcaccaattaaagaaagatcccgtacagcattcgagtttgacggcaagcatgaccccaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgcatctgaaatcctcaacccatgatcaaaacataatcttatcttcatgttgagttaactaaccgtggaggcatcttattcaggaatatgtattgatgaaatctgatcccccaatcactcagcgccggtctcctcgccagcacaccgttcagggaagtggagggccaacaatcagaccagatccacaacctcaaacctccaatccgactggacagacaggttttcgcaagagaaaactggtgctcgacaacgatgaaggcgacgacaacaaatctggggacaagggctcgcctaataaactcccaaagcgtaccatgcccaagaaaaaactggctggccgtcaaatgccaaagattagaacatcttccaggtataaacctctcggtaccatctccctttgacatgcttctctcacagaaattacgctgaatatcgaaaggacactttgcaggaaaccatccgacatagatccaactggaaaagatcctgatccggctgcgacagagccaaatttatccaaagatgctgagccgactgccgaaagccagccgactgccgaaagccagccaactgccgaaagccagccgactggcgcccatgcttcggatgacaaggccaatccgagtgaccagccgccgactggaaaccagtcggcagcaactgaaactgcaacaacccaagagcccccgactggaaaccagtcggatgtaggtctaaatcaagagattcctgaagctgaagcgcaggcgacaacttctcaaggaccagaggctggtaatgactcggtgattgggtctccggataaagagcaaggatcacctcacgctcagctaggcacatcctcaggtaactcatcttttcaagtgatgccgttctgaataactccagcttgttcgtctaatgtcttgggaatacatcaggtccattaggcggcgacgaagaagaaattctccgcataaaggctgctaatgactctcgtcctcctatcttactcaaatggtgggacgagaactctcaagtttccggcatcgtcataaatcgccaaaaagaagatgaggaagtgtgccagctgaagaaagcacttggagaagctactcgcattgtgaatgtaagtcttccgggtgactgcctttgataactttgttctctcgttagcaaaactaatccatgaaccaccgtgcagagaatccatcttcgcaatgaggccaagaccacaaccttagaaaagttggttcctcatttgggaactcttgaagccgttaggggccagctacacgaggccaaggagcatgccaagaaaacggagaaagagttaagggaccgaatcgctcaactccaggattcaaactacgagctgagtggttcatcaaaaggtaatctctagatctgtcccattgattcaggccgtcataaccgtatcctcaaccatttggatttcaaacagcgcaagccgccaggatggctcaaatggagaagcaaattgaagccctggagagagacaaggtagaactggctgcgcaaagggactcggccttaaaggaagttgaaggtgctgccggctgacgatctgaacttatctctttttaatgcaacaaattcttatcataaatgtgttttgcagaccgcaaaatcaaatcccaagctcaattcgacgtcctggttggtaagatcaagaggcttgaaggagcaagagatgaagtcgccaatgtcgctacaccactcgtccaagccatgttcctcaataacagtggtccgagtgcactcgacgcaaccgaaatctttgacaagctgagagttgctccggatgtgtatttcaagaacatcaagaaagctgggagtatgggagctagtatggcattagcgatgaccaaatccttgtacccgaggattgaaattgactccattgatggctttgcagacgggacaagcgaagaagcagctcttgatcttatcagtaatgctcaaaatgcggctgacaagattgcaagtgacgttgtagatcaattccgcaacaacgaccttcagccgagcaacaataactctgacgatgaaagaactgattctgactgagtatgaatgtaacaaatggaggcttaatttgtacaatactggtgtatttatgctgtgcttgatagttctagccaagtctttgatttcttaaatgcttttatcgagctttgttgagcctaaaacccaaagaagctattaaaaactttcagtcctcgcagactaagtagaaaaaaccaaacaaggcaatgatagaccaagtaagcaaattaaattgataaaaaatcacactccattattatgatgatagcccccgactgacaacgtcaagaagaaaacttgatgttgatagtcaagatagggaagtacaatgataagcttaagcgtagaaacgacgaagatgttcaatgttccaagaattgtcgacgatagtaccgtcttcgcgcttgagtcgataagaacctggtcgggtgacttcagagatgataaatggcccttcccatagaggagataacttgtgccgatctcgtgtagtttgaattttcctcaaaaccaggtcaccgactaaaaaagcacgggatcgaacattgcgattatgataatgccgcaacccttgtaagtatcgagccgaccgaattaaagctgcctcgcggacttcttccaatcggtgcaaatcatccactcggtcttcttcgtagcgttcttcacggaaatttcgaaagcgcaaagactcgaattcaacttcactcggcaacattgcttctgccccatagacaaggaagaaaggtgactggcctgtggcccgactgggtgtagttcgcaaagaccaaagtactgatggcagctgtgtcacccatttgccggcatagggttttagccggtcaaaaacacgcgctttaatcccttgaagtatcatgccattggctcgctccacctgtccattgctcatggggtgtgccactgaggcatagcaaatcttaattccaaagtcctcacaaaagtctttaaaaactccgccagtgaattgtgtgccattatcaggatgatccgattgggcactccaaatctatgtcaatgttgatgaagaagtctcgagcgtattgctgtatgggcaaccggtttagcttaatcca

SEQ ID NO: 23237 - DNA, 2648 bp, Oryza sativa
gggtggcttacgcccgaacttgccgaccaattcttcgtggcgaatccctttggtgaatgcggcgatgataacgtcgtcggtgatatcggagatcttgttacgttgttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgcattggctcgctccacctgtccattgctcatggggtgtgccactgaggcatagcaaatcttaattccaaagtcctcacaaaagtctttaaaaactccgccagtgaattgtgtgccattatccgtgatgatccgattgggcactccaaatctatgtacaatgttgatgaagaagtctcgagcgttatctgctgttattgtggcaaccggtttagcttcaatccacttggaaaatttatcaatggccacaaagagatgcgtgtaaccgccgactgcctttttaaacgggccaaccatgtcgagcccccaaaccgcaaacggccaagacagcgggatggtctgcaactcttgagctggtagatgaatttgtctggcgaaaaattggcaaccttcgcatgtgcgcacaatcttgtcggcgtcggacactgcagtaggccagaaaaaacctgccggtaagctttgccgacaatggtgcgtgcagcagcatggtttccgcatatcccggaatgtatgtcgttcagcaattgtctcccttcctctaaagatacgcagcgttgcagaattcctgaagggcttttcttgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtgtaaaggtgttcgacgaaaacatcagagggcaccacctcgcgcttggatccaaagttggcaagtctgtcagcggcttcattgttgtgtcgaagaacatgactgagctcgagtccatcgaacttgtcttctaatttgcgtacctcctgtcgatatgccatcatgttgtcgtcaaggcaggaccactctttcataacttggttgacaaccaactgtgaatcgcctcgaactattagacgctttatccctagggaaattgcaatccggagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccactttgcaatccgtccgtttgcttcgcggttgtgcagtatatcaccgagtggaaatgatgtgaccaccgttaccgagtgaccttgaaagtagtgagatagcttcctggtagtgattaaaataccatataacagcttctgaacctgagggtacctcattttggagtcggctaggacctcgctgacaaagtagatcggtcgctgaactttctggacatggccttcttcctcacgctcgacaaccaagactgtgctcacgacctgggaggtggctgatacatacagcaacaacggctcctgcgggtgtggtgaagctaagaccggtggcttggtgaggagttgcttgaaatcttcgaaagccttctgtgcttcgggtccccattggaaattatctgttttcttcagtagcttgaagaagggcatcccccgctcgccaagtcttgaaacgaatcggctgagcgccgccatgcatccagtcagcttctgaacatctttctgggtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttaatcc

SEQ ID NO: 23238 - DNA, 30208 bp, Oryza sativa
tgtataactcagcttcatgcataacataaagtttgctccgccttgaaatccgctcggcttcatctttgtcttgggggagttcttgagaagtcaaaaatcgtatgaggggctctcgccagtcggcttcaaccatagctacgtcatgagtgcccgcgacttgagtagtatctttgggaggtactgtcggcgtataaaggtgttcgacgaaaacatcagagggcgccacctcgcgcttggatccaaagttggcaagtctgtcagcggcttcattgttgtgtcgaagaacgtgactgagctcgagtccatcgaacttgtcttccaatttgcgtacctcttgtcgatatgccatcatattgtcgtcaaggcaggaccactctttcataacctggttgacaaccaactgtgaatcacctcgaactattagacgctttatccctagggaaattgcaatccgcagtccgtgaaggagggcctcatactcggcgacgttgtgggatgccgaaaaatgtatccaaagcacataacttaatctttctccagttggggaaatcaaaaccactcctgctccagtgcccgaaagtctttttgacctgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccattttgcaatccgtccgtttgcttcgcggttgtgcagtatatcaccgagtggaaatgatgtgaccaccgttaccgagtgaccttgaaagtagtgagatagcttcctggtagtgattagaataccatataacagcttctgaacctgagggtacctcgttttggagtcggctaggacttcgctgacaaagtaaatcggtcgctggactttctggacatggccttcttcctcgcgctcaacgaccaagactgagctcacaacctgggaggtggctgatacatacagcaacaacggctcctgcggatgtggtgaagctaggactggtggttcggtgaggagtttcttgaaatcttcgaaggccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcggtaactttctccgggttggcttggatgcccctatgagacaccataaaaccaagcagcttccctgacggtactccaaaggtgcacttttcagggtttaatttcatcctgaaagcgcggatgctcgcgaaggtttcttctagatccgagatcaaatcatccttttgcttggtcttgacgactacgtcatccacataggcttcaacgttgcgaccgatctgcgttgagaagcatctctggatcatacgttgataagttgctcctgccttttttagtccgaacggcatggtgacgtagcagtatgctccaaagggcgtgatgaatgaagttttcaaacagtcggattccttcagtcggatctgatgataccccgaatagcagtccaaaaaactgagaagctcacagccggcggtcgagtcgactacctggtcaatgcgaggcaacccaaaaggatccttagggcaagatttgttgaggtcagtataatcaacacacatgcgccattgccccgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccaagcaaatatatctttattgttctgaagaaaggtgatgagcgcgctttcctatttacaatctaactcggcgcctattacagcagttttagtaggatcagaaggatctaggggaatcttcttagtcttggcctcgctttctgcactttttgaagtcttggtagctggcacttctccttcgctcgccgtggctgcagccagtcggatatcctctcgggcagacgccatctcgcgggtttgggccatgtcgcaactctccttgtcgcatgtgacggcttgcttgatgtcgctccgtagggatagaactcctcggggaccaggcatcttcatcatcatgtaagtgtagtgcgggacggccatgaacttggctaacgccgggcgtccgagtatggcatggtatgcagtctcgaaatcggcgacttcaaagctgatattctctgtgcggaagttttcccgagtgccaaaagtgaccgggagggtgatctggccgagtggagttgcggatagtcctgggattactccgtgaaaaggcgcattgcttggttttagctcggagcgaggaatctgcatatcatccaaggtcttggcgaagaggatattgagtgcactgccaccatcgatgagggttctgcgaagcttgacattacggaccactggatctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccaccgaagatatggttaagctccttgcggtggtcttgaaatcctgccggggtgtcgccgtcgtccttcttcctcgacgtgctttgttcttcgtcggggttcttccgcgtagtcttagtgtattgatccgcgaattgcttgtagacgaaacaatctttggccacgtggttggagttaggatggtgcgggcgttgggagttcatgatcttgtcgaacgtgttgacgcgcgaacgctgtcgagaagagtgactggcggttgcaacaagttccgcaggcttacgcttgcggtctttatgattgttacttccacctcctcccgaagccggcgtatccttttttggcttccaactgggacccgactgttttgatgcggtgacggcgtcttcagctttagcgtactcgttggctttttcaaacataagcttgactgtcctgggtggcttacgcccgaacttgccgaccaattcttcgtggcgaatccctttggtgaatgcggcgatgataacgtcgtcggtgatatcggagatcttgttacgtagttcagaaaatcgccggatgtaatctcgaagggattctccggacttctgaataacgttgtagaggtcgtattgtgtgccgggacgctcgaaggtgccttggaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccgtcgtacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgatggggcggcgacgaggtggtgagcgaggtcgttccactcggcactctctatgatgatcgggaggcgagtgaacggaccgctcgtcgtgacccctgctcctgcgattggatcctgcgccggtgatgctgaggcttggatgacggtagtcatgagatcagaagtgggggactcggctgccagtcggcgtgtggacgctttcggagttaactgggaccgaagccgcaatcatggtcttcgtctggttcaagatgttgacaacgtgatcagattgattgagctcgttttccctgaggagggtgtcgaggagggtgatcgcggcaaccgcattctgttggggggtgcggaaaaccggtgtcccttcaacatcttgttggccgatgagatcacgcgctcggcgccctgcttctaaagctcgctgccgtcgatcctcagcctccttcgcggtccgctcacgctcctgctgctcacgccgtagccgttcttgttcttgtgcttgatgctcctcctccagtcggcgacgctcagtctcgtgacgcgcttcgttctcccgggcttggcgttgctcctccgtctcgttattggccatgaagacgccgaagtagagaggagtgtagttgtcatctaggcttccgtcgaagtcgtcgagatccgggtcgttgtagcgagaggtaaactcgtcgtactccacgatgtcggtggggcgcgagtggacggtgggagagctgtagtggccgtccagctgatccgtcgaaaccgtgccgagtggttggaggatgacgccgacttccctgaagctaggcgaaatcggtgttgaagccgacttccgcctaggcctacgggatggagatgctgtcgtgatggagacggccgccaaatcgtcggggagcttcatcaggatcggtgggtaagccccctcgtcttgatctggtgaggttggtgaagatgcgatctcgcccgagtggtttgaagccgactcgattgagatggtcttgaagtaactttcagccgcgtttgggagtccaaacggggccgaaatctggttctctcccgactggtccgactccgagtcaaggagagagatcttgccgaagttgttggtgacgaagtcgaggctgccgaaccgaaacgtctgcccgggtgggaagacgaggtcgtcgatgccggagacaggacccattgcactgatcggcgaaaagcttgacgcggcccctacctggcgcgccaactgtcgaaactagatttcggcaataataaaagggggtggctatcaagctggaaaagtgtatgggtttgaagacaaaggatttatacaggttcaggccttcttattcaagaagtaataccctactcctgtccggggatgaatccgccgagtgtgttattgattgtatgatttggagaaaatcaacatatgcccctagaggcacccggaccccccttatatatgggaaggagtccgtgttacaaaagacaatctatatccctaacggaatatgtagatacagataaaatacagtcgtaaccgactaagtctcaaggtgtttccttgatgcacaagttgagaaacaaacccgagatacaaataagatattctatctatattcggtatcctatattcagtccaaatatcatcgccgtgtagatatgggatatccataatctccacactgtgaacttgtttcattgtgacggagggaataaatatactaatgaaaataattaaaactagctaattcagctttgcctgtattgatcgcggaatcaccgaccgagaagctctctagttctagggcaggtttgaattaattagtggtattaatgaatgattaattattgcagtggaccaggatcatagcaggcagcatcgatgaagcagcaggcagggtaattgaattgctggaggatacaagcaaggggaatgtgatgtatttccatggctggggtggactgggggcttcagccgtccttagagcagtcgccaaaagactgacgatgaggccatcgccatcgccaggaagaagaaggtgggagaagatgatccacgttgattgctcggtgtggcagagcaagagggccctgcagaaggccatcgcccaggagctgcagcttcctcggtcgctgatggccttgttcgaccagcacgacgaggaggatgatttcagtggggtggatcagggcatgagaggggtggttccacttgtcacacagacaatcttgagcgacctggtaaaccacacattcctggtgatcttccacaatgggagcggcagctacattgatctacaggagtgtggtgtccctgtaataacaggaatcttgaacaaaacggtgttgtggacctcccgaagcagctttcggattaccgacttggacatggataacgtaagcaaggaggatcgggataagcttgctgggctgagtgatgtcgctatatatgcttatccaaccgcaggcgatgaatatagttttgtaatcttatttggaatgcttttgcatcaagaggcagaggaggttgccaggtacaccggtgtccctcaatctgctggcatgagcaccgagcttgtcaagaagtgcatcatgtatcagttgatgctaagacaacaacatgtggactacacccaacactgggatacccacgcagctaactattgggtatgcagtggaatcatacaaacctcagacaccactagtagtacaagttgtcatagctcatcgccatgggagatagcccaagctctttataataacttgatcttggagtttttgaccatagacgattacaacagcaacccaacttgtgcgaaaagaatacagagagccctacgactgccttctgattttgtgggcgagtcgtccttcttctggacatgtgatgctgctggcaataacaatgtcgacgcaactacagcttgttgtagacagaaatcactggaggccaaaatgttccaacatccatctgcaagctggctacgtgtgatacatctctttgaatgtaccttcagttttgcatctccacccttcctctcttgcagcagcctaagattcctcctacttgaccattgcaaagaccaaaacagcagcaggacggactcaacgctgacgatgacaacggataccggagatactagagcttgttttcggaagctgtgggtgctggacttgagtttcacagactggtattggctcttatcggttgaggccctagatttaatggttgagctcagggagttgaatgtgaagggaatcaagcattggagcataagccatctactccatcgccttgatgatgatgacgctagtaatagtacccgaagcagcagccgcaagccttggctgctcagccttgtcaagctccaagtcacaaccgaaccaataactgaagatcaacatcagtcacaagtatggaaggaagatcaggtagcagcaacattattcccgaacctatctagctgcaaaatcgtaaagacgatcattcttgatggttgttttgagttgaagcgaattgaccctcacgtcctgccaccatcactcgagtcatttagcttctccagcagcagcaatgacaatgatgttcatgtctcagccaagatagagagcatctcctttcggggatgcacccagttgaagagtttgttattgagaggactatttcaaaggctcaagcagctggacgtgtcagaaacttgtattaaaaccctcgacctacatgcaatgcgaggcaacgggtctctcaaggagctatttctgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccattagcagggctgaacaacgttggttgatgtcaaccaaaagccgacgaccaactgctgaccacaagaagttatatgcggatgtcgactccacgatccagcacttgcaactacaagcaaccatgaacggcaactggatgtggccatgtaaatcggagggcagcacctctcactacattagcttacaagatgataagaggatgcagacgaaaccattgtcgtcgccatctttgccaggttccatctgtgaaagagcttcaggcctgcacgtgcatgacagcttgtctgtcgcaagtatcacaagccattcaaatgaggcacggagatggtataacctagagtggtgcagagtggagagatgccctaacattgaaggcgttgtattcactccacctagtactggtagtaacagcattttctggtacctaaagacattctgggcatcccaactagcaagggcgcgccacatctgggactggagcacaacgggccagatacattttgagcctgcagattcgtcattctggttgaaagtgctacacctaaattgctgccccaggttgatatatgtgcttcccttatatgacaacagtccttcctatgcatactgtgcgttggaaacccttgagatcgtgtgttgtggtgacctcaaggatgtcttccgagtggatgataataatcaagagcttctaaaaactataaaatttcaagagctgaagcacatccacctgcacgagctgccctctctgcaacgcatctgcgggcataggattgtggcccccaagctcgagaccatcaaaatccgaggctgctggagcctcacccgcctaccggctgttggtcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattgttacttgggtatcattccttgcgcgcacatacatacatacgtagaaacttatatagctcagtactttagttactccatcatatatatatatatatatatatgatcgagcttttcccttttttttttaattttgtctgacttggcgtgctttcttttcttcttaaattcaggtgatcgatatatacgtccatacactacatatttgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctctggccggcatccagacgctcgtcatctgcttgttactagcttggattctgttcatttatgcttcttttgttttgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcactgttctggtgtggtgtgcttcctagaggtcgacgaataaatcatcagcttcagcggcatgagaagatccattgggtgatcctcatgcagtcgagttgctgttgtgcacttgtttgtgggtgcgtgtgtgttcgtgtgatttgtcagcatttatggactgacctaagtttgtactcctaattacttcacttgtatgaacagaaacaatgatgctaaggattgtgagtgtgacattgtctatgcagcaaacatatatacctgttgctctgttatttggaaggggttgtatattttgctatgcagtctgcagtccacatagacgcctagtattttctttatgaaaaatacggtacaccttttgccttttatggttagcttttactcttttccttatgagtccttttacagtacaccatgctagtgatagagacgaaatccagccgtttatttgtgtggttatttttatactaattgatttggttacttaaaaagatttcccaccaatgccaccaagggaaatccaatcggcatttttttttctatctcgtttgttcttcgtcgctgcgaggattccagtcctgactcctgaatggaggacgcttcgtgctgaggcacagactctgatgaatttatctgtagctgcaagtactatgaatgatttggtgatgcgtagaacactcccagtatatttaggccctctttgttaagacttataagccaacttataagtcgaaaagtctaagccaaaacaaacaagcagcttttttatttggcttttttgaagccataagccactctaacactattaagccaaaagctaggttggagaagcttttttggcttatatgagatagatgtatgactccaccactaaacttaggacattaaatccactggcttataaatcatataagccaataagctgacttaaaagtctaggccaataagcctaagcctaaacaaagagggccttaacatttcactagatttggtggatcatgcatataatgtttaatggtccttagtaatctctctattatgtgctactactaataatttattagttgatcaactagcaccacacaatttctaatctattgtgaaaggcaaacgttcagtgtggtttcatcatgtatgcgagattaggaattgagtggtttggcattgctattgttgcattctgatctgttgattactaatgcttgcactaatataagcacggagatctgaatgtgcttttttgtcttcgatgaagcgtacatacttggccactctggtggatcagttttaattaaattttgtgggagggagcacggggcggcgacggcatcccgatcgggtcgattgggatttggggattcatcgaacgaatcggtaggggtaggggtagattacgttgagttagtgatccaaattaatttgcacttaataaaggtcatcttctaccggagcgaagcggaggcccagtagaagccagaggctgggccggaacgtaggcggaacgtcgtcattccttttagggttccaccttatatatatacctcttgtaagccgccgtgcgacgttgtaacctcaccccgatatagtgaagatattttgctggccgacgctcgtggttttttctctcctgttttgagaggattttccgcgttaaatctcgtgtcttctgtgattgatctattgtttttatatcgtttgcttgcttatcgtttcctaacggttcagtgcactaatcttaaagtgaaccaaacaaataacatataagccattgttttatttttcccataattccttcatactactgcgtactaatctgtactacttgtggaaatttcattagtataggatgaatcttttctttattttttgagggtaagtataggatggatccaaactgttggattagccctctaacccactaatataaggtagtatggtgtgctctaaagaaactcttttttacatgtgcaaagggagaagcacaatattttctcaatcctcaggtcgactgatctggtcaatgaattaagatgtatttcaacttgattagcagtcaccattagtaattgggttttgtacttgtgcagtgatataatactctgttttgtagtgaaaaccttctgccatgttgcagtataaggatatacagatgacatgcagtaagcattggggcatgctattctgtgtatccccaggtgttgtgctgggcctctatgatacacacattaggaccattttggtagacaatctgcaccttttaaaatacagtccttaaccagcaaaacacaagaacgccctgtccttttccaattcattgcttacacaaggaaacccctaagcagattttcagttctcattttttttccattttatccatgccgaagttcaattcttccttcgtgcgactgcaaagttccatcgttgcccttctccccgccaccgccgcctcctctctctcgccaccgtttcctcctctgctcccccgccttccttccaccgctgtcatctccgcctctcgtgcgttgccttcgtccccgcctcctccgttgctcgatctcacggcggagccacctctcttccttgttcttccaactcatgcacatggtttgaaattttggtaattttcggcccccaccggcaagcacaaatcttccccgaatttttggctttttgtcaaatatttgcaaaatttgtcaaaatttgttcaaattcagtcaaaatatgttaaaaatttaaataatttcggtccgaaaatcacgaaagtctcaaattctcggcaaccaccgaaatttctatggcaaccgaacttgcaaaccctgctcgtgcacaacaacagcacaacggatgagggtccatttcgtcatcgccatccccgaccaggttggaatctgagaagacggaggaggctatggacaaggcgacagatggggaaaggatccacaccaccggcctctcttcgccatggcggccgaacacacccaagaatcctcctctcgacattctaaatctcaaaaattcttcaacttaccatggtgatgggaggttgattatcctgttgctgtttcagataacccagtgatatggggctggtaagcatcatcttggcatcgacgaacctggcatcgttgtgcatcaccaaggttcactctcctgcattgtgaattttgttctcatgttttattttctctgaagttgatactcctgctggctctgaactctgaattttgttttacagtaccatcctctttgtacctgcaataaactgacatcgtgatgaatcagatggatgttggatctcgtgcttgtgaattttgttcaccgtaagttcaaatagagtacaaatagttttgatagctcacacataagggaaacagagtacacctttcttcggttaaatgacactgcaagctgtgaattttgatactccagctccagagatgtttcagatatgaggtcttcttaacatgaggtaaatttcttacaggaaatccattgatgattctctagttgtgaattgtagttctactccagcagaaattagcttattgtttcaagatgcatctttctcagcttagtcttgttcgtagattaagaaattcagaccaagtcaacctcctgataaccacactggattctgatgtcctggcgagccacatccaacgtgtggtgatccaaggcggtgacattatgtcgatgacactccaggcactctacagttaggaaaagtctttgttttggggtagaaatttgccatttgagcatgacaaatttgaattccatcaagaaattctagcgtagagccggtagaatcattgtcaacatgacaaatttgtatcgtgtcagtaaaattggtattgtgtctgtaatgccaattggaataatggattacaatgttttctttgttctgatggatcatgctttgttcagatggagtctaaatgtcagtttgattaacagatgttttctttgttctaaatgacaatatgaatgtctaaacaagtgccaattgccattgcattgctctgaatgacagattagattgttcatctgaacaatctgaacttttctataatgacagttggaacaatgacaatctgaatttttcgtgatgaaaattggaataatctgaattatacttagagagaatcccttatatgccactaaaaagtggtctgaacctttatatgcctctgaaaattggctcttctcttatatgccattggtccaaaattacgcacccttttatgccactcccgtcagttgaccgtgcgttgaccgttaactcttaaggaaaaaagccgtatttacccttctgagtatagggcatgcctaacaactcagagaggacaaatatgtctttttttacttgagagttaacggtcaacacacggtcaaccgacggaagtggcatgagagggtgtgcaaatttggaccaatggtgtagacccccgtttttatagcaggaatcactcgtgtgaatagtaccatttccctagatcaagtagtctggtactcacgattacattgctgaaatatcaagtgcgcatacatagattgtctagcgcgaattattacatcataggcccgcaggcatagtctagaacataggaccaaacggtccggaatacatcccaaaaggagaaatagataagcagcggaatcaaggcagcggcgacgccattgccacaggcgacgaccgtaactaagacctactaagcgccaccatcttcttcaccctcctggtagtaagcatatgggtcatccgagacttcatcaccggcttctgatggaatttgtaaatagcaagagtgagtaccaaccgtactcagcaagccaccacaacaacgatgcatatgatagaggatattcaatgaaaggctaatggtttatttgcataaagccaattttgcaattcttttcacaagcctaagacctagcataactgatcaaattttatctccgtagttcattatacagcgacggttctgtccaccatccattgtgttcccaaggatagcttcccgccactagttgtcatagttttctggggtctaccccttctcgcctctcgagaagttgatccaccagtctaaaaatcattatgcatatcccacccatcattttaagtgtttagagtctagccaagtgtaatacatgtcccggtgctcaataaccgcgagcacggctattcgaatagattggtttacttacactgtagtggatgtacactttacccgtactacgcgacttgcccaacacatgagcctacatcccaacgaatgagacttgccacggcaaagcctttcaacaacctcactttggcaatacccgctccatgaacttgagtcctcatgcactctaggcgtcataaatttctagcagtgagaggagttctggcgctccctagggggaaaactcacgaaagcctaacattgcatcctgtagttgaacccaatccatgctgtcctcttttgggtatctccttgtagtcttgtagtcttgacaagtcagtctctggccatccgtatcgggtatccgccagcagactgcttgttcgtccacacacctaagtgaaaccactatgcaggggtactgcctccgcttggctatctactccactaggtctatacccattcgagaagtacggctgtactaggatcgtttcatgcttaacttcatggctcggtacttaactgaccagggacggcactagcctttatcggacaccacccaagtcctccagccgccccagtcgaaaacatttgtttagtttaattttctttcacaaatcatctcatcattatcatggcaatgtggcgctcatgtctccacatgccgtatgtcaattaccttccctaattaaggtaattgcccaagcataaagcattttgataaatatgaatatgcatggatctaaattagcatgggctaagcatttgtcaaatattgactaaagacacacgatatcatggattacaaaggttatatggataatcaatatcaaaggtatggcatataacaaagtaggacattcacatataaatagcatgcaaactttatttaaatcaaaataagttcgcaataggtccaacatgctcaaagattagtgataacttgccttgctcacagatttgatgtccctgttctgcagttaactcaaccactccctcggaatctatatgtacgtgcgaaagattcgatttgaattcaactagaattcaaattaaatcaccaaaattcaacagtacaaaaataaatagcaaaagttattccatcagctagatcttgattttatatgaatttaggttcaagtttcattcaaatccgagctaaaatgagtgagttatacttgtttaaagattcaaatttgaattaattccaataattgtgaaatgatactgttcataattgatttatttttagtcatggcattatccataagatacattggctgacacgtgggaccagcccaggttgactagggccaaaccggctgttttaattaccagtgggtccagcttgtcatggagagtaaacttaatattggttttaattaaatttctaatcatccggacccacgcgtcatggacaggtataatcatcattggaagagaattactgtgcgctaagtagatgtgggtcccacatgtcataatctctctctcttgttcttttcctttttccccatcgtcttctacctcgcgccggccatcgagcagagcagaggcgcagcgcgtgcggcccagcccggacgagggcgacccggcggcggtcaggggaggcgcggaggagggtccggcgacctcccgccggcggccacagcacagggcggcgcggcatggccgccatggccgagctctagggtgcaaggggactcggcaaatggcgaggtctctaaccaattagtttggcgcaagagcttgtacagcttatggtgattccgttttgctagctaggtgggaaggagagtgctcgaggtgacctacccacggcgagcccgccgatggcgaagcggcggccgggacggcacgccgaagggcgctaatcgccaaaactggtgggggatttagcttctactccgtactagactaggaggagctataggagtgaggttttaccgagagacagcgggatggcgaagttcggcggcgcgcagctcagtgcggacgaaacaggggcggctagcggcgacgcttgcaggtgttcgatgcgtggttcccgacgttgatccaaggcagcagaggaagtagaggcggcccgagccacggttcccgcggtcagctacgccggcttcggctccaaccggtgatgatgaagcatgcacacaaggtgttcgatgaaatgtattcgaggaaaaggcagatagggatgaagtttttatgggggcttggcttggggataggccaggatggcgtggaggataggatcggcagctggtgcactcaatggctgtctagattccttctccattaaggttctgtctatactgtgtgttctagccggccctagctggagaggaaggctccgttcttacccgccggcatccgcatggtggcggacgtggccatggcgatgcgtgcacatgggagctaaggtagtagttggctagggctaggggtgacgcgcgatggcgacggcgcgttcgtggcggctcagcttttgcgcgtggattcggcggctcggtcgggctaggtctctggtcgaccacctggtggcccatgaacagtagcaaaagaaaaggaaggagaagataaaggaagagagtaagggggctaatctgtaaaagtgacttggataggaatttgaatgaaatgtagctctatatattttgtatttgagaattcaaatgtttgatttgaatatttattttgttattcattagttcccaaatgaatttgctttccattatattatccaaaaattatccaatataacttctaggctttgatattccttaaaaattaattaaatattccaatgtgacctttaataatacattagcacattggtcgagtttatttgtatggcaaagtattgcatatagataagtttaatctatttaattaattcttactccatgaaggcactgtgagacttggtgcaatatcggtctaaatattgaatcgagtactcatataagccctttttatatatagaactcaatttatttacatgactaattattttatgcgagtaaattttattccatgagagcctcaatgcaagttataaatatcaacttaattattccagtgaaacactccattatatgtagggttcataataaatatcataattttataactattacttagttgtatagctttagcttaattttcatttgcgacattttatagtttggcaagcaataatgaccgtaacatccatcatgatgcacaacaaaagaaccaacaacatcggcatgatgcaaatttatttaaaagtttttgaaagtactcaattttgagtttcgttttatttgtcgaattttcagggtgttacaaatggcatataagggaagagtcaattttcagtggcatataagggattagaccaattttcagtggcatataagggattatctcttatacttaatatttgaactagaaaaatgcccgtgcgctgcaataggaaaaaacatgagaaatttaagaaaaggttaagaaatatttatattatgtaattaattaaaatataaaatcgcaactatacatgtatacatgtatacgatgttgaagaaaaaaggctcgtaaaaatcaaggtaaatgtggaaaataaaattttccaaataaactatagctggatttaatttttattaaactctccacgattaattacactatgtgaaattttttcagtattttcagagcaccattgctaattttaataattaaaacattattttagcatttattttaatgaaaaccctcctttctccctgggccattttgagcccattctttctttagcccgtagccgagccggcccattaacctgacttctcctccctttcacctttgcctgcaagcgcgcatccagcccatcaagcaaccacaaagtttaatcagcgtcccttctcctctcactgtcgcatgggtcccagtgctacaggtcgtcccctacctccgttcgattccacagcttcccaacaccgccggaaactgtcccctccgtgaaatctgtccgcatccatagagctaatccaaaattgattgaggggttttgatgcttatctcctctttccgttttttctagaattagagcaaaatcgcatcgtatcaacctcggaattaagccatatagcaaaccctagagttgtccgtttcgcgtacggggaggaaattggaccgctcccaggacaatgtacgaaaaaagttggcaaaaacatcttaaagttttataataggtaaagatatactgaaactactggttatatatatgagaaatctgaaaataatgaagttatattcaaatatctgatgcttcatgagcatcatgtgcttttgaatatactgaagctaaactgaaaataccatgtacttttggactcctttcaaacatcaatcaaggtctctcaatagtcaatactccagtccaattactccaaggtttctgagtacttcaattcaggaaatcgaatcaagatttccatgtactccaattcagaaaaaatcaatcaaagcttctgactttctgagtactctaattccaaaaaagaaaaatcagtactcggcacatatactctttattctgtacgtacattcagaaagagtatcagagtactctaaatcagaaagatatttcttgtgctagttctttcattgtgtgtgtaaaatcgactacaattccagccaacgatcgagattcttgaggttatcggcgcaacctttctttattcttgagcttcttgattagatgcatcgctagaggttcgtcgtcgtcgcccgggagaggcacgccatttccgctgggcttcgtcgctgtggactgatgaggtttcgtcaccgtacgttgcctaggagagctaccgtcaatattagggttcgtcgctgtcgaggtccgttcatcgccatcaccagcgattgcgtaaaggcagttgagatcgagcccggccacgagccgcgcggcatcacggcgtagggttcgccgccattacgggttgggaaaggcgcggctgcgtcgtcagggcaaaccagacattttggaagatggggagagtatatcagttgctccgttatttggaaggggttgtatattttgctttgcagtttgcagtccacacagagcctactatcttctttattatcaaaaacacagtacaccttttgcctttgaatttcatgtttgacttgagaatgtgaatttaattgcccttaaattaactttcgaatagatttcagcactggccttttgagaagaagaaaaggaaaacccaataaaataccggtaagatgatattttagaaaagtttttttaattatttcaaattttgtttttctgttatagattcgaaaattttaaggtgttgcatagcagcatgcaatttgatgtcgcatggcatcgataggttcaagccttctttaggcaaagcattggtatcgatatcgttcatttttcatcaatcttaaatatatcttattcaagctcggttatattacattttgtcatgagcccctgcgcataatctaatgggatatcagtgggttatcggagggcgaggacatggaagcttggtcgaacatcgacccgtggcggcagcaacaggagatgagaaaacagagaatcggagatgagaattgtagattgaatttgcttgctttattcatccgaatgctacctcttaataggcttacaattggtaaccaaattactataagaaatagctaacaaactggtaattaaggaaaagagctaacaaactttatctaatttgcaagcggatagaactgttgccgtccggcgcggctgatcaggcgcgacgcgctgcgctccctgctgccgcgtcctgctgagccggcgtgcctctgcgacgatacgtacgtaatcctgaccatgacacatttatgtttggtttgcatttcaaatatcatcgtggcattaccactcatattactagtgatctaattagggagactaaccaacgggagactcggagagctacgaaccaatgattaagcacaacttctatacgtaatggatttgatgtgcttttatctgattaaatactatacttaatgcctataaaaatatatatactatatacttaatgaatagtatatagaaatatatacttaatgaaattaatactatatacttaatttggaggcccaaaaattgtgggccctattcaatgggccacctcgacctgttaaatatgtgatccgaattttgggctcacaatatattcggattagtttataggattagtttcctattaggagtcctaaatttcttctatatatatcccttgtaagctgcacgaggagggtgcgacagcccaatgtatcccctgcgtttgtatccaatttctctacagtgatcattgtccgacgcggagtgggtgttttctgtgcgaggagaaaaaggcaatgcagcagccgtcgtccacgcctacgcagccgcacgcgtcgaggaagcagcagtcggtgtcatctgatgtccataccgagccatctaccagcacgtccattcagcagccttgcctcggttctgttcacgtgaatttatttcacggttggaaattgctgcgtgcacacgcccttcgtaccagggaatcaattcagtggcaatgctccggttctgttcaggtgaattcaaattcacattcaattgctatgttcacaaagccaagtctaccaggaggttctatacggagatcaaatacttcgttttatttaatgcacctagagcgtttcgcgtttttgctagggtttcacaatttataccagcagattcaggattttattcccaaggcgagtttgaagtttaatctaccgctcctggattgagatgcaatattctcgttatggcaagtgaagatgcaagttggcgtagccatcgaggaggagaagcaagtattgctgtacaccagagaggaaaaaaaaaggcaacacattcaagtcgtcgagagggagcctcgctcctgtctagatcacaaggtgatcaaattgtccggcgaattttgctaccatcatgcctaacacaccggaaggttaataaggagatctaagtactttgttttatgcacagcgttttgcgtttctgttaggattccagaaattaataccagcagattcaggatgttattcccatggcgagtttgaagtttgtgcatcagtttcgcgtctctgctgggttccacgatgtcataccagcagattgtcacatcctaaaaatcctaaatttataaattgttgtttaattggaattattagaatttattttagaagcctagaagagaagatctaattttaattaataaattccaaaatataaaatagggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacccctctctctctctccctcggcccagtcggcccagtccagcagcagccgctgctctcgcgcgcgcgtccgtccgctgacaggtggggcccacctgtcagtcttcgtctacctccggtcgccgccgccagaaaccctagcgccgcgccgccgccgccgctttccaaattcggccgcgtctttcccgatccggtgaaatcgattgaggggaaacgatcttcgggatctcctctaccttttctcttttggaatcatcggctaaaatcgtttggaaattcgtggattcgaggtcgaatcggatcggtctctttcctccgaaccccaaagtttccttctcgtcgccggtcgccgtgggccttcgccgccgcctccttgcccctataaaaggatccccggtgtctccgctacccgccgccaccctcgccttcgtctctcgccgtcggaagcgccctagccccgtgtaacctcgtgccgccgtcgtcgccgccgctccagccgtgcgtcgccgccgttccggtcgtcgtcgtcgctcggggaggtcaccatcgtggtcgccgtcgcgtcgccgtcctcgtccgcgtcttcgccgtcgctgtagaccgccggagcaccgccgtcgtcgtcaagccgaaggtctccgccgcttcgatctcgtcgccgccgccgtccgttcatcttccgccgacgttttggtcatcggtgagttcgccgcgtcgcgctctacgtcctggtgtcctccgttcgcatcgtcgcgccgtcgttcgccggcgagcttgcgcgcccgagccgccgagccgccgccggaggtgacgtcaccgctgacgtcatcgtggccgtctgccgtgagccgccgtagacccgatcgatctcggccgtccgttttggatggatcgatctcggccgttcgtttccgtgaaccgctgccgtgcgcccggtccaccgcaaaccctagccgctgacgcaataaaccccttttccttttcaaaaataattcattattgcgtcataattcaattaaaattcatataagtgttttaatccgatttaatctttaaaaattcataactaattcatcttagctcggatttagttggttcaagtctctaaatttttctaaaattgagatctatatgttaaaaatatttacatgtactgttcatgcttgtttatgtgctgtttggtgattttgctcttttctgtttagattccgatgtttccggagagtccgttttcgcaggagaagaatttgaagagttccaaggccagcaaggcaagtcacatagatcccatacaaccctttgagcatgttgatcccatttaaaactattgtttctattcaaacattgcatttattgtcgaatgtcattgggtggaattaacctattgtttgttatagccctttttgttcttgatcactttattccttgataccttgggttattataacttgactagttgggctatatatattggttcagctagatattagatgtaattacttagccatgcttagaaacattagcacactattgggataacttatgattcactagtatttaatgatggcttaatgatagttcacgatggtcaatcgtgattggttaattaattacttgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcgaagataagcccacggggtcgctggggagtccatgccttgtttataagggggtgattatggtccaggaaaggtgcgctgtggtggattgtgttgtgtgaggggtactgtcacagctcctttccgaggtaccgtggtggtattgaggcacatggtgacatgatgtggggttgtgtcttgtgggtactatggtacacctctgatcagagtaaaactattcgaatagccgtgcccgcggttatgggcgggtctaacaatgtctttcgtgattagtttcacacctctcatcataataaaagatgctataactggtaataatttgtttagctcctggtttggaatggtatattcctggtttggagatagaactgtgcagccgggttggttgttcagaatggttgggcctatgcaacagggtatgttgtatagtgttggtttaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtatgcgccgtttatcttatctttccgctgcttagatctttattgattgagaggaactatctacctctgtaatgacattttattcgcttattaattagagtaataattgtactctattatcaatttgttactgtgtgcctcggttgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccccttctcttttaattaaaccaaactaatagcacatgcacttcataatctcttttagtggttctcattcaaaaatttattccagtgttattagtactgtacatctattactgtactaatggctcgtttaccagcaaaagttttacaatattgttttatttaatcttgctgcaataaaataaatttagcatgttgattttataattttcttttatttcttttggaacctgttgttcaaaagtacacaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgtcataggatttgggactgcccctttttatgcccagattcctcatgatcgtcacgaagagaagtgccgagtcaaagtcaccttgaatagtaatagtgaagatatcccctcagtgatgttcgaagctggaggaagaaactacatccatgcatgttaggaggtggcaaggatcgccgtaggagagctccgcgatcgctacagtgatcagttggccgacactgattatcgctaccatcctcgtcaaccacagggaagtgaccgtggcagctaccttgagactgagggaattgagaatgatgctaccacaaggcatttggttgagatgctgtgggctatggatgaaacccgtgcggagactgtgttagcagctcaagatcgtgaagaccggaatcgtggtaagatttgcaagctagaggacaaggtggatcgtttggagaaggaactagccgcgttgaagggagaagcaccaccgcagaaggccagggttcgtcttaccgcaaggaagagagctctatttgtccctcgctaccaattggcgccaaaggtccgtgtggtggaaaaagaagttaccccagccctagcggatcctccggtcgtcaacgtaagtgatgatgaaggagaagaatccaagcgcacccattccaagatcgagtggggagccactcaagatgatgaagacgagccgaacgagccttcaatcaactccgatgcccggaagacttagaaagccttgtcaaaccgttgtcttagatcgttgtgttagtttgcttgctttaagtttggttgtgtgtgtctcgcatgtgatttacatcagtagagggatgtaagtgcatgcgtttgtttgctttcgagtgttaggtagttggtgagtttagtggtgtgagagtcttcagtttgtaataatgaaactcacttaagatcaataaaagttaaattaattctctgtcctaagtagttttccccggtttctcttcttgtgctcctgcccatgccagatggtgctcactcgcagcaacgggaatggccccaataacaacaataacaacaataacaacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcctactttctctagcactactaatcctgttgaagctggtgattggctgcatgccatagagaagaagttggatttgcttcagtgcaccgatcaggagaaggtctcatttgcatcacatcagctgcatggccctgcctctgagtggtgggatcactttcgccttaacaggactactgctgaacctatcacttggcttgaattcaccgttgctttccggaagacgcatataccatcgggagtggagtctctcaagaagaaggagttcaggtcgctcactcaggggtctcgctctgttaccgagtatctgcacgagttcaatcgtctggctcgttatgctccggaagatgtgcgcactgatgaagagcgccaggagaagttcttggaaggacttaatgatgagctttcttatccactcataactggggattatcctgatttccagaagttagtggataaggctattcgccaggaggacaagtacaatcgcatggaacagaagaaacgccttattgctcaattcaaggcacaacaggggaatagtcaaaggccgcgtcttactttaggaccccagtctatgccacagggaggttcttcgtcagttgttcatccgcagcgtcagttcttcaaccacaatgctggcaacaacatccgcaatcaagctccacaccctgttgtagcttcgacacagcaacaacctgccaagaaggagcaaggcagcaagcccgtggtgtgtttcaactgtggagactcaggacattatgctgacaagtgtccgaagcctcgacgcgtgaaggttgtccctacccagagcaactctaccgtaccagcatcaaaggcccgtgtcaatcatgttgctgctgcagaagctcaaggtgctccagatgtgattttgggtacgtttcttgttaacttagttcctgcaacagtgcttttcgattctggtgctacacattcattcctatctatgagttttgcgggaaatcatgggatggaagtagaagatcttagacgtcctttgatggttagtaccccaagtaatcaagcactctctttgcaacgtagcccctctgtcataatagaaattcaaggagtaccatttttggccaatcttatcttgttagaatccaaagaccttgatgtcatcctagggatggactggttagccagatataaaggtgtgatagactgtgctaacagaaaagtaactctcaccagtaatgatggtcgagttgtaactgttcatgcattgtcttctgagtctttaaggtcaagactgaaccaaatgactttgaaagagattcctatagtccgggagtatcccgatgtgttcccagacgatttacctggtaagccgcctaaaagagatattgaattagaatagaattggtaccagggacaactccgatccataagagaccttatagaatggcagccaatgagttggcagaagtcaagaggcaagtagacgatttgcttcagaaaggatacatcagaccaagttcatctccatggggagctccagttatttttgtggaaaagaaagatcatacccagaggatgtgtgtggactatcgtacactaaatgatgtgactatcaagaataagtacccgctgcccagaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtactgttatgtcttttggacttaccaatgcccccgctttcttcatgaacttgatgaataaggtgttcatggaatacctagacaagttcgtggtggtctttattgatgacattcttatctactctcgaaccaaagaagagcatgaagagcatcttcgccttgcactagagaagctacgagaacatcaactgtatgccaagtttagtaagtgtgaattttggttgtctgaagtgaagttccttggtcacgtcatctcagcaggaggagttgccgtcgatcctagtaatgtagaatccgtaaccaactggaaacaaccaaagacagtttcagagattcgcagtttcctaggcctcgcaggatattatcggaggtttatagagaatttttccaagattgctaagcccatgacacgattacttcaaaaagatgtgaagtacaagtggttagaagaatgtgagcagagttttcaagagttgaagaatcgcttaatatcagctcccattttgattttacctaatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaagatttggcgtcattatcttttcggtactcgtacagaggtgtataccgatcataagagtttaaaatatatctttactcagccggatctgaacatgagacaaaggagatggttggaattaattaaggattatgacatgggaattcattatcacccgggaaaggctaatgttgtagcggacgctcttagcaggaaaggctattgcaatgctacggaaggacgacaattgccattggagttatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggcttcttggaggatgagcaaggaactgtatggttgggtgagagaatctgcgtccccgacaacaaagatttaaaagatgtaattctgaaagaagctcatgatactttatactccattcaccctggtagtaccaaaatgtaccaggatctcaaggaaagattttggtgggcaagtatgaagcgtgaaatcgcagagtatgtcgcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtgatagtcgacagacttaccaaagtggctcatttcatcccagtaaagacaacctattccggaagtcggttggcggaattgtatatggccaggattgtgtgtttgcatggcgtccctaagaaaatagtgtctgatcgaggcagacagtttacttcaaagttttggaagaagcttcaggaagagatgggttctaagctgaactttagtaccgcttatcatccgcagacagatggacaaactgaaagggtgaatcagattttggaagacatgttaagagct

SEQ ID NO: 23239 - DNA, 11574 bp, Oryza sativa
accttatgcggaattctcgtacaacaacagttatcaagctagtcttcagatggctccttacgaagcactgtatggtcggaagtgccgcactccgcttttatgggatcaaacgggagaacgtcaggttttcgggacggatatcctgagggaagcagaagaaaaggtgaaaatcattcaagaaagattgtgtgtggcccagtctcgtcataagagttatgccgacaatcgccgcagagatttgagtttcgacgaaggagattatgtgtatcttcgtgtcacgccttttcgaggagttcatcgttttcacaccaaaggaaaattggcaccgcgttttgtgggaccttataagattgtcagtagaagagcaaaggttgcttatcagttggaattacctcaatctttggcaggagtccataatgtgttccatgtgtcgcaattgaagaagtgtttaagagtacctaccgaagaagctaatcttgaacagatagaagtccaagaggatctgacctatgtggagaaaccaatccgtatcttggaaatagatgagagaagaaccagaaatcgagttatccgtttttgcaaagtccaatggagtaatcactcggaagaagaatcaacttgggaacgagaagatgaattgaagtcagcccatccgcatctgttcgccagttcttccgaatctcgaggacgagattctgtttaaggggggtaggtttgtcacatcctaaaaatcctaaatttataaattgttgtttaattggaattattagaatttattttaaaagcctagaagagaagatctaattttaattaataaattccaatataaaatggggccagataaaatttcattaaataacttgcttaattctataattcctagatttttctgggatttatttgagctaaggaagtatttttaataaatggaattgcatttcatgaataatttaaattgaaaaaggtctttaaaagtctcttttggctttgggccgaaagtcggcccaaaacccctttctctctctccctcggcccagtcggcccagtccagcagcagccgccgctcgcgcgcgcgcgtccgtccgctgacaggtggggcccacctgtcagtcttcgtctacctccggtcgccgccgccagaaaccctagcgccgcgccgccgccgccgctttccaaattcggccgcgtctttcccgatccggtgaaatcgattgaggggaaacgatcttcgggatctcctctaccttttctcttttggaatcatcggctaaaatcgtttggaaattcgtggattcgaggtcgaatcggatcggtctctttcctccgaaccccaaagtttccttctcgtcgccggtcgccgtgggccttcgccgccgcctccttgcccctataaaaggaaccccggtgtctccgctacccgccgccaccctcgccttcgtctctcgccgtcggaagcgccctagccccgtgtaacctcgtgccgccgtcgtcgccgccgctccagccgtgcgtcgccgccgttccggtcgtcgtcgtcgctcggggaggtcgccatcgtggtcgccgtcgcgtcgccgtcctcgtccgcctcttcgccgtcgctgtagaccgccgtcgtcaagccgaaggtctccgccacttcgatctcgtcgccgccgccgtccgttcatcttccgccgacgttttggtcatcggtgagttcgccgcgtcgcgctctacgtcctggtatcctccgttcgcgtcgtcgcgccgtcattcgccggcgagcttgcacgctgtcacaccctaaaaatcctaaatatataaattattgtttaaatggaattttttttagaaattattttaaaagtctagaagagaagatctaatttttaattaataaattccgatataaaatggggccagataaaatttcattaaatactttgcttaattctataattcctagatttttctaggatttatttgagctaaggaagtatttttaataaatggaattgcattttatgaataatttaaattgaaaaaggtttttaaaagtcttcttttggctttgggcggcccaaaaccctctctctctctccccggcccaagtcggcccagttcacagccgccactcgcgcgcgcgttcccgtcgctgacaggtggggctcgcctgtcggagtcgtcttcctcctccggccgccgccgcccgaaaccctagcgccgcgccgccgtcgtctccttccaaattcggccgcgcctttccttctccggtgaaatcaattgtggggaaacaatcttcgggatctcctctaccttttctcttttggaatcatcggctaaaatcgtttggaaattcgtggattcgaggtcgaatcggatcggtctctttcctccgaaccccgatgtttccttcgcgtcgccggtcgccgtgggccttcgccgccgccctccaacccctatataagaacccccggtgtctcctctacccgccgccaccctcgccttcgtctctcgccgtcggaagagctctagcgccgtgtgacctagcgccgccgtcgtcgccgtcgctccagccgtgcttcgccgtcgttccggtcgtcgtcgtcgctcggggagatcgccatcatggtcgccgtcgcgtcgccgtcctcgtccgccacttcgccgtcgctgaagaccgccggagcaccgccgtcgtcgtcaagccgaagaccgtcgccaccgccgtccgttgcttctccgccgcttctttggtcaccggtgagttcgccgcgtcgcgctctacgtcctggtgccttccgttcgcctcctcgcgccgtcgttcgccggcgagcttgcgccgtccgagctgccgagccgccgagccgccgccggtggtgacgtcatcgccgacgtcatcggggccgtctgccgtgagccgccgtagacccgatcgatctcggccgttcgttttggataagatcgatctcggccgtccgttcccgtgaaccgctgccgtgcacccggtcgaccgctaaccctagccgctgacgcaataattcccttttccttttcaaaaataattcattattgcgtcataattcaattaaaatccatataagtgttttaatccgatttaatctttacaaattcataactaattcatcttagctcggatttagttggttcaagtctctaaatttttctaaaattgagatctacatgttaaaaatatccacatgtactgttcatgcctgtttatgtgctgttttggtgtttttgctcttttctgtttagattccgacgtttccggagagtccgttttcgcagaagaagaatttgaagagttccaaggccagcaaggcaagtcacacagatcccaaacaaccctttgagcatgttgatcccgtttaaagctactgtttctagtcaactattgcatttattttcgaatgtcattgggtggaattaacctattgtttgttatagccctttttgattttgattactttattccttgataccttgggttattataacttgactagttgggctatatatatattggttcaactagatattagatatgattgcttagccatgcttagaaacattagcacactattgggataactcatgattcactattaattaattaatgatggcttaatgatagttcacgatggtcaatcgtgattggttaattaattacttgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagtacagtttattgcggggcaccagactgaaaagtggcggagataagcccacggggccagactgagaagtggcagagataagcccacgggggtcgctggggagtccatgccttgttataagggggtgattatgatgcaggaatggtgcgctgcggtggattgtgttaagcaaggggtattgtcacatctcctttccgaggtaccgtggtggtattgaggcacatggtgacatgatgtggggctgtgtcttgtgggtacagtggtacacttctgatcagagtaaaactattcgaatagccgtgcccgcggttatgggcgggtctgacaatgtctttcgtgattagtctcacacctctcatcataataaaagatgctataactggtaataatttgtttagctcctagtttggaatggtatattcctggtttggagatagatctgtacagccgggtatggttgttcagaatggttgggcctatacaacagggtatgttgtatagcgttggattaatattgtttaaatattacttaactgttttattaaattctcaaatgtttgctaaatgctgtttatgcaaatggaaccctattatgccatcctttgttatcctgtgcacttgcatatttgctgcgtgacttgctgagtatgtcatatactcaccttgcaatcattcatcagaggaagagttctacaatgatgctgatggtatggaggattaggtgtagccctggtcaagctgcctgtggagtggagtcgtttgcgccgtttatctttttttttccgctgcttagatctttattgattgagaggaactatctacctctgtaatgacattttattcgctttttaattagagtaataattgtactctattatcaatttgttattgtgtgcctcggttgatttctggacgagggttcacacacatgtaagcgtttggaattttggatagaaattcagggcgtgacacgcgcccgagccgccgagccgccgccggaggtgacgtcaccgctgacgtcatcgtggccgtctgtcgtgagccgccgtagacccgatcgatctcggccctccgttttggatggatcgatctcggcagttcgtttccgtgaaccgctgccgtgcgcccggtccaccgcaaaccctagccgctgacgcaatagaccccttttccttttcaaaaataattcattattgcgtcataattcaattaaaattcatataagtgttttaatccgatttaatctttaaaaattcataactaattcatcttagcacggatttagttggttcaagtctctaaatttttctaaaattgagatctacatgttaaaaatatctacatgtactgttcatgcttatttatgtgctgtttggtgattttgctcttttctgtttagattccgacgtttccggagagtccgttttcgcagcagattcaggatttgttcccaatggcgagtttgaagtatggtctacctcttctggatcaagggtgttatggattatagtccaagtgactatttggcgcacattgattttatcatcatgaggttgtttagaggttgaagatttttatgctacaagggaaattcgtctcaagatggagattgttaaatatgtgatctgaattttgggcccacaatatattcggattagttatctaataggactctactttatagaattagtttcctattaggactcctagatttctcctatatatatcacttgtaagccgcacggagagggtacgacagcccaatgtatcccctgcgtttgtatccaattcctctataatgatcattgccggtcggtgcccgtggttttttcccgcaagggttttccatgtctccgttgtgcatctattttcataacacgaccgatagcccggccttaatttaccgtatcgatgatccgttctctaaaggaagttacagtgatgaggcggtttctactggtatttttatatataaaagggcattttatctttaggataaacagggatacaattgctttcgctcagaatagcttgggtcaccctggaggcctggactgacaggcatattagcttagatgaagcaaacaacactcctttcgctttatatctttttctttatgcatgctctttaattaaggagggcccagcagcgatcagtggcagtccaagcaacgaatctgatgattattgatggagcgcacagcttgggagatagtatatcgatttgggacacttttgccgaaaagcacattaccaaagcaaacggaaggaataatagaccaagcatgtaatgcacgcattctatgtaggcttctgctagctccatcagctctccccaaacatcatcttgcattcagttcttcgatcgtttcattttgtatgctcccatgatgcgtgcaagcatggcttagtttgttcactcccggccgcccagttttctcaacatcgtgatcaaggtaagctacatgaatgcagcttgctttctcaacatccatagttttatatatgtacaaataatcaacacagtgatatataagagtcttatatatctctctggagttttggttctcaacgagctagcaagggacattcttgaatgcatgtttcaatatactccagttaatttgtatttagttttatatcatcaatttatattcatatagaatcattgattaattaaattaaaagaacatattctagattttgtaacgtacgtgcgattcaaagaacatcgactgatcaagatatgatggagctgctcgcctagactgtaattcaacaattgaagatccagctagctagcaagagatccaggcaacagatcgactcatcatgccagcggatgaggtatatatttcactccgtgccaatgtgccattatatttttttctcttttcattttgaatggaaattattcagcgaccatgcatgcaaaatttggcattccctctgtttcatattataagactttctagcattgctcacattcatatatataaatgctaatgaatctaaacacatatatatgtctagatttattagcatatatatgaatattgacaatgttagaaagtcttataatatgaaacggagaaaagtatatattagctaggcaggcatgtatgcatccaatttggatgctattaatttgttcaaacacactttcattaattcattacatatatatggggtatattttaatttagacccaggagtgtcattaatttattcagtttggtggtcttctctataacttcactggttttcaaatagaagtccggcaaaatctttttgtattttcgattacatatatatgacttatagtacataactcaaaatatatttactagcttatatagccacacacccccacgcaggccatatataacaaacttgcccatatctaactccacgacccaaactaaactttcagctgcatggacacacatgcacacttgctaattactacctccgtattttaatttatgacgccgttgacttttttatccatcgtttgaccatttgtcttattcaaaagaattatgtaattatcatttattttattgtgacttgattcatcatcaaatgttctttaaatataacatctactgacacacttcacgccacgagactcacttcacttgacacatctactgcatgcaggcacttacatacaactcatggctttcactgatatcacactaattaactcacacatgcacgcactgtcgtgctcctagcacacacgcacacgagacttagtatatataactcaaaccaaaagatcacttaaacaacaacgagattaaaccataacactagctaattaactatactatagtacgtatcattaatttgaaagttttccaccaaaaaactgtcagaagtacggtgatctatttcaaggccggaggatatggattggggtcatccgccgtcctcaaagaggtggccaaacgactgagatggtcgtctgtaccggagaagctgaagctggggttggacaagatcatccacgttgattgctctctgtggcagagcaagagggccctgcagaaggccatcgcccaggagctgaagcttcctcggtgggtgatggccgtgtttgatcagcgtgacgaggaggatgatttcgatggcgtggagcacggtgccagaggggtgataccagatgtcactgaggcgattcttaatgagcttgccggtcacacatgcctagtgatcttccacaacgggagcggcggctacatagatgtgcaggagtgcggtgttcctgcaataatgggactctcgagcaaaagggtactgtggacatcccaggtcaggtttgggccctggatcgggtccgatttgcagaagattgccggattgagcgatgtcgctatgtttgctaatccttttaatgttcaacccctgctgcatgaagaggctgaggaggttgctaggtccactggtgtcccaaaacctggcatgagccctgagattgtcaaggagtgcatcatgtactacaaggtggtgagactgttagatggaaaccatggtattgactaggccacccacgcggctaactactgggtatgcagcgggatcatacgatccgctggtaatacgtcagcatgggagattgcccaagctttgcataccaacctgagattggattggaatgacaatcagaataataatgaaagaaaactagctacactacaagtgccatgtgattctgtaaaggcatcattcttctggatggaagcaaccggaagatgtaaagaatcactagaggatggaatgtcccaacattcatctgtagacaggttgcgtgtgataaatctctcccagtgtacatttagttttacatctccgcccttcctcggttgtagcagcctaagattcctcctacttgaccgttgcaaagacaaagacaagctctgctcaggctcaacaccaaatagtactagtgctggagatactgacaaggagactggtattagtagtggagcatgtttccagaagctatgggtgcttgacctgagttacacagattggtattggctgctatcagtagaggcacaagatctgatggttgagcttagggagctaaatgtgaagggggtcaagcattggagcataaaccatctactccgtgatggtaacaattctagtgctggtgtcggaagcagcaccaagccccttgggctactcaaccttgtcaagctccaagtcacaaccgaaccaataactgaagatcaacatcagtcacaagtatggaaggaagatcaggtagcagcaacattattcccgaacctgtctagctgcaaaatcgtaaagacgatcattcttgatggttgttttgagttgacgcgaattgaccctcatgacctaccgccatcactcgagtcatttagcttctctagcagcagcaatgacaatgatgttgatgtcacagccaagatagagagcatctccttccgaggatgcacccagttgaagagtgtgcttttgagaggagtgtttgagaggctcaagcaactcgacgtctcaggcacttgtattaaaaccctcgacctacgttcaatgcgaggcaactggtctctcaaggagctcctactgcttggatgcaaggagcttcgtgcaatactatggccaacacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcgtcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcgactccacgatccagcacttgcaactacaagcaaccatgaacggcaactggatgtggccatgtaaatcggagggcagcacctctcactacattagcttacaagatgataagaggatgcagacgaaaccattgtcgtcgccatctttgccaggttccatctgtgaaagagcttcaggcctgcacgtgcatgacagcttgtctatcgcaagtatcacaagccattcagataaggcacggagatggaataacctagagtggtgcagagtggagagatgccctaacattgaaggcgttgtattcactccacctagtaccggtagtgacacaattttctgtcttctgaggacattctgggcatcccaactagcaagggcgcgccacatctgggactggggcacaaggggccagctgcattttgagcctgaagatgggtcattcgacctgcaggtgctacacctagattgctgccccaggttgatatatgtgcttcccttatattacaacagtctttcctatgcatactgtgtgttggaaacccttgagattgtgtgctgtggtgacctcaaggatgtcttccgagtggatgataataatcaagagcttctggtggcaactatagaattctcagagctgaagcacatccacctgcacgagctgccctctctacaacgcatctgcgggcataggattgtggcgcccaagctggagaccatcaaaatccgaggctgctggagcctcacccgcctaccggctgttggtctcgacagtacccacaagcccaaggtggattgtgagaaggaatggtgggatggactggagtgggacgggttggagaacggacaccatccttccctctttgagcccacccactcacgctactacaagaagaacctgcctagaggttccatgctcaggtacgtacgtatgtgatatgtctgtatggatgaataattattacttgggtttcattccttgcacgcacatacatacattcatagaaacacataaagctcattactttacttactccatcatgtatatatatgatcgagcattttcctttttcttaattttgtctgacttggcgtgctttcttttcttgctaattttaggtgatcgatatatacgtccatacactacatatttgatacagtaatcatctacgtgtcattccctttccatcatccaatggctcaaaatcttcagatcgatctatctctattatatatgtccttacttgggctggtgttcaatgtgctcgctcatttcatcatatcatttgcaacggcagcaatatctaatgcatgatgagtaagtacatctcccgccggcgaccagacgctcgtcatctgcttgttactagcttggattttgttcatttctgcttcttgtttttttgtgtgaaaattaataaatggatgctcagctggtgtgtgagctcatctatctgctaagttattttctccatacatgcttgctttccgtttggtcggttggtcgatctgcttgttcgaccgatccatccatcggattactacgtatgcttcatctttccggatagatgatcatacatgcatatgaaaactttgatctctagctccatttctggtgtggtgtgctagctagagatcgacgaataaatcatcagcttcagcggcatgagcagattcattgggtgatcctcatgcagtcgagttgctgttgtgcacttgtttgtgggtgcgtgtgtgttcgtgtgatttg

SEQ ID NO: 23240 - DNA, 885 bp, Oryza sativa
ggaaagggaatgatacgtagatgattacagtatcaaatatgtagtgtatggacgtatatatcgatcacctgaatttaagaagaaaagaaagcacgccaagtcagacaaaattaaaaaaaaaagggaaaagctcgatcatatatatatatatatatatatgatggagtaactaaagtactgagctatataagtttctacgtatgtatgtatgtgcgcgcaaggaatgatacccaagtaacaatcatgtatgcacacagacatatgtacatacctgagcatggaacctctgggcagtttcttcttgtagtagcgtgagtgggtgggcacatagagggaaggatggtgtccgttctccaacccatcccactgcaggccatcccaccattccttctcgcaatccaccttgggcttgcgggtactgtcaagaccaacagccggtaggcgggtgaggctccagcagcctcggattttgatggtctcgagcttgggggccacaatcctatgcccgcagatgcgttgcagagagggcagctcgtgcaggtggatgtgcttcagctcttgaaattttatagtttttagaagctcttgattattatcatccactcggaagacatccttgaggtcaccacaacacacgatctcaagggtttccaacgcacagtatgcataggaaggactgttgtcatataagggaagcacatatatcaacctggggcagcaatttaggtgtagcactttcaaccagaatgacgaatctgcaggctcaaaatgtatctggcccgttgtgctccagtcccagatgtggcgcgcccttgctagttgggatgcccagaatgtctttaggtaccagaaaatgctgttactaccagtactaggtggagtgaa

SEQ ID NO: 23241 - DNA, 15393 bp, Oryza sativa
gcaatgtccggttctgttcaggtgaattcaaattcacattcaattgctatggtttcacaaagccaagtctaccaggaggttctatacggagatcaaatacttcgttttatttaatgcacctagagcgtttcgcgtttttgctagggtttcacaatttataccagcagattcaggattttattcccaaggcgagtttgaagtttaatctaccgctcctggattgagatgcaatattctcgttatggcaagtgaagatgcaagttggcgtagccatcgaggaggagaagcaagtattgctgtacaccggagaggaaaaaaaaaggcaacacattcaagtcgtcgagagggagcctcgctcctgtctagatcacaaggtgatcaaattgtccggcgaattttgctaccatcatgcctaacacaccggaaggttaataaggagatctaagtactttgttttatgcacagcgttttgcgtttctgttaggattccagaaattaataccagcagattcaggatgttattcccatggcgagtttgaagtttgtgcatcagtttcgcgtctctgctgggttccacgatgtcataccagcagattcaggatttgttcccaatggcgagtttgaagtatggtctacctcttctggatcaagggtgttatggattatagtccaagtgactatttggcgcacattgattttatcatcatgaggttgtttagaggttgaagatttttatgctacaagggaaattcgtctcaaggtggagattgttaaatatgtgatctgaattttgggcccacaatatattcggattagttatgtaataggactctactttataggattagtttcctattaggactcctagatttctcctatatatatcacttgtaagccgcacggagagggtgcgacagcccaatgtatcccctgcgtttgtatccgattcctctataatgatcattgccggtcggtgcccgtggttttttcccgcaagggttttccatgtctccgttgtgcatctattttcataacacgaccgatagcccggccttaatttaccgtatcgatgattcgttctctaaaggaagttacagtgatgaggcggtttctactggtatctttatatataaaagggcatttatctttaggataaacagggatacaatgctttcgctcagaatagcttgggtcaccctggaggcctggactgacaggcatattagcttagatgaagcaaacaacactcctttcgctttatatctttttctttatgcatgctctttaattaaggagggcccagcagcgatcagtggcagtccaagcaacgaatctgatgattattgatggagcgcacagcttgggagatagtatatcgatttgggacacttttgccgaaaagcacattaccaaagcaaacgaccaagcatgtaatgcacgcattctatgtaggcttctgctagctccatcagctctccccaaacatcatcttgcattcagttcttcgatcgtttcattttgtatgctcccatgatgcgtgcaagcatggcttagtttgttcactcccggccgcccagttttctcaacatcgtgatcaaggtaagctacatgaatgcagcttgctttctcaacatccatagttttatatatgtacaaataatcaacacagtgatatataagagtcttatatatctctctggagttttggttttcaacgagctagcaagggacattcttgaatgcatgtttcaatatactccagctaatttgtatttagttttatatcatcaatttatattcatatagaatcattgattaattaaattaaaagaacatattctagattttgtaacgtacgtgcgattcaaagaacatcgactgatcaagatatgatggagctgctcgcctagactgtaattcaacaattgaagatccagctagctagcaagagatccaggcaacagatcgactcatcatgccagcggatgaggtatatatttcactccgtgccaatgtgccattatatttttttctcttttcattttgaatggaaattattcagcgaccatgcatgcaaaatttggcattccctctgtttcatattataagactttctagcattgctcacattcatatatataaatgctaatgaatatatgtctagatttattagcatatatatgaatattggcaatgttagaaagtcttataatatgaaacggagaaaagtatatattagctaggcaggcatgtatgcatccaatttggatgctattaatttgttcaaacacactttcattaattcattacatatatatggggtatattttaatttagacccaggagtgtcattaatttattcagtttggtggtcttctctataacttcactggttttcaaatagaagtccggcaaaatctttttgtattttcgattacatatatatgacttatagtacataactcaaaatatatttactagcttatatagccacacacccccacgcaggccatatataacaaacttgcccatatctaactccacgacccaaactaaactttcagctgcatggacacacatgcacacttgctaattactacctccgtattttaatttatgacgccgttgacttttttatccatcgtttgaccatttgtcttattcaaaaaaaattatgtaattatcatttattttattgtgacttgattcatcatcaaatgttctttaagtataatatctactgacacacttcacgccacgagactcactttacttgacacatctactgcatgcaggcacttacatacaactcatggctttcactgatatcacactaattaactcacacatgcacgcactgtcgtgctcctagcacacacgcacacgagacttagtatatataactcaaaccaaaagatcacttaaacaacaacgagattaaaccttaacactagctaattaactatactatagtacgtatcattaatttgaaagttttccacccaaaaactgtcaaaagttgtaaagacactccctgtatatgtagtaccgaatttaactagctagctcaacgctcagagaaaacgatatataattggtgtatctctacgtaccaaaaaacagcaagcatatatacagtagaaggcgaagcttagctaggtttgtctgattaattatattattaattagtacttattaattgcagtggacgaggatcgtagcaggcagcatcgatgaagcagcaaagaagataatcgatttcctggacgatacgagcaacaacagaagtacggtgatctattttgaggcctgcagaggattggggtcatcggccgtcctcaaagaggtggccaaacgactgagatcgtcgtcaccggagaagctgaagctgaagctgaggttggacaagatcatccacgtcgattgctctctgtggcagagcaagagggccctgcagaaggccatcgcccaggagctggagcttcctcggtcggtgatggccatgtttgatcagcgtgacaaggaggatgatctcgacggcgtggaccacggtgccagaggagtgataccgcacatagatgtgcaggagtgcggtgttcctataaatatgggactctcaggcaaaagggtactgtggacatcccaggtcaggtttgggccttggatgatcacaggcgatgtgcacatggttgccggaccgagcgatgtcgctatgtttgctgatcctatggatgatcaacccctgctgcatgaagaggctgaggaggttgctaggtccactggtgtcccaaaacctggcatgagccctgagattgtcaaggagtgcatcatgtactacaaggtggtgaggctgttagatggaaaccatggcattgactgggccacccacgcggctaactactgggtatgcagcgggatcatacgatccgttggtaatacgtcagcatgggagattgcccaagctttgcataccaacctgagattggattgggatgatagtctgaataataataaggaaaaactagatccactacaagtgccttgtgattctgtaaaggcatcattcttctgggctacatctcacagcaacaaggaagcaactacaagctgtaaagaatcactggaggccagaatgttccaacattcatctgtagacaggctgcgtgtgataaatctctcccagtgtacattcagttttacatctccacccttcctcggttgtagcagcctaagattcctcctacttgaccgttgcaaagacaaagacaagctctgctcaggctcatcaccaaatagtactagtgctggagacactgaaaaggagactagtattagcagtggagcatgtttccagaagctatgggtgcttgacctgagttacacagactggtattggctgctatcagtagaggcacaagatctaatggttgagcttagggagctaaatgtgaagggggtcaagcattggagcataagccatctactccgtgatgacaacaattctagtactggtgtcggaagcagcaccaagccccttgggctactcaaccttgtcaagctccaagtcgcgaccgaaccaataactgaagttcaacatcagtcacaagtattgcagcaagatcaagtagcagtaacattattcccgaacctgtctagctgcaaaatcatcaagacaatcattctggatggttgttttgagttgacgcgaattgaccctcatgacctaccgccatcactcgagtcatttagcttctctagcagcagcaatgacaatgatgttgatgtcacagccaagatagagagcatctccttccgaggatgcacccagttgaagagtgtgcttttgagaggagtgtttgagaggctcaagcaactcgacgtctcaggcacttgtattaaaaccctcgacctacgttcaatgcgaggcaactggtctctcaaggagctcctactgcttggatgcaaggagcttcgtgcaatactatggccaaaacaagatgtatcattggaggttctgcacatcgacactagtagcacagaacttgatcatgctacaggtgtagaagaatcatcatcattctcacctgttgaatttaaatggtatatttcagtgagggacagaaggctccttcgctcgctaaatgatacaaaatatcccttggatgcaccatgcatcgagatctcatcccctcctgctagtgttgctactgctactactgatggttctgaattaggcggaacaataagcaagagaaggcccattgccgttagcagggctgaacaacgttggttgatgtcgaccaaaagccgacgaccagctgctgacaacaagaagttatatgcggatgtcaactccacgatccagcacttgcaactacaagcaaccatgaatggcaactggatgtggccttataaacaggagggcagcacctctcactacattagcttacaagatgataagaggatgcagacgaaaccattatcgtcgccatctttgccaggttccatctgtgaaagagcttcaggcctgcacgtgcatgacagcttgtctatcgcaagtatcacaagccattcaaatggggcacggagatggaataatctagagtggtgcagagtggagagatgccctaacattgaaggtgttgttttcactccacctagtcctgttggtggcataactttcttgtacctgaagacattctgggcaacccaactagcaagggcacgccacatctgggactggggcaaaaggggcctgctgcacaaggggccagttccattcaacctgcaagtgctacacctagattgctgccccaggttgatatatgtgttttccataaatgacaacagagcttcctatgcataccgttggttggaaacccttgagatcgtgtgttgtggtgacctcaagtatgtcctccgagtgtatgataataatcaagagcttctggtggcaactatagaattctcagagctgaagcacatccacctgcacgagctgccctctctgcaacgcatctgcgggcataggattgtggcgcccaagctcgagaccatcaaaatccgaggctgctggagcctcaccagcctaccggctgttgggcttgacagtacccgcaagcccaaggtggattgcgagaaggaatggtgggatggcctgcagtgggatgggttggagaacggacaccatccttccctctatgtgcccacccactcacgctactacaagaagaaactgcccagaggttccatgctcaggtatgtacatatgtctgtgtgcatacatgattattacttgggtatcagtccttgcgcgcacatacatacatacgtagaaacttatatagctcagtactttagttactccatcatatatatatatatatatatatatatatatatatgatcgatcttttccctttttttttaattttgtctgacttggcgtgctttcttttcttcttaaattcaggtgatcgatatatacgtccatacactacatatatgatactgtaatcatctacgtatcattccctttccctcatccagtggctcatcaagttcttcagctctatctctattatatatgtccttatttggggctagtgttcaaagtgcttgctcatttcatcatatcatttgcaacggcatcaatatctaatgcatgatgagtaagtacatctccggccggcatccagacgctcgtcatctgcttgttactagcttggattctgttcatttctgcttcttttgttctgtgtgaaaattaataaatggatgctcagctgccagctggtgtgtgagctctgcatctatctgctaagttattttctccatacatgcttgctttccgtttggccggttagtcgatctgcttgttcgaccgatccatccatcggattactacgtatgcttcatctttctggatagatgatcatacatgtatatgtgaaaactttgatctctagcaccgttctggtgtggtgtgcttcctagaggtcgacgaataaatcatcagcttcagcggcatgagaagatccattgggtgatcctcgtgcagccgagttgctgttgtgcacttgtttgtgggtgtgtgtgtgttcgtgtgatttgtcagcatatgtggactgaccgagtttgtactcctaattacttcacttgtatgaacagaaacaatgatgatgattgtgagtgtgacatatattttctatgctgcaaatgtatgtattagttgctctgtcattttgaaggtattgtatattttgctctgcactccacagtcaacacatgatatgcctgtgtaaattttctttaacaaacactccttatcaaatccgcatttcttttgttagtttattctctgcttcaaaatgtgcaaagggagaagcacaagattttttttaagcctcaggtctgactgatttgatcaatgaattaagatgcatttcaaccaaattagcagtcaccattagtaattgtgttttgtacttgtgcagtgatatgatactctgttttgaagtgaaaccttctgcaatattgcagtggagagtggcatgcagtaagatttggggtgtatcccaggtgttagtgtttgctgggcctgtatgaatacacacattaggcccattttggcagacagctgcacctattaaaaatacaatccataactagcgaaatacaagagcaaaaatacagtcctttttccaattcagtgcttactcaagaaaacctcaaactagatttccagtcttcatttttccctgtttatcctaattttgtagctacaattaattcaagatacaggagattaaagaacttggacttaaaaaataatggtgacacagtagcaccttaatttccttctagtttcagaagggacaatttcctttgattcaactatatccaaaacaggcttcaaattacatccagttctacatccttgctttgcaggaaacattggatcttgctagagaagccattagttatacgagtagaagcagcaggtcgagaagcttggcaacatgtaggctgcaccctgcattttctttcataagtgatggttgatgcaatgcaaatcctagtcttgctaggagattacaggaaagctaggtgatctgatctgagcaaattcgcacagttttgccagccatttgttgcattagttagagatccatctgatccatatacgcattacgattaattgtgttacagaacgtatttaaaaatactgatcgatgcatgtgtcctactagtatatatgtacggcaagacaaaagcatgcaggatcatgagttggacaaggagcaggtgaaccgacattatttacctttttctttgcgggtgggccccacgcagcagcctatgttgctcgctgagctgttaaatttacattgtgtgtccaatgccattgttaaacatctacttccttcgtcccaaaataaaacaacttttatatatatatatatatacacaaattcatgcataaatgttaatttgtttaagtttggaaaggaataccctcaaaaaagtttagaaaggattgagaagatcgctagagtaaaatgcaaacatgagagtgcagcgagattatacaaattatatatggtggtactattgaataaactttttgttgtaattgttaaacttccatgtggaactataaagattgctttgggaaaaaaatgcgaatattaggaaggaccaaatatcaaataaatagaagggatgagtcttcgaactcaggccggctagctcaccaccatgtggagctggccggagtacccctgggcttttctctaaagattgctttggttctaaagataaatgcagaaatgtatgaaataagctctttttatgttttctaaagaagagggaaataatatcatatcattggttaaaaaatgttaagagacacaaagaaaaataaataagattagctagaatcggaataattaacatatcataattgtagttctattttagaagagagaaggaacctcacactattgtgtaacaaaactgtacaaaataacaagcccccttgagtaatatttaacaaatacagcatgtataccaactcaaaagaggacatgtgtataattaatataacatgatatatatagttgaagacaccatcagaaatgctaagcctagatatatactactctagctaggctctagctagctcatacatatcaattaatataaaaatattatattaaagatatatagttaatttgcaagcatatgcatgacgcaaatggcacgtttaattaatactatttgtcaaaactgcatcaagtggaaacaatagcgcacatgattccatttgaaacttagccatgtcttcatgtttggcagtgctaaccgagaacacaacaatgcatcttctacatatttcacctaatagttaacacactgacaacttcatgaagctttcaccgaaaatatttgagatagatcacgtgtcacaggccggctcaataacatggtacaacttagattgggagtataattaaaatgggcatagctaggaaggcaacagcatagaacattgacaacataatgatcatgcatgtattaagacattgacccactctggcaaaatctagtctaataaaaaactcacaaggttaattagaacattcagagatggatctcatcatgtcctgatggtatacttgtaaatgcaagtcgctttaatcatacaaggatggattttaaaaaaataaactcttccaaaacttatttctaaacatgaaccttttggcatggcgagacaacaataccatgtgcaacccatcatggcgtgacagtgttgtttcacctaagtggggtggtgtgaccaaaaggtttggattagaaataagttttggaatagtttacttttgaaatgaaaaaataaaaggttcaaaagaaataataaagaatcaaaaggatgtgataagaaaataactcaaatcaattaattagttgctctttatttatgctacattgaaagaaatgagtttttttttaaaggaaaacaaataaaacagatgaaaatgtgttataaatttagggaagaatttaaaagcaaagatgacgacttattttcagttagcaactactccactatagctctaggtgaattggagagctactagctagggatctttgacttttgccttctgtttggttaatttcaactttcaagtatcatcattgcgggacgttgactttctaatcctagtgagcaatcaaactttgataatcgtgtcacattaactaaatgagacccatttaagtttaacaaacaagcgttttgacatagtaaagtaattgctgattatcaatggcaaccccttctcatgtaacatccacgattttcggagctcaaggatttgtctcagctagggatggcaatttcccccgtggggccgggtcccctacgggggcgggggcgggttcagtttttgacccgcgggggaggtggggccgggggcccgcatttttgtggggaggggacaggtgaggcatttcacccgtggggtgccgaagggtgtatattaaatctcaaaatgtagcccatagaagatctaaaagagccacaaaattttaagtaatagccttatcctctccactctccccatctcccctcccctcactctcactacacaggcggaggcggcggcggcgccaccgcgccgaagaagaacaatgtccaagggcatttcggtactttcaatgctctttttctctctgttttcaccggaaataataaaataatgcatcaggtgtctagcagctaattaccatatttttgcaatgtccacaagaagatacatgttctttgggtgtctcacagcaaatgtcacaaactttgagtatcctatagcaaaatttgcatttgatttagtacaaacctaagggcttattctgaatgcaggaatgcaaattcatagtaccaattcctccaaactgaatgaatgaagtactcaaatcctataggaattgaatcctcaaattgttctctacaatttgtagaagccctaaaataacttaggccgtgtttagttcggtgccaatttttttttacgtatacggacacatatttgaagtattaaacgtagactaataacaaaacaaattatagattccgactgtaaactgcgagacgaatcttttgagcctaattaatctgtcattagcaaatgtgggttactgtagcacttatggctaatcatggcgtaattaggctcaaaagattcgtctcgcaatttacatgcaaactgtacaattagtttttttttccatatttaatactccatgcatgtggccaaacatttgatgtgacggaaaagttggaagttaatttgaagaaaaaagttagaatcgaaacacatgcttagtatgaaagagtgagaatgaactaaccgtacaagtaaatttgcaagtcaagtcaccacaaaaattaacctctagcaatcattgatctgatccaacatggaaaaggtgaagacaaccatgtgtggttgacttttttaacatatgacagatgataaaatttggtcaaaagttagcagcaaacgtacccacatccatatatgcatgcatgcatcacatcttgcaaaggtgagattctatctgtctctcgatctgcatgaatccatggatacatgtctgattgatctgatcatgcatcacagttgagaagaagctaagctaggtccaccaatactgttaagtgactagttaagcaaacaagatggtgatgtgcattgcccaactaatgcaatcacaaaagaaatttcatgtacatatgaacatatgatgtcaaagttataccttcaccaattagttgatgcgtcaaatggtattggattacgtatacgtatcttggcaaataatagttgcaaattggaataatacgacgacatagtatgaatctatgattaaacgtacatcgaatgaagaagcatcaacctgaatgaatgattagttgaagaagcgtgtagatcgaagatttgtctaatcaagtggcttaattatttgtccatatatacaacactacaatacaaacagatactacactggaacagcaactagacaaaaattaagttcatctctccctcaaaatgcatttaatttatacatttatatgatgttgaaattgctggacgattatgctaatacaaaaggttgatacaattaattgattttgagtgttgtttgctgcttcactcggggacaacacggtagatgacgacgaagcacggcagtatggcccttgggttcgccacgaacagctcctccaggttgccgtacacgctgctcgccgcctcgtcgccggccaccgagtcgaacgctccctcctcctcctccgcaccgccatcgtcgtcgttccggcggacacggccggcgattacgcggcacaccagcattgcccggcacccgcccgcctgctgcgccgccgccgccgccgcgccgcagtcgtgcgcgcggccgctgctcgccgtggtgcgcacgccgagcgggtgcgcgcccgcccacggcgcgaacccgtgccggatcgccgcgcacacgccgcaggcgtcgtcgtcgtcgcagagcgaggtggcgccgttgaggccgagcgggcaggcgagggcggcggggtggaagcggaggagctcgttgccgtcggcggcggcgcgggcggcggtggcgcggcagcgggtgcggacggcgtcgcggtaggcctcgaagcgcgccacggtgcgcgccgcgttgtgcaccttgaggatgcggtcgatctggcagatcggacggtcgcgcttctgccagctcgacttgaagattatctccacgatgtttcgccccgagtcctccggccccagctccgacactgcatatgcattgcatgcactccaaaattaatcactcgctaatcctccagggagcaagctaattaattggatctaccgtaatgtaatgtaattagtggagagattaaccacgcacagctagctagctaagtgcattaaatgcagtgagtgcatcagcatgtgcaagctaagctcacagttatcatagcagacagtgtgcaatcaaggcactgaaattcaggagatcagtacttcatctcggccgcatcaacaacaataatggcattgcaaatagtgcagcactgtcatgtgataggacacttcaattgacctaaacagttcaagaggatgatgtacatgttcatgcaagcacatcgatcacttaactaaccttagtggctgccatggcccatggcagtttaaagctgtataatcagctatgcatgttctgcatctatttggaagcttgagattctgctaagtagcttgttcgtaccagaaaaaagatcattttctaaacaaatatcgaacgaggggagtagcaagctattgagaatttaaagtttgattcctggcttctggtgtttaatttattttctgaattctataactatatattcttaaacttgggtgaaaatctgatgtgtttcgaaagctgagaaattctataaggagctatagctgccctagaaacttcataaaaaaaataaaggcatcaaaggacaagcaagtactccctctgtctcattttaagtgcagttttgagttttttcgtccaacatttgattgtccttcttatttgaaagtttttttttattattagtacttttattgatattagatgataaaacatgaatattactttatgcatgacttatttttttaatttttttatattttttttaaaataagacaaacagttaaatattggatatcgaaactcataactacacttaaaatggaaccgaaggagtaaacgacacctgaacaatctgaaactttgtgttcctttcagagtactaatttcacaaattgtgagtgtgttcgtgtttgtgagggtacacaaaagtgcatgcagatcctgtgtgctaccaactaatataataaattggcagattggatggatactttgcccaactactgtagttgtagaagcactgggatctcactctgcagttctttctagtactcctacattgattctattgcttctggtgcattgtcttaatcaggcactgtactgtcattgctgttaattaatgatctttataataactaatcatgtgcatgcagtatcctacatgcattgagatgccatcagtagtcagaaagcttctacccatctaccttcaacaaatggagatgcagatgcgactgcaagcatgcaaaagatggctaggcacagataccttttgatgtatttttgccatccaatcttaactaaaataattaaccaaagatgattaatgtgcacaagacagtagcttccttgtaacccacaaaagacaaaggaaaagaggaaaagaaagatggggttaatagctttgatgagcagcatcttccttctcctttctgtttgtctcctctcctctcatctcatctcatctcacatggtttgatgtgccaagaaactagtaaactaataacactgtcactccactaagattataataataattatcacaatattggtgtctatgtggaaatatccatcatcattttgtcatgagtaaaccaatcatattgactgggcaatatatagtacccacacacgcagatctcaatgcctcctcattagtgttactaacttggattagctaggagtactatcttaacttgttctacaccccaaaagcattgactactattcacacaacatgaacctcagtttgtcatttttcgttagaatggagatggttgatatcaatatcgtttacggtttatgtaaagttgatgaaatttgtagaaattttcatcaaaatttagttaattaccagcatggcgaatggcttggtggtgctccaagctgtcggccttgttgaacacctccccacactgcgagcatgcgcacagctcccgtggcctcggatacctcctaattaacaccagattattattcgctaatcaagttaattatgagcttaattaagtaattaatcggattaggaggagaccttgacatgggctcgacgttgatggcgcggcactcgtagcaaccggagaggccacggagggaggcgtggtggccgccgccgccgccggaggaggaggtggcggcgcggtgggcgcggcgggaggagcgggtgagcggggtggtgtcgcggtcgagggacgcggcggcggtggacgccgcggaggcggagctggcggcgtcgaccacgtcgcggatggcgcagagcgacgcgccgcacgcgccggcgccgtggctgcggagccgcgacaacgcggacgacggcgcggcggggtcgtgcacgcgcgccgccgccgtcgcgctccggcagctcagcaggctcttcagctgctcccacgacgacgacaccggcgcggc

SEQ ID NO: 23242 - DNA, 2278 bp, Oryza sativa
tggccgcgacgacgacctgcttggtgctcttcttggacgacgcggccatggcgcggtggcttccactccctgcaggcggcggcgttctcggcgtcggtgagagcggcggcggcggcggcttcttcttgcgcttggtgtggttgtggtggtggtggtggcggcggcggtcggaggtgtcggtggcagtggccgtcttggaggaggaagaggaggaggaggggaggaggagagtggagagcgccatgggaggggaggggatactagcttggtaagcgaggtggtactaataaattttcttctctcctagttagtgcaacatgggagaaggtgtgatatatatcaaggctcagctctccaccctattaaacatttcttttgtgaaaaaaagagagagaagaaatcatatatatctataaagtccatcccatcccccaagtatagttaatgcatatcacctcaattatttttagcctttggatgatttatcaaggatgtaaattgcatctcttcacatcaccttaattgtttttagcctttggatgatttatcaaggatgtaaattgcatctcctcacatctccttaattgtttttagcctttggatgatttgttgagggtgtaaattgcatttcatcccttcaaaagacacaccatacaatccaatcattataacctttggataatttataaaggtaaaaaatatataaatacatgaaaaaaatcgtatagtagataagaaagaaaattttagaacttgtatctactatattttcacgcaattctgcagcagcaacacgtgggttcccatgtagttaattaatatggcagtggatattgtgtgagaaatttggatctgaaaaaaattaatggagaagtgggcattaatgcaacctcaggaccagggtagtggggttggatgcatttattaaaatacccctggaccatagtgtgaaatgtttgagttcatgatcctttcattcagcaaagtactacagtgtaatgactgttgaaatgcgtgttgtggtaaattaacagagataatgaagatatacagcgcattgtattgtacttggggtgccatctcattctacctgggacaacatagcgtgtagatcatagatgatggtgcatccattgccaactctaatagagttatgtaaaaaatatagcaactctaaataggtgtagatcattgaagtcacgattatgaattggtttctgacatgtggatacatgttacctcgggtctatatgtcaatgacaaggtcatatgactttttgtgtcagaggaacctgatcccaaactgtattgtaacttctcttcaaccctaacgagtatatggtaatcggcccattgaaaaatcaattttttatctgcatttgtaattcatgcaatttcaattttctgcaagtttggaatgcaaataatatattcacagcacataaaaaaccatgtaaagtagacataaaaagtatagaactattggatccctggtaggtgagtcaaaaatgtgattccacgattgttgtttactaaatcaatgaagtaaatgtttctttttctttttcttttttttgctttgaaacacatagtcattaagtaaatatgatcataagtaccggaccaattgtaaagttaacttgtcaacatttagaattgttactctatattctcaaacagaaatgaaaaaaaaatggtttgcgcacatcttttcaaagaagaaatatagaatattgataaactgtattgtcctctccagcaaagatcgcccctattgacatttccttgtaggtacaggcttgcatgagacatcccaacatcatagttagcttagccaccaacaggtgagaaaacagtactactttctctgaaaacaacatgtgagaaaaaaaaagggggggggggtacatatatagtgcatagtatattgtcactaagtaccaatgaattcagcaaccattttattttcattgattggttaacttcagcaatgagagctagctatctaggtccacaaaatttgaccaccaaaagtgtttgaaaaatcgaccatccaccgcgaaagatcgcaggaaagaaactgaatttcttgggcttgaatcatgaatgccagatcgatctcgatgatttctgcctgcttgattcatttttttgcaagtggtaggagtgtgggacagtttcagaggacagctgtttgtttggcctgcaatcttgtgttgtggagtagctagtaccagaatgggtagagatcccctctttttgggttgcatactgaaat

SEQ ID NO: 23243 - DNA, 3209 bp, Oryza sativa
tatattaaaataacgcttctgatagatattggaagatttccagatcaattggtgaaaaaactgatgcataagctagccatgatcgcaattattattattatttttacaatctgaaagaaatctgatcatttcagaagtgaaactatctctctcaaaaagaaaagaaaatacagaggagagaggttgagcttccccatcacaccacaggatgagggagttgctaagtactaaattagtatgctattctcagttgcttacctgcctcaagtaggttaactgccctctcacttcatccatgtcctcatgtccctttctcttccttgctataatctctctctctctctacgattagttaatgtcaggatcatctaccatatatgtgtcttctctcaaatttggagttattggatgcaacattagagtttcttggcaataatttggattgaaaagattcagatgttagcaacaccacatggcgacgaaatgtcaggactccttgtgaccttgtccatgaatacaagcatactatatttgcaaatgtaaactacttaaataagatgtgatgcctttagaattcatacaagagcaacaaaacatgccctacgtggattatcgccaatgatcaaactttattcttcaaccaatgaaccaaagcaacctagcatcttaattaccaactgaactataggtagttgcattacatcacatctaggctgaaactaatacgatgcttgcttcaaaacagaatatacagattatttctgaaatgctgacatgctagtgacaagcatggtatggtaacatgggagagctaatgctagtgagatatacataagatgcttgagctttctggcccaccatgcatgctaccattttgtctggttttccttcctatttttatgagctgaaagcaacagcgaaaagggaggagtccgtggtaggtatgaggcatcttcagggtgagctagcagctggtttgcatggcaccaattttctcacaacaaatccccaaccaaaatgcatccaaggaagaaaagggaaaggaaataaaagtaaggaggacatgaaaattgtaccaatggttgttgattatctgatcagcctgctaacctcttctagaaatgggttcagaacctgtacttctgagagggaaaatgacaacaaattccaataattgaattggattgggttatttgttaggacaaatgcatggtgatgtttgcatctgatcagcatctgacatgcttgcactgcacgcactgacttgctctgcaaatgttggcgcagagcagcagcagatctgtgcattaacttgtggagatgtgaggagtaaaggtagtacaggcaggtgatccacatgtatgtgagtaactctgatgatctgatctctgaagcccattgcagtaatatgcagctgttctatggatcacagatccatggatccagccaactgctccatcgtgggctccattaacaagctgtttgcactttgattaccctgaactttattctatccataaaactgagattgtcttcaggaaaaaaaaaggaactaatctaattccagatactacaagacaatgaaaaacaaccggcggtttcgttaagtgttcaactgttcatacaccaaggcaaggaaccagctacagttgaatagtgccctcaaggacaagctttctagaaattttgccagacatgatccagaccacgagttacccagatgcaatcccaggtctgaattgaaaggtactaaataaaagccaacacaataatacaaaggtgtcccatgggctttgtctgagcccttaagacagaatgtacgaatcaaaagttccatatccagcatgtgtaggggaaactgagttactgttccaatgtaccctcgactccatacaattaacatttcaacatttcatgttcatatgagaacgcaggagatgccaccatccacatcaggattaaagagcgtgacaagatcatggcatggcatgttcccaaaattaattctcttctacaggaccatttccttcagtgcaatcactcttgggcgggcaaagatcatgattcttcgtcactttcattgccaaaaaccgatgacatttttgtagcaaccttaggtttcttgcttacattgccaactggagcctgtccgtgcaaaagagtagccaagttaacaattagatactgctgcaaaaaataaccgataaaacagtgtttttttcttaaaaaaacaacctaacgtttggagctcccatgacactacagtataatggagtttggtggtgcacaaagccacaaagacgacccggttgacatgtcgaaaggatagtagtatatgcattatattctcactttaggccaaataagttaatgtgtcaaaagcttctagaagagcacatatgctgagaggaaattacagtttaacaaaaaagcctaagaaagtttcaacttaacggcaaactagagcaatgaaaaaagaatggagaatatagaaaagataaaacaaattcacagagttccatgcaagcacacaactactttacttccataaatggtcatatcagtttaacaaaatatgttgttcagatgtggggtaccttggaaggagccattttggagaagccaaacttcaaggttttacgctgatcctgatttgaagggttaggcaagttcttcattgtaattctctctgatgagctctctgatggttcttgcttctgctgctgctgctttctatgagcatcagcactgaagtcccattaaggaaattgcaagttcaataaacattcagcacatttgttcatagttagcacatcattgagttatcattgttattgactaaaacatgggatggatacagttgagcaaattttgccagctccttctcttctcgttgctgctcacgtttctgcctgtcatcacggctgctgctgctgctgctttgcatttctttcatttccttgaacctctgttgtaaccacagtgaacttatcagaaatatagtcctgaacaattaatatgtaagagtgaagggggaatatatgtatgtgcacccatacttcacaaaagaaaaggcagtagaagagaagttcgctgcaccaagtaaacacattaccttcctatgattgtggtcgtatgagctcaaatgagactcaaattcatgcgccaatttgtactgcttgttacagagactgcaaaagaacaccttc

SEQ ID NO: 23244 - DNA, 761 bp, Oryza sativa
aaaaatgatttcaactacctatccagggatgaaaacggagcgaataccgaccgataatgctcttaccgtatccgttttcatattgttaggcggatacggaaacgaatacgaataactcggatacggaaacgaatacgaattatcgcggatacgaataaggatcgaatatgatcggacacgaatacgaaaacgaatatttctcggaatacaaagaccactcaaactgtctcgtagatacaaatgcaccacatatatttatctaatttaatataaatatcatcgttgtaggacgcatcacagattaaacaaagtgtatcgtgttcaaatcgaaacacgttgaaaagttcaacatatattgagttcgagttctataggtaacacagataagatcaaaatagtaattagcccaaaagcaattttcagtacacttgcagtccgatgcatgaaagctgcaacatcattattcatccatttcatccatcagaacatcatcctgttccatgtcatcattattctcctctttttcctacaggagtcgaataatattgttgttatattaagaaaaatattcatagaggtaaaataagaaaatagctcaccactatcaataagtttgccagatgcctctctacgctttcaatgtccaactcattgataatagcctgagtcttataacctaagaatgatgccagatcagatcatggatcagctatacatatattgatatatacaagaaggaatggccaaataagcaatgaaca

SEQ ID NO: 23245 - DNA, 1463 bp, Oryza sativa
aaatactttgtatttgaatcaccctccaaaatatccttagttttagccctttgataccacttaatttcttcttctctcataagagtagataatctattcctacaaaaccatctaaaatcaatttcctcgtgaattagaagaacagattcagcctttttatccaacaaatccaacctatccaaaatctccttttttttcttttttatacataccacttgtatgtttagcccatcctctcaaatgctgtcttaatcggcgaatcttcgcctgccatcgctccataggagtattaccctcatgtacactagaccagacctcctttaccatatctacaaagccatcacgtaataaccaaccaagttcgaatttaaaactatgttgtgcattacctgaagaggtggagtttgtatttaaaaaaagtggagtatgatctgaaatatctctattaagagcaaccaccgaggataaaggaaatttatgttcccactcagtggacatcaaaatcctatcatgtttctcataagttggatttgctaagttatttgcccaagtataaatcgtacctgacatttgcaactccctaagacacagtccatcaataatagcattaaaaagaaagggccatctatcatcgtaactgtcattatttttttcatcagggctacgtaaaatattaaaatcaccatcaatgagaattggtagggattcatgactgcacaaattaactaattcagcaagaaactgatccttaagttcattttgtgccggtccgtaaactaaaactaaagcccacttgaacttatcaactttgttacataaatggaacttaatataaaaatcaccttcatcaattaaaccaatatcaacgtttagtaaattgatgcctaacagaagacccccagacctacctctgggaggtttacaatgccacaaaaactccttaccagcacaaagatttttaagtgcagctggagtaaattctttcttaaccgtctcagacaatgctataaagtcaagttgatgttccttggtcaagtcagaaataaacttatgttattttgggtccttaaacccatcacaattctaaaagattcccttcatttgaaactatttttattatttttcttatttttcccccttttactctttttcttagagttaggagaagatgccataggatttaaagtgtttttaagactattctcacagtcctcactaaaatccatgatctcttccataatttcactacataaatgttgtagtaaaaaattatcctccaactggtcatctaatgactcagtatcaacattaggggtacaaacttgattaatagaagaacaagcatattcgcttatcctattattttctacacatttcaaatcattaattgcatcatctaaaacaacatttttactagaaggtataacaccaagattctgaagtatgtgcagatatttgatcat

SEQ ID NO: 23246 - DNA, 2002 bp, Oryza sativa
  unsure (1)..(2002): unsure at all n locations
atgcaccacccacttccatctaccaggtatgaacctctccaactcagaaataatagaacttacagacatctgtcctttagtgaccttaaccatagccgctttaggctcatgcttaaccctcattccagctgaaagaggtatatggaagaaacccaaaccatctccagcataaccacataactgagcaacaggtttaacagatgacctaaaaattgggcaacgagaagcaacatgatcctcactttcacaaatctcatagtaaaacctagaagaacattcctgcattgtatgccctttagtataacatctataacaataaggtttgcctgatcctttgacctcaacctttgcctttcctttgtttacctccccttgttgttccaagtttctaatgaacgaaaaatgaatttttttgacgatgtttgtcaccaattttggtacatggtgtagtggatgttcggaagtagttgcacattgccaaaaagtttttaaagaactaaagagtatctgggccatcatgctcttactgtcattgtcaccgtatttgaacccctcagcgcctcaagccatggtgctcgccatcgccgaggactcaggatagggccggccctgactttttggtggcccggtgtggaataaaaaatgaaggcccccattcactataaaaatacaagataatatttaaaaactcattgtcattaacgaatttcacactaataagtttaaaataaaaaaataaatgtctctagatcatttaaaataatttcttctaacaattctagatgcaaaatcaatgatgatagtgtcaatatcaatctcatccagcagcgtggtaccatagaatacatattttggaggctcctaattttttaagtcctagtacggtcgcaccatccacattagcccagcgccggccctaacttaggtgcaaatgcttcagcctttgctgccagggccaaccctggggcagggcgagcagtgaggccgccctgggccccaggtgtctaagggcctccggttgtctagttaagtgcatctatatagtttgggctatatgcttgatttgtgttgcattaactaatctcgttttagattaccactaattaatcttaaaaaaaagaacgaactttgatgatttccattagttcgtaagatctcagtcacagctaactgtttgagttaggagtttgagtgaacaggttggtatattataacttcttacatgatgttcaacataattaatgccttggtatatctatagcgtacaaccatcctggttgattcattcctcttctaaatttgcactaattctctacacatgacatgctttttaattaggattcttattagacattatatacttgataagtttgtcagtgattaattctttttttacattttttttggttttctattcaattatatatcacctaatttatgtttgatgatttgttaaagttaaacattcattcctatttaaaaataactcaccaaataggttttaatccaagtgcatataaatattaggcacacgtgagtacgcttttaatatgaaattattaatgctacataaggatatgctacacgtgagcaagaaagatcagatgataaggatgcaaaaagattaactgaggagttgtgtaagcattagagtgtccacaagttatattgttgtgtgcaagggcagaattatgtatataacagattcagagtgctatgagaatgagaggaatgcaggaattaagtgagaaacataagatgcctcattgatcaacgattcttgaatgtgcaagagtatctcaccggtgccgaacaaacgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 23247 - DNA, 415 bp, Oryza sativa
  unsure (1)..(415): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattgctgattggtgtaacagtacagatggaacaataaaaaccatggcaaacgccatgcaaactaaatatgataagtactgggagaagtcgaatatggctcttgttgttgcatgcttccttgatccacgttacaaaacaagttcaatagagtactatagtatgaagatttatggtttagaagctgcagaaaaatttgatgagttcaatggggttatcaaaaaattgtttgatgtttatgctactagtgcgtg

SEQ ID NO: 23248 - DNA, 798 bp, Oryza sativa
agaatgaaaggtttctctcctaaatggtgtgagtggataacttcttttattcaagggggacatgttggtattagagtaaatgatcagaccggtaataattttcatacttacaaaggtctaaggcaaggagatcctttatctccaattctttttaatatagtagcagatatgcttaccttattaattaagagggctaaagatgctggttcattgaatggggtagtccctcacctagtggatgatggtttatctattttatagtatgcggatgataccatcatttttttggaacatgacttacaacaagcgaagaatcttaaattgattttatctttgtttgaaaagttgtctggcttgaaaataaatttttataagagtgaattattttgttttggtcaggcaaaggaatattatgatgagtaattctaacatctttggttgtaagtttggctctctccctgttaaatatcttggtataccaatgcatgttagaaaactaaataatagagattggaaaatgattgagaaaagaattgagaaaaaacttagtagttggaaaggaaaacatttatctgttgggggtagactggttttgattaactctgtactttcaagtttagctatgtttatgatatctttttttgacataccgaaaggggttcttcaaaaaattgattattatagatcatggttcttttggcaaggggatgaccataaaaaaagtagacttactagatgggatatcatttgtcaacctaaggatcagggaggtttaggggttcataacttggaaataca

SEQ ID NO: 23249 - DNA, 13814 bp, Oryza sativa
  unsure (1)..(13814): unsure at all n locations
agatgatcgagatcttatgaaggttgcatgtcgtaggcttgagataacggtcatgcaactccttgcaaactattgatggagattcacaaatagacttgaataaatgtgctctccttatcttagtttgatcttttattttgttgggtgtgtttaattaatttgaactacactcagtgtttgggtgttacttttgtaataattggctatagctctgatgaacaaaggccgggatgttttattccattatctaaaaaaattagaaacttggaaatgtgcatgcacttattcatctatgactatgttcacaagatcaaatcaatccgtatgaaggaaatggttacaattacatgttaactgttcatgtgtggatgcatccaacatgttctcgaaaaaatcaaatcaaataatggatacaaacgtaatcactatatatgatgcaatcaattatattactgtttatagcttgtaaccgtaggttaagccttatccaaacagtattttttttctctgcgctccacctgaattttctgtggtatttctatagtgaacatgaatagaccgaattaactgggtgagcatcacaattagtggatccatcttctttgtacgttaggatatatagcaacaaattgcgtgtcaaagggagaaaagacgaagctgtacgaactcatcttgtgttttctatcatcatcagtcccattttccagcaaatgcatgacctacaatgcatgcaggtcacaaccgtgggtaagtgtaagacaagccgtctccttcatataattttatacctctcaccaaatgttgttcatcgtgagttgcaaggggaggggggacacatgcatgccctatgcaacctgcgcgacgacccggggcctgtggcagaagccccatttagtacttctattgtgtaggacccaaacttccatggacggggctaaggccttggccaatttctagttccgcccttcagaagttcatctacaatctagaaattcggttaatccgtgttgcttagagttcatctcacttgttttctcgatgcctctcattctcagatcttagctgagtacctcaatcttactcttatgacactatgatggttgcacagttactctactaatccttccatcccatcgttatccaatctttcttgtttcacttttataggacaaggatgaatcgtctaggggtgaagagtttgatgggtgtatgtgtttatagtggcatatttattgttcagttggcgtgttaggtcccgtgttcaatgaactgaatgtgaacctttgcacttacgaacatcgggaaagcggtgctcaaatgagaaatatggaaattttgttgtttcgagataagctatgacttaatattcacaaaatcaacatgggagatatagctaactcgttgttgaggaatcgcttactagttttggtgaacactgtttaattttagtaggtatgaaatctcctacaagcgaacttgtactctgattttgcttggatggttagtctcaatttcaataacaaagaagagggcatatgatcaaaatttactttttaatataatagatttatataatccaataattttataagaatataaaaatacttttaagatgacgaatccacacatactattttatatgtttaaactaagtatttaaaaattattgcacttttaaaattttgacaaaataataaaatgtagtaaaattttgacttagccgatagatctatgtgtcagtgtatagtttgttccaaaaaatcatatgttaaaccttaattctaacaattgtgagtctgctctttctgctcaattccactggtcagaattagtttcccgtggcatgtctgcatattgtatacagaatctgaattgacagagttagcatcacaagtgaatacacaacacatttctcaaaatgcccgagacgtactcttgtgaaagctccgatgcaagcggttaatccaattccacggataaagtttgttaaaggggaagtgcctcttgcgtagttcagactattgatccaatttgtgcaatgctagaaaaagacaatgacatctggccaactgcaagcnntgtctgctttttcctatacatcatctacaatgtctgcaggtcanagcaccagctgttctacggctatttgatctacactgagttgtttggcactgttcagttcagatgctcttgcgccttcaaacttgttcgatcggtgaggcgtctagtgcttctcccttgtttcctgcatacctctcattctcacccacttacctctcattataatagcactatgatttcttctacaaatataataactctgccccctgcatcaactatagacacacacaacattaatttgtggtcactttgatgcttgcacaacacctagactagtctaaatttcatactcattgtctcgtcttttttacttctcttttatacagcatgcatctcattgacatcgttgtcaagctctaaacagatactcgtaatgagccaaaatgccaaatattcacatggttgtcaagatcagcgaatgatcaaatgcctcgcacttctttcctgaatgccatcattcttacctgaatgcctctagcttttatggcactctcctgcttgcactacttatcgattaatcccttctatagagtagaatgaatcgtctggaattggagagtttgatgcgtctgtgtttgcagtactatgaatgaagttattgttcagttatatcgtgagaagtcccatgttgaatggactaaatgtgaatttgtgatcctttccatttatgtgcatcacgaaaacaatgtttaaatgagaaatgcaaaattttggtacttttcaaaaaaaaattggggcaaaaccttagtaaacagtaaaatggaaaatattaatctctactgccgaatcgaccgactagttggtacacatggcttatattatatttttagactgtaaaagatctcttacaagcatacttgtactctgcttttttggaattactactaagttctaggggaaaagcagttcatattagagttgatgatgaaatttggattctaaatagagtccaaggaccaaaatgcttctttccaccggtcagcacttgtttcttgtggcatctatacactggcatgtataatctgaattgaccgtgtgagcactgagcatcgtaggtaaacccatcttcgaaaaattctttgataacaatttacttgtacttctgtgaaaacatctaatggttaatctgattccacagataaaaaatttgtttatttaaaaggattgtgtttcttgcaagcttgtgatgctgttcagagtaatgatccaatctgtgccttctgcgagaaaatgacagtaaaaatccaatcaccacgcgcaaggtcatcttgtgtctcctgaaatcatcagtcgccttcatcaaatgcgtcgtctacaatttgtgcaggtaaagcaccactgctgctgagtttgagcaaatagtagattatgtgcttcacaatactatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctggattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactcttcccctattaactacctctattaacactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaactcgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtgggaggcgcgcgcgccggcgctgggccttatgggccagaaatgcgcgcgcggcgcgcgccgattagcaatcgcgcttttctcctgactcctgactgcatctcattccaacatggcactctgatgcttgcaaccactcctcgattaatcctgttccatctccattattatctaatctttaatctctctgatttcccttttatagaccacgttgaatcgtccggcattggagagtttgatgtgcgtgtgtttagaatattatgaaattattgttcagttacattatgaagtcccgtgttgattggactgaatgtgaacctttccttttatgcacatcaggcaagcggtgttcaaatgagcaatataaaataaaatataacacactaacacagatctttctatctgtgacggcctctaacaagcctagaaatagcgggccatcacaaggaagtcatctcaatcggaccaaaaagtgtccgattgagatatgatcgcacagacatattagatgggcataaaacttaaacccgtcacggataacacctatcagtgacgggccgtagtttagtcccgattgagataacattccacatctcaaacgggcctaaagttacggcccgtcacagatgaccatcatatgtgacgggcaccaactttaggcccgtttgagataacattccatatctcaaacgggcctcaagttgggacccgtcacagatgaccatcatctgtggcatgcaccaacttgaggcacgtttgagataacaattaggcccgtcacagatgactcatcagtgacgggctatatactaatgtccgattgagatgacttaatctctatcgggcatgaactaaagcccgtcaccgatgagtacttttccatttttcatatgaaatgtttatatttataagctgaactgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaaattataaaaccacctaatgttgcctaatgaatcagcgaagcatctacctaaattcatactagtggaaccataaatagagtgtccactagatggggttttgtttaatctagggtgaacaaggtattaatatcaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcgacttccacgaagaacggatcttccgaagctgcagcgtctacacgaccaacggaaaagaaaagggcttttactctaataaactccaaataacagcataaacaaagcacaaaaatgggttctttacatcttaaggaaaaattagagacttgaacggtccaattccgagttcaaatggccaagatatggccctttgaagtttatatgctctttaaatggatatttacgaatttcttcatttaaattttaattaaaaaatcggattattgcgtcagccgagggggcgggcgcgcggaccgggtccacgggagtggggcccacgcgtcagcctctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgatgagaacggcggccggagcggaagaagacggcggcgcggctcgggatgacgatggcgacggcgctccgacggtcggcgggcgaagcggagcggcggacggggtcggcggcaacacggcgaagcggacggaggggtcgccgagtcggaaggaggaccggagcgacggcggcggcggaacggagctcggcggcgacggcggggagagaggagcacggcgcgagcacgattccgacggcgagagcgagcggcgagcggcggaaacggaagagcggagctcggggagcaattatatagcaacgggagggagagagggcggccggagagagaggaaacgggcgcggagatctcggctccattgaatacgccggcgaggtttgcgggattgattccgagcgaatccgagggagagagagaggggaaagagggggaatcgggagaggggattgcggggaataattcccccctcattaaggcgcgcggggaaggcgggatgcggcggattccgcggcggcggcggcgctagggcacgggcgggcggcgggcgcggcgcgaggagggagatgacaggtgggacccacccgtcagcgagggcggcgggcgggcccgcctgtcagcggcgcgcgcgcgcgggggagaccgatgggccgcgggggaagagagagagggagggactgggccgagccggcccaagaaggaatgggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacaaacttccagcaaaacttcaccactcggaactgcttggcttgacctcctgttgaggatggaatcttctcttcacctgacttggaccagggtgcaccttttggctgactcagactaggttgcggtagtgcagtgatgcttccgttccagaacttctcatgattcctatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctgtattgctggatttgttattgtctaatcattaccctgtcaaatctgaggcttcgttgtaagaggtgattttaatctgacctctatagactatcttcgaacatatcactggttctataactgggaatggctctcacgaacaagcagctcggattcactttctttacattcagtttacttcccattattatcttcaggttgtcctcagttagtattcaacgtattcctttacacctttaaccttgatgtgttctttcccattggatcatctcccaagacttggcattacctggtaaccggtgcttgcacttttcacttcgtgtagcatctgataccgagtggaagatttcactctttgccttcatagaaacacttttacctaggtcatcttgctgacttaatgacaaggtgactgttgcggggcaattacaatcaggggtcttccgtgagcgatgcagagcatgtttctgtttatcaatcacctttcggcctacttcttttatgctggagaacatctttgccaatctcttttatcaatcatctttcggcttatctctaacaggtggtattctttaatgtgggttgcggacgcttctggggacgatgaggtcctttggcttgctgcctttcagtgaaaccttgatgtggtttgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaactaccaaccattgactattatgttctcgaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcacatatccgcatctttcaaaagaatcctcttagaacttgtctgcattacacatttctcccttattacacgaatacaaggcactgccttaaacaaaaagagacggtgcttaacatcggtacattgtatcctcaacatgaatcatccataagcatagcaagctcactgtttatagacatgaatatatttatgtattacatgattgctgcaaactttcgattacgcaatgataggtagcgaactgaaaaccacaaacacggctgctcattttgattccggagagatatagctggcattgttctagtgactgcatccttgattggttctgtgatgatgtgataggactgcataatgctatcattcacaggagaagattccttctgattgctggttgaagcggatgacggtcttctgcttggtatcgccttccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctataggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacctccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggtgcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccattctgtgctagtaatgatcatcttacggacttcatcttcggttcgcattggtgtttttcttttctgctgaggacgctcccttgcatagtgcccttgctcctcacacataaagcaaatgttacttgcttcttttgggtcaacatgtggcacgtcaccatgggtccttcgggatgctggcggcatgctgacttgtggtgtgagtgcttggactgcctccaactgcacttgaggtcgtatttgactcgggttcagaattggcgtctgatgctgctgtagtatctctataagcaatcggttctggttaatcaggtgttggaccagtgtcacacaactggtgtctggtgcttcattcactcgggagcttaaggtactaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcctgcttcacagctggcttcactgcttcctttgcttcgctagcggatcctgcagccttctggagcgtcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaatacttttatttataaaatatgtccttaggttttatccacttggcttatcctacagtcgagatggctctgataccagcttgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaaccaggccaaccatcccatatttagttgtgagcaaattttaagaattaaacactgacttgggtacattgctag

SEQ ID NO: 23250 - DNA, 770 bp, Oryza sativa
aagatctgagaatctgtatgctagtaattcattagaaagactactacataagctccacattatgacccaaatttcaatcaatacagcagaaaataagaaaacaagaacatgctaatgaaaggcacaattactattccaccaacacccactacgaattaatccactacgtaaatcaagcctttcgcaagcaaccaattatctgttcaaagcagggcatagcagatcagtaaagaggcgaggatctgagcatggcatcacacagagagcaatgccaagatggtcgtgccagaggtcaggatggaaaccagcacctcagtgctgcaggccacagtgtagacctcagacagcatcagcctcagcaggccacatgctttgctccaggtacatcattcccagaatcagtgaggggatgaagaggggagaagaaagaagggcaaaaatgatgaaatggtataggtaagaagttttagcccaagttgtggtattactacttggtacccagaaaaaattaatattttttggtacctggccaaattcttgtgaacttttttgtccttgcctttctttgaaaaaccttgtgtatgacggtatgtcagtcttaacccatccccccagaatgttgcagaaagttaatgtagaaaacaacggggtgtaaaccttttagaaaaaggacagctgacgatgtgaaatttaaaatcgaaaatctgcacaagttgaatacaaatatgtacttttctgaaacagaggattatcaaaaaggaagccgcgta

SEQ ID NO: 23251 - DNA, 13416 bp, Oryza sativa
gtgaatatctactccacctcctttatgttataggttttatgaatttcccctagtagttcttcaatatcatatgaaagttattctacatattgttatcttattatttggccttctaaaatacaaatttaacatggaagggtccaagattcacatgtacatgtacacaagctaatgttacaattataactgtgtgaacatgcgaagggtgcctttatgaagaaaatcacattcatttatttcacaatactagggaatgtatgattagtgtttatccatataaagcacgggtgtttagatagtacttccaaactgtggcagggacggaacaaataccccatcaggtcaaaagctgactgactaggtgtaaggacaagcctaatagggttcaatcctagactaggcactgttgtccatcaattttatgagtacagctacgtctagtggtaaagcgaatggtcatgcttagcggactttgggcaactccataattttgaagcgtgtagaggacatgcacacaatcatggggtcaattgcttgacatttgaagtttttatgtattttagtgaaaatattagcaaaattagcactacatttcaaaagaactgcacaacatggtggcactacttccaaaaccatgtgattgatgatgtattcaaactggaaatataaataaatttatgcaagttccaatggaatctatgttatacattcaaagtctaccaaacatcaaatatttttcaaaagagccttattgttactgtagagatgtaactcaacaaaaaattgatagtgccacagaatatagggataaagtcataaaacactttgattagtatatacctgaaattaggagggccaaaaatgggaaatcaagatccttgttcactaacctgacatcaatagaactacattaatacaaatgcatcgattatagcaataacaataggttaggtggctatgatagcatttttaggattatataattactttaagtataggcatgattacaatagtcttagggcttagggtcttagcatttctggtaaaaaaagctcttctgtaataataatttaaatttcataccttgcatttcatcacaatacattcattttgcaaaacatgtagcactgaaaaataatttatagttgcaaatttgttcctgctcaaatatcgttatgtggtttttacatagcaagatgttggtcaaatgttcggaagtaataccagtagaaaaagaaatcattcacttttcggttcaaaaattgctaatttaccaacctaatggacattacaaatatacaatagaaaaaaagtggaagtgcaaaagtacataacagaaaccagtcgtgctctagaactaaatccacaaaaataaagagaaaaacataaaatcccttacaaatggacagtaaaaaaatcatcgtttcagctaaaaaaatctactattgcttggcagtgaactgataaaggaacttatgtttcatcagttgagaatgtcatcttcataactcagaaataaaaaccaaggttggatacctggaaactaatgcatgtgcctccatatgatgaactccaacaataggcaggcgaaatgatttcgctatttttcgagctttgtgaacaccaactgcaatttatatggttcattaaatagccttcaaagaaatgtaagagagactcagcgaggttaaaaagtaaaatcaataaagttcactctgactgtgtaaatagtagtatatgcaatgtatcatttcaacaatcgattactttacaggttgacattgcgagtgactgcacaagataaagaactactaacaagtaacaccatctaaagggcaaacaagttaatgatgagaaatgccctgcatctaaaatactcagcgaactaatagtgagaacacagggtttggggtggggagaatgattgaaagatgcaaacaagattctgtaacaaactgaaaattcagaactatgccagcatataagatataataacagtaaataccagctaatcctattgatcaggagtaaacatacaaaagctgatacctctgaggcataaactaagtcctggtcctacggtgacagccactgctgaaagatcattttctgacacatttgcatcatcaagtgctttctgaacaacctgcaaggaaaatacaaaatctataacataaatgtcaaaaacagcaagattgaacagaaactctgaaactgaaagccaaacctgatcaatcgcaagagaatgagcttcctcggccatcttcggagcgacgcctccccacctcacgagtaaatcttccttccaaatgttgtaagcacaaaacaatacaatcagcagcgcacagagcatagcatgaccaataatacagaaacaaagtgtaagtgggctgaacagggaagcagggggcatagtatagtatctcacttgggaagataccacctggcttaggatctcgccatcgcctctaacctgcaaccaaccaaccaacaaaaacaacaaagagccaggcactaagcacaaacaaatcctacacaccgactccaccactgctacaagcggtctgaaataggggagtgagccgcgcgtaccacggcggcggcggtgtcgtcgcagctggtctcgatgccgagcatgaggaggtctgcggcggcggcggcggagggcattgtggcgagggagcggaaggtaggagaggaccgtagcggaggggagggggcgggggcgaggaggagtcggaggaggggagcgggaaggggtgaggggaacggtggggctcgccggaggaggagggcggcggcggcgcgggaggccggcggcgataaggtggggagaagagtggccgccattccactctagctcgggttacactggggtctctcaacaaacaccgatctttttgcatccgacgcacatgtgtgcctcctttttccaaaagtctaaagaaaaaaaattactgacgaaaatgcatgatggcatttggttgtattattactatagtagggtacacaaattctttgtgatgttaagctcataataaaagtataaaagtgcatactcctttgtcctttaaagggttaattggatccataccattgcaaatttatctattcagaaaaataacactacaatttgtctatttgtagccttgccactgaaatttcacaaaattagaaccgtgtcactaccgtcacgttttccatctattctcttcattttccgtttcttccttccttccttcctgtcttccaatttgtgcggtgcggcagcgacactggttcgtagggggtaggggtgaaaacggtacggaaacggacggaaaccatctttatcgttttcgttttcatattttttttcggaatcggaaaccccggatacgaaaacggaatcgaatattatcgaaaccgaaaacggagcgaaaacgaaccggcgcgaatacggtaacgaaaatttatcggaataaaaaacctctcaaactgataaatccaattgaataaattatctatgtttaaaagagtaatgttgttgataaatcccaatgtaggacaaaaaaatattcttatgtaattttagatttgcataacaaatattttttaaaaaattaacagccaaacattcactatttagtgcttaaaaaaagaatccagagtatttcagtcacgaaatttctactaattccaagaaaatttccagaaattccgagaaaattttcggaaagtttccgaccgatttcgagttccgacggaaactgcccttatcatttccgattccgttcccaagaaaatatttccgaattcgtttccgtttccgaaaaattccgaccgacagattccgttttcgaaaataggtctggaatccggaaagatttcgtaccgttttcaggcctagtagggggcgatggggtgcacggcgtccaaggtggagtagtgtcacgcccagaaatttagcccaaatttcgagactattttgtgtattaaatccctgtctaggaccagccagggtacacaaaacgacaagtaatatacagttccaaacgtaaataaagcgtaaaatacttacaaaagaggcacctagtcctcacaccgaaacagaacgacagcagcggaaaaaggcgatcctagcggagcttcagctccactccacaggcaaaactcaactggggtctgagcattggtcctctaactccatcttcagctcagaagcactacacttctaaaaagggggaataatagcaagactgagtacaaccaccgtactcagcaagccacaccaacgatgcagatgtgcaaggggatacaaggatggtttgtggctatttgcataaagacggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgttaccgtgcgccgacatgtcaccacgacataccgaaaagaggccgtgacaggacccttcgcataaccccctctaaccaagcacaccacatctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccacgaagcatggccagatgtctcgagcacgcagctcactctgatactaaaaaggtctaatactgtaattatcccatcaactgagctagtggtaattaagcatagctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaatgcgatcttccgaaacgacgggaactacacgctggcacgcaaaacgaggaaaaactctaataaagaccaagaaaacagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaaggagatgggcggcgccggcaagcgggccccaccggtcagcggcacaagggcgccggtccaccgtggaccgggaccaccgaggcggtccaccaccggtccacgggaaccgacggtccggatcggcccaagccgatcgggcggccaggggcggcgcggctggggcacagcacggcacaaagccggctggccaaacgacggcgcgcggcggcgcggccacccgcggcgacggccggcgacagctcccgcgggcgaaagcggcgcacgcgcgagcagcggcgcggcgcggcaagggggaggcggcaaccggctgcccggcaccaccggcaacggcgcgggcacggagcgcggagcgcggcggcggcagcgcgtcgcgaggacgcccgggaggcggccgacgaaggggaggaaaagggagagggaggggagtgctcaccgagatgcacgacggcgaaggggcggccgacggcaaggaacggtggcggcggggctcctcaggaagacgatgtgacagagctccggcgacgggcgtcgctcaggatggggcggatgggctcggcctcgatctgaggaagataaaggaggggttagagaggagaggactggtgcgtggtgaccggtaacgacggccgaccgcgacaatatgagaaggatctcaccggcgaccgaggaaggaggagctccgacggatttccggcgaagaggggcggcggccgaggtcctcctcgtccttgcggagctgagggaggcaacggcgcgggtcggcgtcgaccgaagcggcggcgcgacgcggctggagtcggcggcggtggcggagagaggtggttcgcgtggctacggcgctacggaggtggagaggggaaatggagcggtggccgagcttgcccgggcggcggcaaagctggcggtggcggcggagcagtgcggcggcgaccctagcgacgggaaacggcggccggagttcgccggagtgtggcggcgcgcgggagcggcgtggggagctcgagagagcgcgcgggagggggcaatgagttgggggaaacggatgaggggaggtcggggtgcatttttataggccccggagggggagatcgtggccgtggcgggcggcaacggccggcggatggagcttcgacgacgtgggcgagtggggctcgaacggcgccgattttttggggggggaaatgggggagaaagtggaggaaggggaggacgtggggtggaccacgtctgcacgcgcgcgggagcgtggaggcgcgcggaggaagcagcgtcgtggggtggctcaggcggccatggcggcagttggagctggaggaaagggatgacaggtggggtccacgggtcccacctgtcggagagagagggagggagaggccggctggggaggcagaacggacttgagggagagagagagccgagcgggccgagggaggaggccggcccgagagggagagaaagggggcgcgcgggtcgcaggagagaaaggagggattgggccgaaaggggcccaaagagaggaaggaggattttatttgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttccagaaaatgtattattaattgatttttattcccgaacgaaaatcggggcgttacaagtaggaggacatggtgtggtggtgcgaggagcggcggtgacacatgaaggacacggtggcgtcgcggtagcagctcgcctcggcccacgccgactaactccgtgtcccaccacactgcgccagtgctcctcaccacaaccacctagcctcctctgttttcctcgctcccgtcaccgacgccgctgctctccaagcaccacccggcgctgccgccgccaccgccccatagtcacaatagcagcagcagcagcagcctcgtcacatagcggtgagggctccccgcggcgggccgtgttgcctcaaggtgcctcacatcctgtccgactccagcattgctcgcccaacacggttgtcgttccggaagctagtggtctagacaccgtcggcagcggcatcgtggaactgggagaaaaggggaaataagaaggaagaagaaaatgacaagtggggttagggcatttttgacttttcacgctatttatctctcatattcacctgaaaattaataatttaatgggcgtaatgtctactagcaaataaccacgtttagatagtgtttttccccaaaagtgaattcgtgcggtgtccgactggtaaaatcacaaagtcttgatgtcctgtagcaaagtttgcctaatttttatgtttttagtttcatcatgagaaatactttcataacatatataatctacacgttgttaaactatacgaacttttatatcgatgattaaagataaaaatgttttaacttataataaaactaaaatgacaattaatttaaaactgagggagtaaaggtagaagtagctcggacgtccttgtcgagcccaacgtaccccaatagtaaccggacaacggcgctgtgcgtccgtgagggttgattggccacgagccaaggacggaacggaacggaatggaagaaatatgttccctttgcttgaacccaaagtgtcacagcgctatacaattcatcccatccgtacacattttgctgccctgccacacgtgtgcgtcgtaggattacgtacttgtaccaccaaaaagttggttggccagaagaaaaaatttttgcacatgaatcctctcaaaagaatacaaatatattaatggccgatcgatggcccggcgtccttggtagtcgtcgaatacgcgatgaaattttggtattattgtaggtgttactaataagacacatttcctctatgatgcaggcctggtttagtttccaaatttttttctcaaaaacatcacatcaaatacttggacacatgaatagagcattaaatataaattaaaaaactaattgcacagttaagggggaaatcgcgagacgaatcttttgagcctaattagtccatgattagccataagtgctacagtaacccatatgtgctaatgattgattaattaggctcaaaagattcatcctgcggtttccaggcgagttatgaaattagttttttcattcgtgtccgaaaaacccttcagacatccggtcaaacatccaatgtgatagccaaaaaatttcttttcgcgaactaaacaggcccataatatgatttgtctggtctctaaaatgtttttaaaatgtcactaaatataagactaagtacaatagcaaactataagctagctataaatatatgtggaggggataaaacaaagagagaagagaaatgaactatggatcttagcacgttatgtgtataagaggtgggactagttattaatgatgtaacatatatttataagtaactactgtaaaaatagattattagattactataaatgatttgacttttgaaaaaaaagtagttgattataatattaaacttgctctatagctctgtagttagtgggactgtttctaaaatagaaatggttgaccgggggacaagcgctactgatgtagtgatgtgcccctgacttatagggaattgttaatgatctcaagtcttaaaacctctatctcctctatttacagcctcatcgctaggcttagtgagaaataaaaaaaaaagcatacttgtaaacgataatttatgaataaaacttttatatacgtgttcttatgatttaaaagtaaatgatttaaaagtaaatgatagaaaataaactacgatgaaaattctcaaaatcaactctaaatttaaggtaaaaaatttaaattttggctgataaggataaatataaatgaaaaaaaagacgttaaatatgtgttagatattgtgcttgtgaatgtgtaagtgtagtgtgtgtatactgtatagatggtgcatgtaccaatggatcatccacgtaatcgaaagaaatggcttcatggatcttataaactggagtacatagcaggagagaggatagcacggatcaactatgcttgtgttgatgtcgccatatgaacttccagatcaaaccaccatgcatgctggtttaaatagttgaaacttgtctttcaaagaaatgaatgaaactgagagatggcccactcttcaaaattatttagcaggttaattaggcaaaataatgcatatttttctagagaggaaataatgcatgttctcacctaatatttttcttttctgtgtgtttagtgggaaagctacagaatcaaatgcctttggtttcggaaacatatgttatactcaaatatatttggctgataccaaatcatgtaaaatacatccacatcaatccaattatatgttacatagtttgttttttttttcataatggaacattgcagcaatttttcacttgtgttaaatatagtaccatatatacaactctcctaacttgataattttggcataagagaactcatgccaagaaacagaggtagctacccagtcctaatagcagcaactactactaaacatattttatactataattaatacacatcaactacataatcatcatcaccaccaaaagaattaagattaatttaagttaaaattaatgtaaacacatatcaacatcatcaccagcaactctgttcagcaacaaccacacacctcgcatcgtcgtcgatggcgtcgtcgtcgtcgtcatcatcgcatcgcggccgtccgttgctccacgtcagcatcagcgccgccgcggcctcctccgtcagggactccagcacggcggcggcgagctcggcgccgacgcgccgccgcgcgtcgccgacggggcacacgctccacccggccgccatctcggcggcgatgaggccgtgcaccttggcgatctccgcctcgagcttctcctcctcctcccagtagcgtgaggcggcggcggaggaggaggaggaggaggaggagctcgtcgacggcgagcttgctgtgtggttcgtgacggggtggtcggggtaatgccggcgtgtacgccgccgccaggagctccctgaagatgactatggcctctgcgatggacgaagtacgtggagcgagtgagctctgagctatccacgtggcggcagcaatggcgccgccgcgccggagacgaaggagacgcgaggtgagtgtacacgtttgcttacttttcgagtaggcaggcgacgctggcggctggaacgggctctgctccagcacggagacggggctcagctgcttctcctcctcctcctcctcctcgtcttccatgtcgtcctcgccgatggccgccgccgcagccggctgctgctgctgctgccgcttcccgccaaccttcttggccgccgcggcgccacgcggtagaaacttggagaggatgacgctgagaagcgcgctcgccggtcgccgtcgccgccgcctcatcgcccgcgcgggggccggccagcatgcggcgtccaggagggcgggggagcagcccttgtcgaggagaaagaggtggagggaaaagggctcctgctgctcctccagcagctctgaaaggcggcgggcgccgcccgcatcactgctgctgctgcttcccgacgccggcgacggcgagaggagggtcgccatggggggtcggaccgtcggagagaggaggtaggtggacggcgccggatggatgaatggaggcttataaaggtgggggaaagaagattgaaaatctgagactctgaaatgtctactttggttaccaaactatatatctccttttgtcatgaaaatatactttaagctactgaacttttttaaaaatatgactatatttataaccctataaaattatgaaaaaaagttcaaattaccaacccaaactaatgtgacagtacgaattacctcatcaattcaaaattagacattcttcaccctcaatttttcataccggacaaattgtccccttagctaattccgaagcggttttggttttacgtggcataagtcaacataagaaaataagtagtgtggcccacttatcaattctgcctcttctctcggtcaccacatttgggcccttaacttttttttatatattttcttatgttgtatgaattgccacatgtgcatcacttaggattaaaaccgctctggagtctatcaaatgagtaatttgtctggtataaaaagttaagagtgaaaaatatctggtttttgaattaaggagggtaattcatattgccacaatagttcagtgggtatttcggacgttttctcaaattattataaaaatgatttatagatacatcatcctttcacaacttagatcactaatacatttagaaaagaaaagttaagatttcatttgtaaaaattatattagtagatttatcatggatatgtggctagtaataataaaatgggtattgctatgtttcagaggtgcaattttagccacctaaaaattacactttcctacgcctaaaattgcagaagtatgcaatgtgcaattttacttctttttagctttatttttcctgttctatatggttttgctttacttttagctaagtttgaatattgtgtgcatgtacttgtgtaatatgaattgtaatttcttttttttagttatgtgttttttgaaaaattttgcaggttagaataatttattgctaaactttctatgtaagaaaaagggaggagtgatggaaaccagtggactgttaccacagggataagaaaaccgactaaaatttttgaaaatcacagtcacgacacttcttagtaaaatatatatattaatgtactaagactatggcaatatcctaaacgataagtaaatctctactacttaaaaaataaaaaataagatgcttccttcgtccgtcaaaaacaaaaaaaatagcagaaaaataaaaaaaaggtctctactacttaaaaaataagatatgcttccttcgtccgtcaaaaacaaaaaaaatagcgaaaaaataataaaaaaaaaaggtccgactcctattcctctggtccgactcctattcctatcagaaaccaaaaaaaaaaatccggctctatccgattcccccttataaaaaggaaaaataaaagtcaccactcctctcggtttgagtctgagatcacaggcaccctcctttctataccatgatatctcatacatcttggtgaaaaaaattgatgtgccgaattaaagatctgtttgcaaaaatagaacctacaggtcgagagcattccatttttatatgattttaatttttggatttgtacttttgcattcgagtccctgtaatttttatatttacatttgagttcctataatcttgcaaaaaaatgaaaagggcgaaataaagtccgatttctaatcagtatatatctcttctctatctctaatctaatctaacaatttaaaaatagaaaatgcacgagaaaataaaaattgttcaaataaaacgcgtgagaaaaaagttagaaaaaagcgcaaaaaacacgctaaaaaggttttacatcttccataaaacaaaaaaaaagcgcgagaaaaattatttccatcgctggtaaaaaaattttaaaaaaacatgcgaggaaaaaactgtaaaaaaatgcgctatttctaaaaaaaatggtttgaaaaaaccacgcaaggaa
